United States Patent 6,812,339 (POLYMORPHISMS IN KNOWN GENES ASSOCIATED WITH HUMAN DISEASE, METHODS OF DETECTION AND USES THEREOF) - sequence listing, part 57

SEQ ID NO: 15602 - DNA, 134890 bp, Human
aagggcatttgcggctcacagccaaccagctggtcggcattcctactacccaaatatctaaatgacataagggtgaatgtggggtgagggtgagaacgggaaaaaacacaggccgcaaattcagtcccatctggcacttcataagacttagtattttcatctttgtccttccaaatttataggtttactcttgcccaaccttcatattgtttttatgggtctccaggtgggtcatgcgtaggaaactttaggggactacttcatacttggtgggaagtacttaaacttgtaaaccccaagctaagggtagttatgatcccggtgggtggccaattctccccttaaacctatgtttatcctgcctttcctcccccttttcttaaacgagtcgggacggagagctgagtcacctgagacacagagaagggacttttgagagtgtcttccgtcccatttgcggacgttagatgagcacaccgggatccttgactcagcccgctctaggcgtgggcgttgtgtcattccccacacgtgacactctcccaggcggcagaaacctcacttgtcatgggacttattcactccagtgactccaccccttacctcctctgttccccaacctcccacttaccctttccgccccacttcaagacttgaggagaggagggtggctggagcctggaaatgtccccgtcccaagttggccagaagtagcagacacactatgtgggaaagtgccacatgtaacgttccagtttcacccttctccagaatgctatcacccttcctgtttattttttaataacttgagatataattcacacgccatatgattcactcacttaacgtgtaaagttgaatgtcttttagcatatttagagttgtgtattcatcactataatacattttttagaacatttttattatcccaaaacgaaatcccatacctattagcagtcactcccatttcccctcatctcacccttgctcttccatagcacaaaacagttctattctattcgagaccacctttccacttgggcagaccctggttatggttttttttccctccctttctgtttccagtttttttcggagcccggaattctcaatctgggtaattggtttgagtcccggctcagcccgtttcccgttgtagctgcgtgaccttgagagcaacgccactttcctgggcctagtttctttgtctgtgaaacgaggtccaaatatctacctctttacgcctgttgtggggatgaagtgagtaggtgctttgtgagctttaaaaagccatagaaatgccagctaagttaactcgtcactcttcccgaacccctccctttcccctgggacccgccccgcgaatcccgctgtggatggatacttctccccacccgccgaccgcagtctttcccattggcgcccgcaccgtcttcgcggcgccgggtgttgacgccatggcttcctccgccagcgcccgaagacgcttggccccgcccccggccgcgcctggcctcccgcggcgccccgcccatcgggccgacgcggcgccggccccgccccgcggatgacgtgtggcgcgcgcggccgggccgccccggcagttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggaggtgaggccggcggcagggcgggggccgcgggatccgtctccgggggcggccggggcgggggtcgcggcccggtcggggactagaggcgcgacgggcctcctggagggcgggcctgaggccgatgccccctgggaccgatcccggcggcctccaggtaccccgggagccaggccggcgttggaagccgaggccggctactgagtgtcctgggaagggagcgagatggaggaggcagggcccggggaggaagcggcagcctggcctgaggacacctggggttggccaagggcggagattgttgggtgtctggttgcttcttgttgagggaagtttccgaccaccgtgggatagtcagatggcggttcaaagttttacccttggggagggggacacttctgccctggatatgtaacttccgctagttccagtacctttccagggggttgccttgctttgggaagttagagatctccctctttcggtcagtttcttcttgacgttttaatcttgttgagaaagacgtcttattttatgttctatgtgccttggttgacactttgtcaacttttagatgttgtgtggcagtactcaataaatatataaacaatttcgttggtatcccaaaccaaagcattcctccgtatcaggttgtaaccttggacagttcccttcaaaaaccctccgtttatttataaaaaggattggggggcggggttgggaagatgtaggtgacagttggcaacactttttccgtctgagtttccttcttagactgctgtttatacgtgcatttggccacctgttaactctagcacccgagcagtgacctgggcgccctcacctcgactctgtgaaccttttggagttctagggtgcaagtgataggtccttggcttcttgagactgacaaggagtttagctttcagcctgcgttggcgttatttctgtggaccttatcaaaggcaggtgatgtgtcctatttttgtttctcaagcacctagcacacctgcttaaatacatggtgatcaaaggaggcgaaataactaattattgaaggaatgacatagtatttttcaaaaagacttgaagagtttttaggatgtgaggtttgtagctcatttcctgacactgaatagtaacaccattaaatttttgttttattttgtcacgtatacctttgcatctggttaaatagttctttttccttttttaaaagcttgactgtagtgatgatttttagttctgattgtgggatccaattttctcaaaggaatgctattgaatttgccaaacaaaattgcctttttttttttttttttttgagacgtagtctcactctgtcgcccagggtgaagtgcagtggagtgatcttggctcactgcaacctctgcctgccgggttcaagcgattcttgtgcctcagcttcctaaggagctaggacaacactccccgctcatttttgttttttgtagagacaggatttctccatggtgcctaggatggtcttgaactcctggcctcaagtgatctgcccactttggcctcgggctgaccatcccagtgctgggattacaggcatgagccaccgcaccccgccagaatggactatttcaagagcttttcctttcatatagggaaggaagggatgaaaaaccaaataatgataggatcacaatttccgcttgtttgttagcactctttatagaacagaggtcaagtgctacttgctgcttcatgctcatatagccccttgccagtgtgtggatatacatggaagtgactgggaattaaccacatgtacacacaggtgacaagcaagcctgacatgaccttttacctcacgtaaaataaatgctccctccagccttaaactcctgtcagtccgtgtaaatatgggcaaaatgccagggtcacacgtgccaagaaaaccatctgccacaggttgcagaatcagaaaacaaaattgcccgactgctagactctgggttccctattaatttcttgagtaaatgactctaaaaaaaataggttatccaatgaatttatttgtagtttatattttttcagttacatctgtaaattctccatagtgaaaccattgggcaaagggtcatgacctgagaacagagaacatttatgaaatgctaaatgagcccactcccaggccacaaacataaacacaccttgttatcagttttcttttctctttttttttttttttgagacagagtctctctctgtcgccaggctggagtgcagtggcacgatctcggctcactgcctcccgggttcaagcaattcttctgcctcagccgcccgagtagctgggactataggcacgtgccaccccgcccagctaatatgtatatatattttgtattttagtagagacggggtttcaccttgttgcccaggctggtcttgaactcctgagctcaggcaatccactcgcctcagcctcccaaagtactgggattacagatgtgagccaccacacccggccatcagttttcacataagatcataaattgtgtgttgctcagtatccagaaattgtctccctttggccaatatgtagagtgaattctgtgtttagttttctgtgagtgctttgtttgcgccttttttttttttttttttttttttgagacggagtcttgctctgtcacccaggctggagtgcagtggcacaatcttgactcactgcagcctccgcctcccgggttcaagcgattctgcctcagcctcttgagtagctgggattacaagcacgtgccaccacgcctggctaatttttttgtatttttggtagagacggggtttcaccattttagccaggatagtctcaatctcctgacctcgtgatctgcccgcctcagcctcccaaagtgctgggattacaggcatgagccaccgtgccggcctgtttgtgtctttaatgcggagaccaagagtcttttataccaaagtaagtgcctcagggtatttacagcaaaagtgatttgaaagcatggaaattatccatcaccagagagagtaaagtaaattctgagcacctctgtggaaacttaggtgggtatgtagatagaatgttttaggaatgtgtgaggtgctatgatctcttgcttgcaggaattctcagcaaggcatcaaaaatttaatctttatattgataggacatattttgaataccttctgactttttcctttgcttttatttgaatttctagtgtggagctagtctgctgttttagggattctttaaaaacaacctaaagaagggctaattttagatagatttggaccggtttcagatgctaatcaagaaatctgtcatcttatcgcccatcactctctcctttgggctgcctgtgacacacctctccattctttaaccaagacccgtctgatgcctttgcccatgctctagaatgctctccttagaattttacatagctagctcctcactttctactctgtttcaatttcactttttcagccagaacatcctgttgactctatccagaataagccctgtgaacctattgaataatttattttaaaatcagtgacttttaaatttaaattctttttggagacagagtctcaatcgcctaggctggggtgtagtggcacagtcacagttcactgcagcctcaatctcttgggctcaagtgatcctcttgcctcagcctcctgagtagctaggaccacagacatgcgttaccacactgggctaattaaattttttacagagacaaggtctcactgtgttgcccagtctggtctggaactcctgggctcaagtgatcctcctgccttgtggatcctgccaaagtgttgggacttacaggggtgagccactgtgccccagcccagtgattttttaaaataaaaatctggatacaaaatgatctggagagagaggttataactgggtatgttagggtttttctgcaacttctgattcttttaaaacaggcatgatttgctgtaacttttaaaaaagggccaggtgtggtggctcacatctatagtcccagcactttgggaggccgaggcagatggatcacttgaggtcaggagtgtgggaccagcctcgccaacatgatgaaaccctgtctgtactaaaaatacaaaaattatctgggtgtggtggtgggtgcctgtaatcccagctactggggaggctgatgcagaagaattgcttgaacccgggagatggaggttgcagtgagctgggatcgtgcctctgtactccagcctgggcagtagagtgagactacctctcaaaaaagaaaaaagaaaaaaaaaagaaacttctgaaaagtagacatacgagtttaaagaacctttaggaatttagttcttagtgattctgtgggtcttttatgttatcactgttattctcaaagtgagagctcatttagcatcattcagtagagggagattacacataaaaacgaagaggcattgtcttccttccttttctttttcttttcttttcttttcttttctttttttttgagatggagtttctcttgttgcccaggctagagtgcaatggtgccatctcggctcactgcaaccttcgcctcctgggttcaaacagttctcctgcctcagcctctcaagtagctgggattacaggcatgcgccaccacgcctggctaattttgtatttttagtggagttggggtttctgcatgttggtcaggctggtcttgaactcctgacctcaggtgatccgcccgccttggcctcctaaagtgctgggattgccactgtgaaccaccgcgcctggctccttccctcctttttgagatagactcatacatgcagagaatggactgaagagagaatatctttactgggaatggattatgtgattttgtgtctgcttttttgtggccttttgctttaaaaaaaaaaaaaaaaggatgagttcaagcctgggcaacgtagtgagacccctcttccccaaaaaccataaaaaaaattagttgggtgtgatggtgtgagcctgtagtcctagctactcaggaggctaaggcaggaggatcacttaagcccaggagtttgagactgcagtgagttatcatggccacggcactccagccttgacaacagggcaagaccctgtttcttaccaaaaaacaaaacaataggatgactgaatgcagaggtgagagacactactgagaattttctaacttgttcccatggaatcagcacttaaagcagtaacaaaatgatttttgtttaaatggagacttttgacacttcttgtctttggaagtgtatgaacatgggacccgtaagactcatgggcaggaaaataggtattgacattcattgttcttgttttagtgttctcattcattcataattttttttttttttgagacagagtctcactctgtcacccaggctggagtgcagtggcactatcccagctcattgcaacctctgcctcccaggttcaagcaattctcctgcctcagctgcctgagtagctgggattacaggtgtgcaccactacacccggctaatttttgtattttcagtagagacagggtttcaccatgttggccagggtggtgtaaaactcctgacctcaagtgattcatctgcctcaacctcccaaagtgctgggattacaggcgtgagccaccacacttggcccacacttgatattttattttttaattttatttatttttgagactgagtttcacgctctgttgcccaggctggggtgcagaggcacgatcttggcttactgcaacctctgccttctggattcaagcagttcttctgtctcagccttctgagtagctgggattataggcatgagccaccatgcccagctactttttgtatttttagtagagatggggtttcaccatgttagccaggctggtcttgaactcctgaccttgttatctgcctaccttggcctgccaaagtgttgggattacaggcatgagccaccatgcctggcccattttttaaaaaatttatttttgagacagagtcttgtgctgtcgcccaggctggagtgcagtggtgcgatctcagatcactgtaactcccaccttccaggttcaagcaattctcctgcctcagcctccctagtagtttgggattacaggcacgcgccagcacgcccggctaatttttgtagttttaatagagaaggggtttcaccatgttgtccaggctggtctcaaactcttgacctcaggtgatccccctgcctcggcctcccaaagtgctgggattacaagcgtgagccaccgcacctggcctaaaaaacacatattttaatatttttatagatcttttgattgattgattgagacgagatctcactctgttgcccaggccagagtgcagtggtgtaatcccggctgactgcaacctctgcctcctgggttcaagcgatcctcccatctcaacttccggaatagctgggactacaggatcatgccgccatgcctggctaatttttgtattttttgtagaaatgggtttcccatgttgcccaggctgatcttgaatatttgggctcagacattcctcgcacctcagcctcccaaagtgctgtgattacaggtgtgagccactgcacccaacctattttcttttgttgttgttgtttttttttttttgagatggggtcttgctttgccacccatgctggagtgcagtagcgcgatcttggctcactgcaacctctgcctcccgggttcaagcagttctcctgcctcatcctcctgagtagctgggactacaggtgctcacaaccacacctcgctaacttttgtatttttaatagagatggggttttaccatgttgtccaggctggtattgaactcctaacctcaggtgatccacctgccttggcctcccaaagtgctgggattacaggtgtgagacactgtgcccggccaacctattttctttttcttttctttctttttttttttttttttgatatggcatttcacacttgttgcccaggctggagcgcaatggtgcgatctcagctcactgcaacctccgcctcccagatacaaaggattctcctgcctcagcctcctgagtagctgggattacaggcatgtgccaccatggccagctaattttgtatttgtagtaaagatggggtttctccatgttggtcaggctggtctcgaactcccaacctcaggtgatccgccggcctcggcctcccaaagtgctgggattatgggtgtgagccaccacgcccggcagcggccaacattttttcatatttttaaaaataccattttttttttctgaactgtttgtttttgtgatttttttttcctttggttgggttttttttttttttcttttttttaaagatgaggttcaggctggagtgcagttgtgcaatcatggcccacagcagccttgacctccagggctcaagtagatcccacttcctcagcctctgagcagctgtgactacaggcatgcgccaccatgcctggctaatttttaattttttttgtagaaacagggtctcgttatgttatgcaagctgaactcactatgttgcccagtctggtctggaactcctgggctcaagtggatcctcctgccttgtggatcctgccaaagttttttttttttttttttttttttttttgttgagacagagtctggctctgtcgccagtctggagtgcagtggagtgtcttggcttgctgcaacctccaccacctgggttcaagcgattctcttgcttcagcctcctgagtagctgggactacaggcgcgcgccatcacacccagctaatttttgtatttttagtggagatggggtttcaccatgttggccaggatggtcttgatctcgacctcaagtcatctgcctgccccagcctcccaaagtgctaggattacaggtgtgagccactgcgcctggccttttttttttttttttttttgtagagatggggtcacactgtgttgcccaggcttgtcttgaactcctggcctcaagacattttcttacctcagcctcccaaagtgttgggattgtaggtgtgagccaccacacctggccatggttaacgattcgaataatgttcacactgcccctagccagagtagatagagatatgcccctgcacctagtcattcagacactttctgaaatgaacaatctatgtttgttttctggcgggagtgggatgggaaggggtatggttgttgctttatgaaataataatttgttagttaattattacttaagctcctaagacatttttttttaaagacaaagactagctctggattaagacatctttttttaaatttgagatttctgaatgtgaatatctaaatgagataccattatgtgtccctgctgtagtgacactcatatttttatttagttaaaaatcacaaaagaacgctacgcatggtggctcatgcctgtaatttcagcactttgggaggccgaggtggtggattgcctgaggtcaggagttcaagaccagccctgaccaacatggtgaaaccccgtctctactaaaaatacaaaaattaactgggcatggtggcggacgcctgtaatccaagctactccggaggcagaggaaggaaaatcacttgtacctgggaggcggaggttgtagtgagccaatatcttgccattgaactccagcctgagctacagagtgagactgtgtcttcaaaagaaaaaacaaaacaaaaaaaaatcacaaaagaggacaccaaactgggtatagtaccaaactggttcagagggtagattagtagattgactattcactggattgctgaagtgtgtgccataggtcacacatccagttctgtgcttgagagagtacaggattcctgcttcttgaaatctttaccttacctttaactacatgctgcttacttatgttgtactgaactttgcttctcaggagaactgatgttagaacctacccaagttattttgctctgctctgcactcaatgaatacagctgttatctaaataagttattaggttgtggtcagaaatatctgcatagaccagtttaataatgtatgtaatgttatatatatttaaaaagctgttatttggaaatgggtatatataagttctgttttttactttgaaatcttgaccagtgatatttgattattgctttgaacatagcactgtgttttcttttctttttttttttgagacggagtcttgctctgtcaccctggctggagtgcagtggcgggatctcggctcactgcaacctccgcctcctggattcaagcgattctcctgcctcagcctcccgtgtagctgggactacaggcgcccgccaccacacccggctaattttttgtatttttagtagagatggggtttcactgcgttagccaggatggtctcaatctgacctcgtgatctgcccgcctcggcctcccaaagtggtgggattacaggcatgagccacccacccggccatactgtgttttattttcttaagaattacagcattcagtagtttggcataataggcacacccaaaaatgtgtgaggtgaaccatgggaatttatatattaatgtaatagagaagtaccaagttgagggtatagaattttattttatgttatttttttcgagacaaggtctggcccaggttggagtgcagtggtgcgatcttggctcactgcaactgttgcctcttgggctcaagccatccttccgtctcagcctcccaagtagatgggactacaggtgtacaccaccacgcccagctaatttttgatattttgtaaagacgggtttcaccatgttgcccaggctggtctcgaatttgtgagctcaagtgatctgcctgcctcggcctcccaaagtgctgggattacaagcgtgagccaccacgtccagctagggttttttttttttttttgtaaggttagtaaactttttcagtaaatccaccaccacccctcccaactttttattaggtaaactttcaaacatatagaaaaatggaaagtacatttgtcatttgtatacccactatatagattcagtagttgttgttttatttatctgtctgtatatgtggatgtgtgggtgtggatacacatatacacacatacacatatttaattgctgaaccattttaaattgcagacatactttgcccctcagtacttaacatatttaaattacagacattatgatactttgcctctcagtacttaacatatttatctcctaaaaaatgagaatattctgccatataaccaccatattatttacgtttgagaacatttccaaggccgagtgtagtagctaatgcctgtaatcccagcactttgggaggctgaggtgggcggaacacttgagctcatgagttgaagatcagcctgggtaacatagcaaaaccttgtctctacaaaaaatataaaaattagcgtggtgtggtggtgtgtgcctatagtcccagctacttggggggccgaggcaggaggatcgcaccagcctaggaagtcaaggctgaggtaagatgtgttcatgccactgtgctccagcctgggcaacacagtgagactctgtcaaaaagaaaagaaaagaaaaaaaagaacctttgtaatatcatctaatattaatttgaattaatttttaagagcacagtatgtgtcagttattatatagctaactagcttcttaatatgtttataatgaattaatgaaactcatctgggaggaagtgtttgcattttagttacttttctataagaaatttaaatttgaggccggacgcagtggctcacgcctgtaatcccagcactttggaaggccgaggtgggcagatcacgaggtcaagagttcgagaccagcctgaccaacatggtgaaaccccgtctctactaaaaatacaaaaattagctgggcatggtggtgtgtgcctgtaatcccagctactccggaggctgaagcaagagaatcacttgaacctgggaggtggaggttgtggtgagctgagatcgtgccacggcactccagcctaggcgacagagcaagactccatctcaaaaaagaaaaaagaaaaagaaaaagaaatttaaatgtgaaatatataaaacggaattaaaattggctaattttgttttaaaattagcacattggccaggcgtggtggctcatgcctgtaatcttagcacttggggagtctgaggcgggcggatcacctgaggtcaggagttcgagaccagcctgaccaacatggagaaaccctgtctctactaaaaatataaaagtagctgggcttggtggtgcacgtctgtaatcccagctactcaggaggctgaggcaggagaatcgcttgaacccaggaggctgaggcaggagaatcatgtgaacccgggaggtggaggttgcagtgagctgagatcatgccattgcactccagcctgggcaacaagagcgaaacttttgtctcaaaaaaaaataaaaataaataaataaaattatcacataaaaactattatggaccaggcacagtggctcatgcttataatcttagcagtttgggaggccaaggaaggaggatagcttgagccccagagttccagaacagcctgggcaacatagtgagaccgtatctttacaaaaaatagaaaaattagccgagtgtggtggtatgcacctgtggctccagctacttgagacgctgaggtgggaggatcccttgagcccaggaggttgaggttgcaatgacccctgattgtgccactgcactctggcacacagcaccacttgctctgggtgacagagcaagaccctgtctcaaaaagaaaacaaattatttttcccctttttgaaactttgagatatagaaatacagaaaatgaccctatatttaatatttttgctagtaactattttttttttttttttttgagacagtctttcgctttgtcacctaggctggagtgtagtggtgcaatttcatctcaccacaacctctgcctcctgggttcaagtgattcttgtgcctcagccttctgagtagctgggactacaggtgcctgccaccacacccagctaatttttgtatttttagtagagacggggttttgccatgttgaccatgctggtcttgaacttgcaacctcaggtgacctgcctgcctcagcctcccaaaatgctgggataaccagcaccagccaccgccccatggccatcttttttttttttttttcttaaatcatgtatttccaggatatcttgtttctgacttgtttacctactctgccagggttatagagcctgagaaattcttttacctgctgataagatttcctctggggtataggcctggaatttttatgattctggattctattactgcccccctccctttttttttttgagacagtgtctcatgctattgcccaggctggagagcagtgttgcaatcagagctcactgtagcctcaacctcctgggctcaagctatccccctaccttagcctcccaagtaactgagattatagttgtgagccacatgcaacatctattattgccttttttttttttttaaccttttttttgatggagtcttgctgtcgcccaggctggagtgcaatggcatgatctcggctcactgcaacctccacctcccgggttcaagcaattctcctgcctcagcctcccgagtagctgagagtataggcgcgtgccaccatgcccagctaatttttgtagttttagtagagatggggttttaccatattggccaggctggtctcaaactcctaaccttgtgatctgcccaccttggcctcccaaagtgctgggattacaggcgtgagccaccgtgtctgactattattgccctttaaagtgtgttttctcttgttcttcctgcagttttaattaaattaattaattttttttggtagggatgggggtcagactatgttgcccaggctggtctcaaactcctggcctcaaatgatctgccgccttggcctcccaaggtgctgggattgcaggtgtgagccactgcatccggccttcctgcagtttcttttaaagagctggacaggaactttatgattctctagttctaccttatcccattcccccaagtaggtggaaagataaacagaaacatagatgcttagaaagaacaaatatttattgagccaggctctgttctttttcttttttttttttttttgagatggagcactcgctcttgcccaggctagagtgcagtggcgggatcttggctcgctgcaacctccgcctcccgggttcaagcgattcttctgcctcagccttccaagtagctgggactacaggcgtgcaccgccatgcttggctaatttttgtatttttagtagagacggggtttcaccatattagccaggctggtcttgaactcctgaccttgtgatctgcacacttcagcctcccaaagtgctaggattacaggcgtgagccactgcacccggacttttttatttttatttttaaaaattaagacagagtcttgctctattgcccagactggagtgcagtggcttgatcttggatcactgcaacctccgcctcccaggttcaagtgattttcccaccctagcttcctgagcagctgggattacaggcacctgccaccacacctggctaatttttgtatttttggtagagacagggtttcaccatgttggccaggctggtcttgaattcctgaccttgagtgacccacctcccttggcctcccaaagtgctgggattacaggcatgagccaccgcgcctggcagaacaaggcactgttctaagccctggggatgtagccactaatgaaacagacaaggaaggtagcctatcttgtcttggagtttacattgcaataaacaataagcaaaccagttaattacagattgtgatagatgtgatgggataaagactagagtggcaggtactttattttacttaaaaatttttttaaattttattttatctatttattttgagacacggtcttgctctgtcacccaggctggtgtgcagtggagtgatcatagctcactgcagcctcgaattcctgggttcaagtgattcttttgcctcaacctcctgagtagctaggactacaggtgtatgccatcatgcccagctagtgtgtgtgtgtgtgtgtgtgtgtgtgtgtgtgtgtgtgtgtgtgtgtgtagagatgggggtcttgctgtgttgcccaggatgggcacttgaactcctggcctcaagtgatcctcctgcctctgcttcccaaagtgctggtattacagacatgaaccactgcgcctggccataattttattttttttaaccaagcaagcagcagtgaagaggtaggcactttagatggaacaaacaagttaataaaggttaagctttaagtgttttttctttttctctttttttttgagacagcctgctctgtcgcccaggctggagtgcagtggcgcaatctcggctcactgcaagctccatctcccgggttcacgccattctcctgcctcagcctcctgagtagctgggactacaggcgcccgccaccatgcccagctaatttttttgtatttttagtagagacgaggtttcactgtgttagccaggatggcctcgatctcctgacctcgtgatctgcccacctcgcctcccaaagtgctgggattacaggcttgagccactgcgcccggccaagctttaagtgttttttcaagctactggggaagaaaagggaagaagaaaaggttaagctgctctttcagcaaataattcatttcatctcataagataattatttagatctgaaactttagatacatattcagagtgtctcctactcattattcttgaacattcagaaaagttagctctcataaatgcctgtcttgttttctatcttattccttctcatacttgatgtctcagcagtgttttttggctacttcttcctttgagaaacattacatttagtttgtttgactttgaaattccttggctttcctcttacctacgtgaccattctgtggattcttcttactcagatgaatgttgtgctcctgggctttctttctaagaatttctattcccaggggttcaatttaccatttgttgattattacaaaatgtttaacctactcatctaacagattttatttatttatttatttatttatctatttatttttgagacagagtctcgctcagtcgcctaggctggagtgcagtggcgtgatctcggctcactgcaagctctgcctccccagttcacaccattctcctgcctcagcctcccgagtagctgggactacaggcgcctgccaccacacccagctaatttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggccttccaaagtgctgggattacaggcgtgagccaccgcacccggcctatttatttatttttgagatggcgttttgctcttgttacccaggctggagtgcaatggtgtgaactcgcctcgccatcacctccacctcccgggttcaagcgattctcctgtctcagcctctggagtagctgggattacaggcaagcgccaccacacctggctaattttgtagttttagtagagatggtgtttcttcatgttggtcagactggtcttgatctcgcgaccttgggtgatccgtccaccttggactcccaaagtgctagaattacaggtgtaagccaccacgcctggccttacagatactttcattgagtgccaactatgtgcatgatactgtgcccattgggcatacagtggtgagtaaaacagacaaggtccttctctcatggaactgatagcctactttaaggccagatctctctctggagtttcagattcatcttatgattgtttattgggtgtgaatatctcccagcgtgtccaaaactgaacttatttcccaaacctggttctcttttcttccctatcttcatgaaggataccaccatctacctggccagaaatcaggttaccatccctaactcttcctcattcccattgctgctttcttttgttttcaacttttaaatattgctggaatctcattactttctaaatccatttatactactgtggtacaggacaccaatatcgctcaccctgaatgcaaactccatagacctggaagtttgtcattcaccactatatcccagtagctagcacgttgaaagtgccagggaaatttttctgaatagatgaatggacaactgaaactagtccataactgatttttctgcttccagtatggccaacctataaaccgcccatctctccaaaatggaaatctgatcagatcattccacaagcccttagtggctttttctcaaattcctgggctcaagtggtcctctcacttcagcttctcaaaatgctgagaatacagatgtgaggcaccgtgcctggccagttgctctttctaaagctcttgaaaatgacttaagttcctaacatacaagaccttgtgatctggctgccccaatcttgtcagtctcatctgtttctttttgagccacagtgaacattttgaatttggtttgtaaaaagtatcctctctccaggccttcctaaaagctgtccctttgcttggcactcactttctcttcttttctgttgccttattttatttatctttcaggtttcaattctggaaagccttaacacccgactgtggtttgggcacattttatatccttccacagcttacagtcctcttgccctcttgtagcactttcagcgctgtgtcaaactaacctattgcttttattctcccaccaactaggatgcagtagataattaacagaaatttgttggttggatggatggatatgctaaaggtcaaattgctaagactaaccatttaaagttctctttgtgcattcaaattatcgttcctacttctggtgccaagttatgctaaaacttccaaaaagtttttcaataagtcctttcacttttgcatatacagaaaaaccatgacttctcctgggtataattatttcagacttatttcagacactttacctacattgccttatacttactattctgtaaatatttatgcatttaaaaaatctaaatgttaagatcattggaattactttcagaagtattgtaggaattcaagccgggtatagcaacacacgcctgaagtcccagctactcaagagattgagcccaggattcaaggccagctgggcaacatagcgagaccccatctctaaaaataacagtgataatattaataatgccaggtgcagtggctcatgcctgtaatctcagcactttgggaggccgagttgggcagattatttgaggtcaggggttcgagaccagcctggccaacatggtaaaaccccatctctactaaaaatacaaaaaattagccaggtgtggtggtgcacacctgtaatctcagctactggggaggctgaggcaggagaatcgcttgaacccaggaggtggaggttgcagtgaatgaagatcatgccactgcactgcagccttgggtgacagagcgagactccacctcaaaaaaaaaaaatttccatacaaatgaagattaagtgccaaaacttaattttaactcttcgtttcttctcttatgttagacatttctatttttttcttttcttttttttttttttgcagacagagtctcacactgtcacccaggctggagtgaagagtcatgatcttggctcactgtaacctctggcctttaggttcaagcgattctcgtgcctcagccttccaagtagctgggactacaggcgtgtgccaccatgcctggctaattttttgtattttagtattttatgttttttgtattttagagacggggtttcaccatgttgctcagcctggtatcaaattcctgagctcaggcagttcgcccaccttggcctcccaaaatgctaggattacaaatgtgagccactgtgcatggcccatgttagacctttctaatcaggattcagcagtaccttagagtaacagataaaatggtgagtaaaacaacatttatttctgaagaaaacatttgttctaaagaaaaataaacaattatttttgggggcgtggaaatccatgttggttaaaagcctgtgctagactattatggtataggccaggcgcggtggcttatgcctataatcccagcactttgggaggccaaggagggcagatcacctgaggtcaggagtttgagaacagtctggccaacatggtgaaaccccgtctctactaaaaatacaaaaaattagccaggcatggtggcgggtgcctataatcccagctactccggaggctgagacaggagaattgcttgaacctgggaggtggagattgcagtgagctgaggttgcaccattgcactccagcctgggcaacaatagtgaaactccatccctcccctgtccccctcaaaaaaaaaaggactattatggtataaatcaaatttctagttttaattatgtactcctcaattttgaattttctttcagttacctgttctagcctagccacattttgttactgctacctgtcagaaacaaataccttttttgtttgtttgttttctatttttattttttgccaggcatcagatgatggcaaaacaaatacctttttaaaggttaagcagttttttcaaagtgtagcatcaaaccagaaaggtaattttttttttttttttttttttttttgagacagaatctcacagtgtcactcaggctggagtgcagtagtgcgatctcggctcactgtaacctctgcctcctgggtttgagcaattctcctgcctcagcctcccaagtagctgggactacaggtgtgcgccaccaagcccagctaatttttgtatttttagtagagacggtgtttcaccaagttggccaggatggtcttgatctcttgacctcgtgatccacctgccttggcctccctgaatgctaggattacaggcatgagccaccatgcccagccccataagggtcacttttaaaaagacgattgcctatggtttctctgtgaaaatagtccatttgaacttgtttgatgtaatttggacacatttggcagaaattacacactcatttttggctttgtttagttttaacttttttttttttagacggagttttgctcttattgcccaggctggagtacaatggcgcaatcttggctcaccgcaacctctgccccgccaggttcaagcgattctcttgcctcagcctcccaagtagctgggattacaggcatgcaccaccatgcctggctaattttgtatttttagtagagagggggtttctccatgttagtcaggctggtctggaactcccaacctcagttgatcctcccgccttggcgtcccaaagtaccagattacagatgtgagccactgcacctggccatttttttttgaaggcagggtctctctgtcctagactggagtgcagtggcacgattatggctcactgcagccttgacttcagtctcatgtgatccttccacctcagcctcccaagtagcaggtactgtaggtactgtcacaagtattataggcatcaagccagacaccaccatgtccagttaatttttgtaatttttgtagagacaggatctcaccatgttgcccaggctggtctgaaacttctgggctcaagcagtctgcccaccttggcctcccaaagtgctgggattataggtgtgagccactgtgcctgaccctagttttaactctttaaaaaatacttttatcttgggataggaattcagtccataattggctcagttttaaccatccttaacctagccaagggccaggaattaaacagaattctcagcagccaaattaaatgtctcaagcattaaagtttgttatcttggcttactgaagaaacatttaagtgcaaagtgcttatttacccttattttatttttatttttttggagacagagtctcactctgttgctcaggctggagtgcagtggcacaatctcggtccattgcaactcccgcctcccaggttcaagtgattgtcttgcctcaggctcctgagtagctggagttacaggtgccttccacaatgcctggctaatttttttatttttggtagagacaaggttttgtctttttggccaggctggtctcgaagtcctgacttcaggtgatccacctgtctcggcctcccaaagtgctgggattacaggcgtgagccactgcgcctggctgggtcttttttaagataacaatttctagttttttttttttttttttttttttttttttagtaatagaagaatattttcataacagagtcaagtgttgaagcaaaaaccacagtgtcaggattgaagatctgtaaattaaagtcagaaatgtaagatgttggccatatacctacagaagcacataactgtgtaacaaagttagtaaggcatcacttggctgatgtagcaaacatcataacacaggtagagcattcctagtctgaaaatgtgaaatctgaaatgcttcaaaatctgaaactttttgcatgctgagatgacgtcacaagttactttgaacatactactatttcactgtattttttttcctttttttttttttttttttgagacagagttttgctcttattgcccaggctggagtgcaatggcgctatctcggctcactgcaacctccgcctcctgggttcaagcgattctcctgcctcagcctcccaagtagctgggattataggaatgcgccaccacgcctggctgattttgtatttttattggagacggggtttctccacgttggtcaggctggtctcaaactgctgacctcaggtgatctgcccacctcggtctctcaaagtgttgggattacaggcgtgagccaccacgcctggccaattttcactgtagtaatggtacatcatattcttttttttttttttttttttgagacggagtctcgctctgtcacccagcctggagtgcagtggcactatctcagctcactgcagcctctgcctcctgggttcaagcagttcttctgcctcagcctccccagtagatgggaccacaggcaagcgccgccacactcggctaatttttgtatttttagtagagaccgggtttcagcatattggccaggatggtcttgatctcctgaccttgtgatccgcccgccttggcctcccaaattgctgggattactggcgtgagccactgtgcccggcccaaagtaaccaattctttaaacccatccggctgggcacagtggctcatgcctatagtcccagcactttgggaggccgaggggggcggatcacctgaggtcagaagttcagaccagcctgacaacacagagaaaccccgtctctactaaaaatacagaaaattagtctggcgtggtggcagatgcctgtaatctcagctactggggaggctgagttaggagaatcggttgaaccctggaggcagacgttgcagtgagccgagatcacaccactgcactccaacctgggcaacaagagcgaaactccgtctcaaataaataaataaataagtaaaaacccatttacccccacaggcttgtgagactggttggaagaagtgctgctaggcagggcctgtgtgtttggaaaaaaaaatcactcagggtgtttgtgattataactgtctcacccttccctctaattcagaaaccattgcttaagagtggaaaaaaaaaaccacgaactgtctgtcttctgctctcacaccaaaaacaatcagcccgctgtatttgtagttcatgagcatggtgattgggtgttcatgcaggtgtgtgagatatgccacccttgaaccttgttacaacactggcacattctcagacctgaaaaaaaaaacacacataacacagaagacttctgtgaccaaatatgtggggtagggcaggtgcagtggctcatgcctataatcccagtgctttgggaggctgaggcaggtggattgcttgagcccaggagtttgaaaccagcctgagcaacatgatgaaaccctgtctctacagaaaaatacaaaaattagctgagcatggtggcatgtgcctgtagtcccaactacttggaaggctgaggcaggaggattgcttgagccctgaaggtcgaggttgcagtgagccctgaaggtcaaggttgcagtgagctgggatcgtgtcacctgcactccaacccaggcaacagagtgagaccctatcttaaaaagcaaacaaataaaaaaatatgggagtgtttttccctaccagcaagcaatcagttctgcatcaggcaccagctaggtgtcatctaacttaatactgacactgtctacttgagatagtgtcacatcccacagtttgaggtctcagtccccaagactaccgacaacacttatgccaatctcaagcctcaggttattttatctgtgcttctgaccaacctgccatgtatatatatgtacatatatatgtatatgtgtgtgtgtgtatataatgtagataccataattttttttctttatgagatgaaggtcttgctgtgttgcccaggctgatcttgaattcctgggtgcaagctgtcttcctgcctcagcctccgaatcactgggattacagtcatgtgccaccttgcccagctactgtcttttatttttgatgaatcctctgtgtccagtacagtctcaactggctataaactggggttcccacaaccccctcctcaggttcagttgacttgctgaatggtttgcagaacctggggaaacagttatgtttactgttacaaaggatgtagatgaaaagatgcgtaaagcagggtatgggggtagtggtgcagagcttccatgccctccctgtacatgtcaccctgcaggaacctccatgtgttcagctatctggaagatctctcaaccttgttcttttgagtttttatggaggcgtcactacgtaggtatgaaaccattggtcattggtgatcaacttcaccttcagcccctttcccctcctgggaggttgtgtggggtgggctgaaagtcctaaccctctaattatgcttttggtctttccaatgaccagctcccatccttaagctatgtaggggctgccagccatgaatctacccattaacatacaaaaagacatctctctggagattctaaggattttaggaattatattttaggaattatatgttaggaaactgggtcagagaccaaatacgtatttcacgatatcacactgttacattcttatataatcttgcattttatttttttttacctgttgatctgtccatgttgatatacatatgcatctaattctttccttttaactgctgtgtattccatcgatgacatgaatataccactatccattcttcattaccacattatatattacaaatgttgttgtagtaacattcggtgcatatgtaagatcttctcaaagtatatattttagaaataggatgccaggttttaggatatgtatttgtaaaattaactagataaggtaacattgcttgtcaaaggagtgcagtgatttatattcctatcagtagtataaaagacttcttattttcttgtatctttgccaacacttcctgcactatcagactttttggtttctgttgcctgtctgatgtggttgaaaccacttctttctttctttcttttttttgtttttttttgagacagagtctcactctgtcacccaggctggagtgcagtggagcagtcttggctcactgcaacctccgcctcctgggttcaagcaattctgctgcctcagcctcccaagtagctgggactacaagtgcatgcctcctccatgtctggctgatttttgtgtttttagtagagtcagggttttaccatgttgacaaggccggtctcgaactcctaacctcaaatgatccacccacctcagcctcccaaagttctgggattacaggtgtgaaaccactttatatatatatatatatcactatatatatatatcactatatatatatatatcactatatatatatatcactatatatatatatcactatatatatatcactatatatatatatcactatatatataactatatcactatatatatcactatatatatatcactatatatatcactgtatatatcactatatatatcacatcactatatatatatcactatatatatcactatatatctctccctatatatatctcactatatatcactatacgtatatcactatatatatcactatatgtatatcactatatatatatcactatatgtatatatcactatatgtatatatcactatatatatcactatatatatatcactatatatatatatacacatttttttctttttttggagatggattctcactctgtcgcccaggctggagtgcagtggcatgatctcggctcactgcagcctccacctcccaggttcaagtgattcttctgcctcagcctcccgagtagctggaactacaggtgcgcaccaccatgcctggctcatttttgtattttcagtagagaaggggtttcatcatttctcagcctttggctaagatcaagtgagacggggtttcaccatgttggtcaggctggtcttgaactcctgacctcatgatctgccccttcagtctcccaaagtgctgggattacaggcgtgagccaccgtgcctggctgccacttttttttttttttttttttttttttaaagatggagtctcactctgtcccccaggctggagtgcagtggcgagttctcggctcattgcaagctccatctcctgggttcctgccattctcctgcctcagcctcccggtagctgggactacaggtgcccgccaccacgcccggctaattttttttgtatttttagtagagacggggtttcacagtgttagccaggatggtctcgatctcctgacctcgtgatccatgcacctcggcctcccgaagtgctgggattacaggcgtcagccaccgcgcccagcctggccaccacttcttattttaatttgcttttgtcagatcagtagtgtgcttgagcatgttttacatttactggtgattctacttctctgtgaattgcctattcagtttcattcactgataactggcacaaactatgtctggaagtacatagctatatatttttaatggttttatagtattccattataggatcatcacttaggtgaaaaggatcattacttggggaatccagagtttaaaagagacttaagagatatattatccaaatgtaatgtatgaaccttgtttggatcttgagtgtaaaaacatatatgagacaacctggaaaactggatattccttattatatcattaggggttgggaaatggtgctatttcaatccagttattccttcaacatttatcagctaaattttcttgtaaaggaaacttcccctcatcaactgtttggttaccctaaggtatagtttgtatataagaaagacaaaaagtgctggattcgtcaattcatactttaataatttccaagtgctctttcctgttttgtttccctcctcactacttttaaaaatagcatactattctggttccatgggagcaatgacttttctttggtctctgagtatattaattatagttttcatttgttccctgctttgtctgttttgtcagagtcccatttttatttcttatagttttggtttctctctttcaggctagaacttaaagtgccttataattcttaattatccttcatgttttaaaagtgagacactaaaaaaggagggttggaagctttgtgtgcctggatacagtttactgcctcttggcaacccagatttcaatatcccatggtcctttcgtagagacacttgagtttttccagagaaggatagtctctttgaggtgtggctggtggagtggtaggtaagcctagatatttacattattgcaacctgggtgaaggcaggaaggaggccctattactgtttagtacgtagactttagaccttcatgtaattccacttgtcatttggcacctgcctggctgtgcctagagtgttcctagtctaaaatttctggttgagtttattgagaaaacaaacctcttatttcctgtgtgggtgagcaaggaaggccacctggccagtctggtgtgggactgtctacctactagggatattactaactagtgattttagacttccactcaaccctcctgttttcagtcccaccctcacacaccacaccagttttctattacatactttccatagtatggatctgttataattttcttttttttttttttttttttttgagacggagtcttgctctgtcgcccaggctggagtgcagtggcgcaatctcggctcactgtgagctccatctcctgggttcacgccattctcctgcctcagcctcccgagtagcagggactagaggcacccgccaccacgcctggctgatttttttagtagagacggggtttcaccatgttagccaggacggtctcgatctcctgactttgtgatccacccgcctcggcctcccaaagtgcagggattacaggcgtgagccaccatgcctggccagatctattataattttcttatccactgtctgttgatagacatttaagttatcttccagttgtgaactgttacaaatagcccttcaatgaatgtctttgtacatgcccctttctgcatatttgctttttaatggcaggacaaacttttttcatattaaacaccactgatacttttattccaataatttattttcatttttttgttttttttaaaaagagggttttgctattttgcctaggcttgtctcgaactcctgagctcaagcaatctgtccacctcagcctcccaaagtgctgggattacaagcatgagccactatgcctggccaacttttttttttttttttttttacagaaatatctaaacattgatgattaccgagaatagtagaatatatttgaactcccatatacccatcattcaacttcagcagttaccaacaaaatgccaatattttttctttagaaaaaaaaattttttaagagacatttgcttgctctgtagcccaggcaggcgtgcagtggtgtgatcatagctcactgcagcttagaactcctgggctaaagcaatcctcccagtttagcttcctgagtagctagaactacaggtgtctgccaccacgtccagctaaatttttctttttctttttttcttttttttttttttttgtagagacaagggtctctctatgttccccaggctgttctcaaactctcggcctcaagtgatcttcccacctttgcctcccaaagcactgagattacaggcgtgagccactgtgcctggccaaaccaatttttcaccataatattaaggcagaccaaagactatatcattgtatctttaggagatagggctgtttaacaaatataaccacaacaccattaacacatctaaaacttataaacaattactctttaataatatttaatacttaataagtgttcatatttccctaattgtctcttaaatgtagttttgtagttggttgttttcaatcagtatctaaacaagagagtctatacatttatacttggttcaatatgtctcaagttcctctttatatataatggttctttttttctttttttccccacttgacatttattgtagaagaaaccaaatcatttgtgttaaaaaattttccacattttggacttggaagggattatatcccttgagtgttatttaatatggtcttcaatcctgtcttatttcttaaaagaaattacatttaaaaacaattacatttaactaattaatataatatcttgatggacacttaataagccagccctttatttgatactattttttagacaagtactatagtcaaagtatttaaatggctattctttttcttttctttcttttttcttctgcatctttactccaacaagcaacaacctttagggaattttttttttttttttttttaactttgggagcttgtcttttcaaagtattcatttgtttttccccagaacagtggggcgaaacagtccctataagccatctggacttaaaagcattttgcttcatcacaaagcttactctttttagatcctgacataagtctgtattgtccactgatttttttttttttaacggtgtctagttgctcccaggagagttgtctgaagtcactttaatgttgttgctggcctattagttattgaaagggaagaggggtatttagtgaagatgtgttattatacctgctgaaaaagctcattcacaggcccttaatccccctagtccttaaaaaaaagtgggtatgtgtgtgagaaaaacagaaaaggggaggagtatgtgcgtttcataccaacatacctgagtgatctgacaaatgcttgtgctgaggggactctctggaatttccagggctaatgtggttttataatatgcaaacaacaacaacaacaacaaaaaaacagaaaaacaaacaaaaaaaactgctgcgcttctcctgccacgattttgctgttggcctaaccctatcgtggttattctaaggtttgccaagcgtagtagagggtgaccaacttataaagtcatgccactggcaagcaattaagtcacattaaatcattaatgactatcctagactttttatgagcattcatttccttttttttttttttttttgtatacagggtcttgatccgtcgctcaggctggagtgcagtggctcactctcagctcactgcaacctctgcctcctgggcttggtgatcccctcccacctcagcctttgagtagctgggactacagatgcacaccactacaccaggctaattttcatatttttcgtggagacagggtttcgtggagacagagtcatattgcccaggctggtgtcgaactcctgagcttgagtgatgagccctccttggcctcccaaagtgctgggattatacaagcatgagccaccgtgcctggcctgtgctttttcttgttcacatatgtaatttcagtgtggttacattatatgcagacttgaactatgtgatttttaaaagtttcatttcatattcagagtttgaaatgttaccttctcatttcagaaagtcttcagaaatcatgttatatgaaagcctgactgagctgtaaaccaatgttgtgctgttatcctatgttggtattacctaggcagtaacagaaatatcagccatctcttatcagccttaacctcaattaggtgactgttgaattatgcaagatcttttgtaaatcgatcttttttataaaatgtaattacccatgattaagacctttcatcttctgttaaatttcaatcaatagaacatagggctctcttgtaacttactacatttcccagtaccttggaatatttaaaacaataggggctcaagttgtgttttgaaaagatggatgaatgtaatctttttttttgagatggagtcttgctctgttgcccaggctggactcggctcactgcaacctctgcctcccaggttcaagcaattctcctgtctcagcctccccagtacctgggattacaggcatctgccaccacacctggctaatttttgtatttttagtagagatggggttttgccatgttggccaggctggtcttgaattcctgacctcatgatctgcttgcctcggcctcccaaaaatgctgggattacaggcttgagccaccgcacctggccaagtggaatcttacttgtcttttttactcgctttgtgaatcagagagattctcaacttattctttagtttatagtttacctttacatcgactcaaaatttaatggtgaattgtagttacctgggcatgccatgatctttagacgtttgcatgtgctgtgacctctgcctggaatgtctttatctcagtaaaggttttaggcaaaccattccttttagagtaagctaaaatgacttctctcttttttaaaaaaatagtatatatggccgggcacggtggctcacgcctgtaatccagcactttgggaggctaaggcaggtggatcacctgaggtcaggagttcgagaccagcctggccaacatggtgaaaccttgtctctactaaaaatacaaaaaattagctgggcatggtggtgggtgcctgtaatcccagccactcgtgaggctgaggcagggagaattgcttgaatctggtaggcagaggttgcagggagccaagatcatgccactgcactccagcctgggtcacagagcgagactccatatcaaaaaaaagaaagtgtgtgtgtgtatgtgtatatatatatatatatatatatatatatatatatatatatataaaataaagtgtatatatatacatataataagtagatatacacatatatattataattatatatatataattttatttcaatattttttggggaacaggtagtttttggttacatggataagttctttagtggtgatttccgagatttcggtgcacctgtcgacttcttttttgtttgtttgtttttttgtttttttgagacagagtttcactcttgttgcccaggctggagtgcaatggcacagtctcacctcagtgcaacctctacctcttgggttcaagtgattctcctgcctcagccttccaagtagctgggattacaggtgcccaccaccaggctcagctaatttttgtatttttagtagagacagggctttaccatgttggctaggctggtctcgaactcctgacctcaggtggtccacctgcctcggcctcccaaagtgctaggattacaggcatgagccaccgtgcctggcccaacttctgttttttttttgtgtgtgtgtgttttgttttgttttgtttttgagacagaatctccctctgttgctcaagctggagtgcagtggcgcaatctcgctcaccgcaacccctgcctaccaggttcaagtgattctcctgcctcagccttccgagtagctgggactacaggcgggtgccacctcgcctggctaattttagtatttttagtagatgcggggttgcaccatgttggccagagtggtctccatctcttgaccacatgacccacctgcctcggcctcccaaagtgctgggattacaggcgtgagcaactgtgcccacctcccatttttttttttgagacggagtctcactgtgttgcccaggctggagtgcagtggcacgatctcggctcactgcaagctctgccgaccaagttcatgccattctcctacctcagcctcctgagtagctgggactacaggcgcccgccaccaagtccgcctaattttttttgtatttttagtagagacgaggtttcaccgtgttagccaggttggtctcgatctcctgatctcgtgatctgcccaccttggcctcccaaagtactgagattacaggtgtgagccactgtgtccagccttgacttcccttttttaaagcagatttagtcacttcttcctctctgctttcattatagcacttagcgtgttacactgtaaatgtttatgatacgtctttgatggctctcatacagtgagtactcctattggatgggtgggcaaagagttttagttttatatttaacatgttattttatctaagaataagtcctatgaatgacattacctagtttgtagtaaatatcatcatgctgcctaactgcctagcatttggagaataggcattgtgaataggtgtgtggcttaactattacaacagctttttcctagtctcttaactatgacaagtttttctttgactacagagtgacggactgggatgtttcctatttttgttatctcagttagtgtgttaagtggaaattatagaagtagaaggcagacatgtttctttgaagtaaatcaagaagactttaaaaagagggtcagggccaggcatggtcgctcatgcctataatcccagcactttgggaggctgaggcaggaggatcgcttgagctcaggaattcgagaccaggctgggcaacatggtgagaccttgtctctactaaaaataagaaataaaaaaaatttagctgggtatagtggcacatgcctgtagtcccagctactcagaaggctgaggtgggaggatcgcttgagcccaggaagtcgaggctgcagtgagccatgattgtaccacttcacttccagcctggatgacagaacaacacctcatctctaaaaaataagtaaatgaaaattaaaaattaaattaaacaataaagaaggtcagccatgcttgtactatacaaacctagtaatgaggttcagcagaactcatgtgctaccagcccaactaagatctctgaatgtagaagggaagcagaaagccctgagaactttctttttagtgtaacccatgccactcattgcccaagtattttgttgatagtatgaaaaggttaggtatagagacaaagaaactattctcattacttcccttatgctatacctccagccttcatccaggaaaaaagaggactcttactaggaccacgaatccaaacctttttctgccaagagctgtattttggcatctgtttgaatttcatgacaccgtctctgtttctattcctgttttctcattcataaattcttatatcaatgtttcccactttcacatgattgctaattgctatatagagctatgccatttctgaagtatttttgtaattatgagtgttctgctttctgagctattctaccctacagcaacttctgtttatgaggttacctatattgtcagggatatttctcaaaacagtggcccaaaactagactatttgatggatatttttcttggatagcaatttagaaacttccagtcacttgttactttttcttgattcttgattattctttgaaagttagtattacatttatcctactcagctttcagtgccctgtgtaagctattagggatgtcttatcagaactgaggaacttttatttttgttgcatattagtgattagcattttattttttattttattattttatttattttttgagacggagtctcactctgtcacccaggctggagtgcagtggcaccatctcagctcactacaacttctgccgcctgggttcaagcaattttcctacctcagcctcccaagtagctgggattacacacacctgccaccacgcccagctaacttttgtgtttttagtagagactgagtttcaccatcttggctaggctggtcttgaactcctgaccacccaccttggcctcccaaagtgctgggattataggcatgagcctgtaatttttggagacagagtcttgctccattgcccaggcaggagtgaagtggtgggatgtcggctcattacagcctccacctcctgggttcaagcgattcttgtgcctcagcctcccgagtagctatgactacaggtgcatgccaccatgcctggctaattttttttttttttatcgtgttttcagtagagatggggtctcaccatgttgctcaggctggtctcagattcctaagctctggcagtctgcccacctcggcctcccaaagtgctaggattacaggaatgagccactgcacatggctgtgattagcattttaaatgaggatggcagctgtacgtttccaaaccaagacttaatacacatttaaaattgggattttcagccgggtgtggtggctcacacctgtaatcccagcgctttgggaggccgacgcaggcagatcacctgaggtcaggagtttgagaccagcccagccaacatactgaaaccctgtctctaccaaaaatacaaaaattagctgagtatggtgatgcatgcctgattcagctatggtgattcagctactccagaggctgaagcacgagaactgcttgaacccaagaggtggaggttgcagtgagctgagattgcaccactgcactccagcctgggcgacagagtgagactctctgtctcaaaaaaaaaaaaaaaaaaaaaaaaatgatttccaagaggataaaaaattatttttacaaaatcaacctcaatagtgtttataaatggggaaaaatcctccttgatttcttttagaacttgaagatgcactgataaatgtatatagctttgagtttcacctatttatctttctgggtataagatctgttttcacaatatactcaaaagagtttatgattccaagaagtttaagatctacttagaacaagaaaggagaaaatgtgcacacgtttgtgaaagacaacattccattttgtaatctctaagtttatctgttttaatttgtttgaaggaaatgactcaaagtatgtatttgctttgaaatatttttattattgctcgtactttcctgtgaaaggaaactaaagaaacgagatttctctttggagataatagccttgccaatccaagacctgtcacatcacttaaaaaaaaatctcttttctctctgccatatttatttaaagtgatatagataaaaagcctcagtagtcataataaaacgtgaaaaattctgaagcttgaatcattccacaaaggtaggtctttttggaattgtcgtattctgtggtatccatcttctgaagctgaacttggtcgctaagcaacaaagcagatgtgaaactgtgtgtcccttattaggtgtctcctattaggcagaaaggagttgtaaataagcaaaatagtggtaaaaatttttggtagcagtttagtagcacagcatcttcataatgctatatgttttttaaaatagtattttatccatagcacaaaaggtgcctaagataagaatttctgggctgggtgcggtggcttacgcctgtaatcccagctcggcctcccaaagtgctgggttcacctgaggtcaggagttggagaccagccttgccaacaaggtgaaaccacatctctattaaaaataccaaaattagccaggcatggtggctcatgcctgtaatcctagctactcgggaggctgagacacgagaattgcttgaacctgggaggtggaggctgcagtgagccaagatcatgccactgcactccagcctgggcaacagagccagactccatctcaaaaaaaataaataaataaaaagcaaaatagtggtaaaattttttgttagcagtttgatagcacagcatcttaagtgttacttggtaaacataatgctgtatgttctttaaaacagcattttatccgtaacacaagaggtgcctaatataagaatttctggactgggtgcagtgactcacacctgtaatcccagcactttgggaggccaagacaggcagatcgcttgaggtcaggagttcgagaccatcctggccaacatggtgaaaccccgtctctactaaaaatacaaaaaaattagctgggcgtggtagcccatgcctgtagtcccagctacgcagaggctgaggcaggagtattgcttggaggcaggagtattgcttgaagccaggagatggaggttgcagttagctgagatggcaccactgcactccagcctgggtgacagagcaagactccatctccaaaaaaaaaattttttttttggttactttcccagatatagtagttaagttagccaagggagcatcattttcaaagcaggccaaaaaataattacattttcctattaattcttagtctttgcttatatatcaaggcaaaatgttgaaataacttactcagacttcatagtttctgcttttctatttaacgtaaccttacatcatctgcttgcattcagttctagccaatgaacacttggaaggcagggctagttggatactcatagtcatgttccctgtgcctggtacatagtaagtagtcagtagatgtttcttgaatgaatgaatgatttattagtttgcctcttttcctatatttactgtaacctttacttttcctatatatggtcatcttgaatattctgaaaaataaacagtgacttgatttccccagaagtcccacaaatatgaaatgttttcatagaaaagtatagcgaagaggtgctaaacttggggtttgtggaaggaactacagtgtctctaagccctctgagaaaaataggtggcatttgacatgggcgggggcgttttttctggggaaatatggttcatagatggatcaaatttccaaattggtctttggaccccctaatgattaagaaccaatgttatagggtttgtagttttcaggcttcaaagatcaggaaagttaaacatggtggctcacacatgtagttccagctactctggaggctgaggcaggagggttgcttgagcccaggagtctgaggccagcagttcagcagttgtagaccagcctgacaacatagtgagacctacatcttaaataaataaataaataaataaataaataaataaataaaataaagaggctgtgtgtggtggctcacgcttgtaattccagcactttgggaggccgaggtgggtggatcacttgaggtcaggagttcgagactggcctggccaacatggtgaaaccccgtctctaccaaaaatatacaaaaattagccgggtgcggtggcaggcacctgtaatcccagctgtgcgggaagctgaggcaggagaatcacttgaactcgggagccagaggttacagtgagctgagatggtaccagcgcactccagcctgggggacacagcgaaactcagtctcaaaaaagaaaaaaaaaaaaaagaaaaaagaaaaaccaactcaagcttatgtaaaaaaggaatttattggattttgtaactgaaaagaacaaaacacactgggaaaattctggctccaggaatcctgggtacaaatagtatctttaattaaagtttttctcccctttgctctttttctctatattggctttagtctcaggcctgctcttctctatgctggaaaaagatgtcagtctgcagcctaggcctgctaggtttttagagtttaagaactggcagatgtcccagagaggacatctcagtttggttcaaatcatgtgcccacccctagggagttggggtcatcaccaatcaaattacatggactgaatatacttagcatgaaactggagagagaaagttccccaaaggaacgtaatgtgtgtagacaaaaaaacaaaaacaaaaacccatgtcctctgcagtgattgaaaagtttgaggacagttaatataggtaatagactgacaatttcatgttaaaactaggatatattgtagtgatacctaagttttttgtgaattataaatttttctataagggtttcagtttttttaacttggaaaattttcttcatttattcatttgtttaacaaatatttgagaacctgctatgtgctgctatcatcattctttgtactgggtatacagcagtgaacaaaacaaaaatccctgacttcatggaacccacattctagtgaggacagacaagtaataagtaacattaattactaaaatagcatgttggatgaggttaagtactctaaagaaaataaacagggaggagagatagggagtaggtatcacaggtttttttttttttttttttttttttttgagacagtcttgctctgttgcccaggccagaatgcactgcagtggcacaatctaggctgactgcaacctccatctcctgggttcaagcaattctcctgcctcagcctcccgagtagctgggattacaggcgtgcaccaccatgcctggctaatttttgtatttagtagagatggggtttcaccatgttggccaggctggtctcaaactcctgaccttaagtgatccacctgtcttggcctcccaaagtgctaggattacaggcgtgagccaccatgcctggcctggtatcacagttttaaataggttggccaaagaagccttcaccaagaaggtgagatttgaacaaagatgtgaaggaagtaagtagagagcaagctgtttggatatctggaagaagagaattctaggtagtaggaagcaagtgctgaggcttgaagtgtttgaggaactgcatggatgcttgaatcagagaatgggaaggagaagagggtaggaagagaagtaggggatgatgtcaaagaagtaagagaatggtggaagcatgttgtgtagatccttagaggctatggtaaagaatttaaaccactagagcgttttaagcagaggataaattgtttttactttttttttttttgagacagaggtttgctcttgttgctcaggctggagtgcaatggcgtgatctcagctcaccgcaacctctgcctcccgagttcaagcaattctcctgcctcagcctcccaaatagctgggattacaggcatgcgccccagacccagctaattttatatttttagtagagacggggtttctccatgttggtcaggctggtctcgaactcctgacctcaggtgatctgctcgcctcagcctcccaaagtgctgggattacaggcatgagtcactgctcctggcctgcttttttttgagagggggtcttgttctgtcgcccaggctggagtttagtggcgtgatctcagcttactgtaacctccgtctcctgggttcaagcgattctcctgcctcagcctcctcagtaactgggattacaggagcctgccaccacgcccagctaatttttgtgtttttagtagagaccgaatttcaccatgttggacaggctggctggctgactttttaaagaatcctcctagatcctctagaatatattgtagaggattagggtggaagtaagaagactaattaggagactttcactgttgcagtaatccaggcattagatgattgtggcacacaccaggatggtggtggaaatgatgaaaagcggtcagatctgaaggtagatttgctgatggattggatatgtgaggtactagagaaacagaagagtcaaagctgactccagagttttggtcctgagtaactgaccacagtaatttaatgagctagagaagaccaggagaggagcaagttttcacatgctaaatttaagaatttaagatgcttttttttttttttttttttttttttgagatagagtcttgctctgtagcccaggctggagtgcagtggtgcgatctcggctcactgcaacttccacctcccgggtcccggttcaagcaactctccttccttagcctcccaagtggctgggattacaggaacgtgccaccatgcccagctaatttttgtatttttagtggagacagggtttcagcatgttggccaggttggtcttgaactcctgaccttgtgatctgctctcctcagcctcgcaaagtgctaggattacaggcgtgagccaccacacccagccttaagatgctttttaaacatccaattgaagttttctagtaggcagttggacatacaaatctggaattcaggtctgggctagagatagaaattcagaagttgtcagcatatagttcgtacttaacgccatgaaactggacgcgatcactagggaataagtgtaaacaaggaagagaagatgtgtccaaggacggagcatgccaatgttaagaagttggggagaaaaggaggtactaccaaagaagaccaagaacgagcagcaaacaagaaaacatcctggtagccaaattaaaaaaaaaaaaaaaaagttttaaggagagcggatcacttgtcagatgttgctgatacaacaatcaagatgaagactgagatttaatgattgcacttagtgttactatccttgatgagaacaggtttggtaagttagatttgagtggtggagttattcctaggacatgtccttttcttaggaatttaaactccatggttcaggtgaatctatgactattaatcacacaaccatttaacaaatatttattgattattccatcattcttttgttctctattgtacatgttatagatttttaagttgtctggaagtcaagatgcatatgcaagtatacaaaagggtttatatatttgtagtaagatatgtatatcatatggaatgcctataacatgaagtggaaacaattattttgttatttttttcttctatatttgggagttttttaaacttaatttttatagaaaaactaaaaatcaacccaaggtcataattctgagatctaagtagttaatacctaattgtgattattgattccaagaaataacaggagttgaaaatgtaaagtttaatttctctgattaaatttatattgttcttctttattagaaattcattgaatttgaagactctcaagaacaggaaaaaaaggacttacagacccgagtggaatctttagaatctcaaacaagacaacttgagctgaaagcgaaaaactatgctgaccagagtaagtaaaacatttcttctcataagtacactaaagattgggcttggccagacgtggtggctcacgcctgtaatcccagcactttgggaggccgaggtaggaggatcacttgggttcaggagttcaagaccagcctggtcaacatggtgaaacctcgtctctactaaaaatacaaaaattagctgagcatggttgtgcatgactgtaatcccagctacttaggaggctgaggcacgagaaccatttgaatccgggaggcagaggctgcagtgagccaagatggtgccactgcactccagcttgagcaacagaatgaaactgtgtccccccaccccccagaaaaaaaaaaaaaggaattggctctaatggtgcaatgactcatcctgaaattcgactaaggttctaaatacaaacttggaattgtcatcccagactcaagagtgagacctaggacctagggttagttcttttttattcacattttcacatggtacccatgtgtgcagaactgactaaaccagatatatcgatcagactcacttcaatttagatctcagcctttgtttgtagttaacattatgctttaaccattatgcaagtgtgtgtgtatgtgtggatcatttcctctatttttgatcaagtacacaaagctccattttttctgttttgctttgaaatgtaaaaatgtaaggtaaacttacagctttgaagtatgtatttaaaaattacctaagcatgtaattagatactggagaaaaaaaagtactgaatcctcttttttgctcctttttttaatggaaaaatggggccatttggggggaatagaacttcatttttcagaatcattttatttttaatataatttcatattttcttggtttttaaaattattgtttcaaacctcaaggatgattttcccctttggctaataaaaacagacctaattaagtcaaaattagaaaaaaaaaaaggtgagaaactttatggcctattttcatgtctgatataggtaggcagacaattctctgcttttctcccagcattgtaaactttcagaatcctagggagcaaaggatggccaggcagctactctatccacattactcatgaaggctacatagtgacaccagctataaaggtacagccattcatgatggaatgccttcgccagcactcttggggcgtgtgtgagaactgactgttctctctagtactctggaaagacggaatagagctaaattaaaaccactggaaatctggagttcaagcattctagaattcaaggagaactcaagtggctattaagcagatgtcctagaagagggccaatggatgtttggtaacagaagccaacttgagcgagagaaaatgagccgtgtgtcatgctttgtgtttttagccttgtggatacccagagttgttggatacctttgttaccattgaatacattgagtgacttctatgatttctaccatagaaatttgaggtttgctgggtatgatggctcatggctgtaatcccaacactttgggaggtgaaggtgggaggattgcttgagccttggagtttgagaccagcctgagcaagatagcgagatcctgtctttatgataaaaaaattaagaaaacgaggccagacgcggtgattcacacttgtaatcccagcactttgggaggctgccgaggcgtgcagattgcttgaactcagggtttcgagaccagcctgggcaacatggtgaaaccccgtctctaccaaaaatacaaaaattagctgggtatgatggtgcgcacccgtagtcctagctatttgggaggctgaggtgggaggatcacttgagcttgggaggtggaggttgcagtgagctgagattgcaccactacactccaggctgggtaagagagtgagaccctgtctcaaaagaataaaaaaatttgaaatctcggaggactgcatgatggactccacagggcatccactaatagatatagtactgtagtcacattactatgaatactattcatctggagaaatggtcttgtggcaattgcaagcttttggtacatttcaagagttgaaccttttctgttcaagaaagaaaatttaactattggaggtaatgtttaaatcctaatttgattgtacttttttttaaatagagacaaggccaggcacggtgggtcacacctgtaatcccagcactttgggaggtcgaggcgggcgaatcacctgaggtcaggagtttgagaccagcctgaccaacatggagaaccccgtctctactgaaaatacaaaattagccggacatggtggcacttgcctgtaatctcagctcctcgggaggctgagacaggagaatcgcttgaccccgggaggtggaggttgcagtgagccgagatcacaccactacacttggcctgggcaacaagagtgaaactgtctcaaagaaatagatagatagctagctagatagctagatagctagctagatagatagctagctagatagctagatagctagctagatagctagctagatagctagatagctagatagatagctagatagctagctagctagctagatagctagatagctagataagatagatagatagagacaagatctcattatgttgcccaggctggtctcgcacttctgggcttcaaagtgctgggatttcagacatgagccactatgcctagcatgaagggattatataatcttttagaaccaaacactaaagacacagttgacagactcagcctacctttcattgttttacgtattaagttttcttgttgatatctgcagggtacacaaagttttctttctgtcttttttttttttaagacggagtcttgttctatcgcccaggctggagtgcagtggtgtgagctcggctcactgcaacctccgccccctggggtcaagtgattctcctgcctcagcctcccaagtagctgggactacaggcatgcaccaccatgcctagctaatttttgtatttttagtagagatggagtttcaccatgttggccaggcttgtctcgaactcccaacctcaggtgatccgcctgcctcggcctcccaaagtactgggattacaggtgtgagccactgcgcccagcctgggtaccaagttttcaataagaaattattatttattgaaaccggatctcactctgtctaacgtgtgcagtggcaggatcgctgttcactgcgacttgtgcttcctgggctcaatcgatcctctagcctcagcctcctgagtaactgagactacagtcacaagccaccatgcctggctaatttttgtattttttgtagagacagggtttcgccatgttgcccaggctggtcttgaactcctgagctcaaagcagtccgcccgcctcggcctcccaaagtgctggcattacaggcatgagccaccttgcccagcctgaaaaaaattttttttctttttcttttttcttttccttttttttgagatggagtcttgctttgtcacccaggctggagtgcagtggcgcgatcttggctcactgcaacctctgcctcctggattcaagtgattctcctgcctcagccttcctagtagctgggattacaggtgcctgccatcacccccagctaattttttgtatttttagtagagacagggcttcactgtgttagccaggatggtctcaatctcctgacctcgtgatccacatgcctcggcctcctgaagtgctggatctttttctttttttctcagagaccgagtctggctctgtgtcccaggctggagtacagtgacacgatcatagctcactgtatccttgaactcccaggctcaagtgatcctcccaccttagcctcccaaatagctggaactacaggcatgagccaccatacctggctaattttaaaactttttgtagagatggggtcttgttatgttgttcaagctggtctcgaactcctggtctcaagtgatccttgcaccttggccccccaaatgctgggattacaggtgtaagccactgcgctcgaccagaattccttttttgacttggaaaagaattccttgtctaacatccttttgtgcattaagtaattggcttctgtgattagaggaagaattaccttatacttgaaattgcatttttgatatcaaagtacctttaaaatgtctcacactcaaaaaagaagcagaagatactgcttctttttttcccaaaagtatctaagtggaatgaattactaattatttcacatacattagcccttttattactaaatttaaaaaatctgtttcctattcctttctaataaatgtaaacaaaatatagtggtttcttttcttcttcttcttcttttttttttttttttttttttttttgagatggagtctggctctgttgcccaggctggaatgcaatggcatgatattggttcactgcaacctccgcctcccaggttcaagcgattttcctgcctcagcctcccgagtagctgggattacaggcacccgtcattatgcctggctaatttttgtatatttgtagagatggggtttcactatgttggccaggctggtcttgaactcctgacctcagttgatccacctgcctcagcctcccaaagtgctgggattacaggcatgaaccactgtgcctggcctagtggtttcttaattaagggaagtgatcaatttaggggactgtttgagtatgtcaatttttttttcattgtcccagatttgttatccagtccagagagtcataccttttttggaattgtcatattctgtggtatccatcttctcattcctctctccaaaagcattaattatgttttccattttaattcaaagactttataaaaatgagatcatttaaaaataattgacaatactctagggaaaggaggaagaaattcttcatcaagtattagatatggtcttgagcttaatttgatctaaaaactttatttttgttatgaatatattatcctccaaagaatttctcccctgggagtctgctgttcctttctgaaataaagcttgctgtataaagaacaattaaggaacttacaaactgtggttaatcaaaattgaccgttcagatgcacgaagttgataacacgaaatcttttttctatgaactgagttattttttgagctggacccttgctctgtcacccagactggagtgcagtagcaccatctcggttcactctgcctcctgggttcaagcaattctcctgcctcagcctcccgagtagctgggattacaggcgtgcaccaccatgcttggctaatttttgtgttttttttgttttgttttgtttttatttttttgagacggagtctcgctctgtcgcccagtctggactgcagtggtgtgatctcggctcactgcaagctctgcctcccgggttcacgccattctcctgcctcagcctcccgagtagctgggactacaggcgcccgccaccacgcccggcttattttttgtatttttagtagagacggggtttcaccgtgttagccatgatggtctcgatctcctgaccttgttatccacctgcctcggcctcccaaagtgctgggattacaggcgtgagccaccacgcccggcctaatttttgtatttttagtagagatggggtttcaccatattggccaggctggtctcgaactcctgaccttgtggtccgcccacctcggcctcccaaagtgttgggattacaggcgtgagccaccgtgcccggcctgagtcatcttttattaatgctttggaacttactcccttctcctgaaattggagtctttttctcttttctagtgaattgttttcctttctcttccttttgtttttttctaagccttaactggtgtaatatgaattctaagtgtatcttaaattttcttcagagtttttattttaccacacttaaacattcccccactttttctggggggaaattatttgactgttttttcactttaccaccttaggtttttgttttttgtttttttttaaatctgcaatatgaatcaaagcttcttatttttaattttaaaaattacttatttcttaatttttttgagacattccagctctattgcccaggctggaatgcagtggtgtgatcatggctcactgtagcctcaacctcccaggctcaagcagtactctcacctctgctccgagtagctgggactacaagcacatgccaccacacgtggctaattgttttttttttgagacggagtcttgctctgttgcccaggctggagtgcagtggcgtgatctcggctcactgcaagctccgcctcctgggttcacgccattctcctgcctcagcctcccgagtagctgggactacaggcgcccaccaccacgcccggaaaatttttgcattttttcagtagagatggggtttcaccgtgttagccaggctggcctcaaactcccgacctctggtgatccgcccacctctgcctcccaaagcgctgggattacaggcatgagccaccgcgcccggctgaagttttgtattttttgtagagccagggttttgccatgttgcctaggctggtctcaaactcctaggctcaacaatctgcttgctttgatctctctcatgttagaattacaggcattagccactgtacacagcctaaaaacttcttattttttaaaaaggtgatgtaggaagtaatctttaagtatcattagttccctatactattggaaaaccaagattgggaatgagtgctttttaaaagatgaaaacaaattgaaataaatgttatgtcaggagttcattaattcttgttttgtataatagaaaacagatgatctgggctatctaatcttaatgtgactgattttattttattttttgagacagagtctcgctctgttgcccaggttggagtgcagtggcgcgatctcggctcactgcaacttccgcctcccaggttcaagagattctttctgcctcagcctcttgagtagctgggacttcaggtgcgtgccaccacacctggctaatttttgtatttttagtagagatggagtttcacccttttggccaggctggtcttgaactcctgacctcaggtgatacgctcaccttggcctcccaaagtgctgggattacaggcatgaaccaccatacctagcctgattttttgttttttaaataaaatatgagaccaggcgcggtggctcacgcctgtaatcccagcactttgggaggccgaggcaggcgtatcacctcaggtcaggagttcaagaccagcctggccaaaagggtgaaactccgtctctactaaaaatacaaaaattagccaggtgtggtggcgcatgcctgtaatcccacctacttggaaggctgaggcaggagaattgctttaacctgggaggcggaggttgcattgagccaagatcacgccactgtactccagcctgggcaataaagcaagactcagtctaaaacaaaaaaagaaaatatgaattttgtgacaaagtaaatgtaacccaacatttaatttaaaataaacatttatttaggggcactgagatgactgttcgcagtacctgtagtgggaggagaggtggatgcaatttttttgttgagtgccatttgtttgagtgctggatgccttttctagttttcatgtttatacagtgtattagtgtctttaattttaaaagactgagtttgtcaattctcatgaacatattttaggagcacacatcccttttaaaaaatagccacaataaaaattcaagttctgctctaaagactacttcctttgttaaaaggggaaattttggttaaagttatttgctatttgagaagcaagaaaaagtaaagaaataggaactgaattaaaagacacactttacagcttttgatagtatggaatctatcatgttgcatgatttaacaatgttgaaaagttgagtctataatatgttttttaacaatttttggtcatgtttgattttggagatttctgattacttttcaaaatctaaatgaatataagaaattttttttactttttccaacatgaataaaggattttttaaaatgctgtatattattccttatctggagcagcaataatacgtcctgttaatatcttatgaaccttaaggaagagtctgtaatcgatattgtgtggaataaggaagttgtgaattgagaaagccttggtgcttttcaagtgtgtaaggagtgtaatcaactttgccattcatagtgtggcagtaataggtctttgtcagaaagtactttttatatttattgtctctgttgtatgttgtgtatttctatcttgtaagccaaatatctaaaatttgagtcaagcaagtatagatattttaatacagttgaaaatattaaactggtccagtatgcctagcattctgcctaggtatggttgtggtacacaagagtatgatatggtccttgtggttaaagaaatcatagtttagtggggggaggaaggggaagattatgcgtatggcctactagtctttttcccatatatattatatttttatatcattgtggttaggatgtatatttaattttgtatcttttccttaacattatcataagtatttttccttgttgtataatcttcattattatttttatgtccacataaatccaccatccagaagctatgccatctattaacaatttttgttttccctgaggactatgctttattttttcctctaatgagaattatttaatggccactgtattttttaccatggcagcccagaaacagaacaaacgttgaaatgcaaccataacaactagtttgaaccttacctggttggcatatttaaattgttttttttcttgatccacgttttatacatgtataattaatatattatgctctattgtaaactgtctcaaatcctttgtggaatgaagaggtgaatcagggtaaaataaatgtaagaaatttaaaataaaaaaaccaaaaacttctgttggttggttggtcattttttctggtatactgaatcatattgcagtaaatatttttttacatctacaagttttcccttctattggtagttttcttagaatatatttaaggaagtaggtcaaagaattttagtgctttttggcatataatagtttggccatttctaatgtcaatagaattggagaagtaagggttagtagtaaattccattttgcttgtcataacttatgaatttgaagcattatttacagcatattagcacacagagctgatatagaatcatttattatttgattctctcttaggaagcttctgttgccctcaggctccttggatttacaacttattcttccctgagtatagagccattgccttttgtggagaagatgaaaagatttagatgacagtgatattttttttttagtgagtacttcttaatttggtggctatgttttttggggagtacaggttttttttttgtttttttttttaagagatgagggtctaattcctgtgtttaagtgatcctcccacctcagccctcccgtgagggagcccacctcaggtgcatgccactgcacccgtggctgtgattttaagctgttatatttagactcttctttaattccgcccttccttcctttaaatgaaaattcgtctttttgaattaaatggaaaaatgttgttggcactgaagtcaaatgtgttagatccttatactttgacctttctaccttttttgtcccccatgtaacattcctttgctttttacatcttgtgtcaggatcttagtctagtaaaatacctgcaagccttcactttgaaacattattattagaaggaaaacacttcttatttcttggtcataagaataagcactccactagatagaaagttgggggagatattaacataaacaataacataatttttattttaaaggaatgtttaaattttatttaattaattaaatttatttaaaggaattaaataaggcttaaaacagaccttcaacacaaggtgattgataaattaagaattttcacagcacataaaccattttaaagttgccaagtatcatttcatatcaaagttaatatttgagagagcctaaatattttctgtcgctgtttttcaaatcacctaaaaaaatacattcaggcttgtacaaaactttatcagatcctttactgtgctttgtgattagcaatgaatgttagtattttgaaaaaattaaataatactgtaataggacactttttccactttagttctatgtcaataggcaattccttctacataattttaagaatgataaaagtagattacgaagatttatatatatatattttaatgatgatatgtgtttttgttgaaagtttttttaatgaggcagctttaggagtttgaattatatcttttggttttaaaagaatgacaagttaattatttagaaagctacttttagtctgtttaatcagaatctagttctttgcaatactaagaatatctatatatttaataaacaatatatatcagctgtttcttatttagagcctacatatgagtgggaaagtagaaaattaggcacaagatagtttttgcaaacactaacattacttctgcttcattaggtaatacttgtggtctttagctgttttatgttttattatctgtatttgggctctttcatttttgagtctagtgttgtctattgagaagcttaaagttgtaatttataattaatatctagaactaaaggtatcagaaaattaagtttatgagtaaaagttaaaggatttctggtgatttgcttagagaacagggaaaatacgaataatttgattattctttcaaacatataaagggatggataaggagtgtagcaagctgtttgtctgttattttggaagattaagtgagagaaaatgaattttttggctttggttggtcatgaggaagtatttcttggccatgagggtgatacacaggaatatgtgcagaggttaagcgtggactgtccctacgtagagactttaggtaggagaatcatcagctttgttgtggatggcttaagtaacatcttcaagacagggaactgtcagatcactagaagtttctaccgctgggattctttgaagttatcctactctgttttgagaatatgatcattgattcatggtagctttaaaatatgtataatttcacattgtgtcattgattaataacatataatatctgaaaattttttgaagttgagagacatggtaaaggacttagttggtgaggagaggttgttattactgttttgatgtggttgtctgagatttctttgctcttaagtcagccttgcttacctgttgggacttctgatgctaaattgttcaaggagaagtttctgaaagaccacatgtcaatcttctgaggcccagcaacagttggactatctgccttccaggaacagtaaaaactgatgattccttttgagaaggcaaataatgagttggatatggcattctagcaggtctgtttctctttcttccccccgtaggcctatcagcagtctgatggggcagaagacaacagagatggaaggtgttccaaacttggcaaaggccatcaatctcaggaggtaagctctgattttgagccggcagagcaggtggctcttcctgccttaatcttatcctcttgctttttggaaagacggatagaaagagcgctcaaaatgaggctgaagtatctccatcattattctaaaggggaaattttggatttgtcttttgattgttcttttttcttgccccctcaccttttttttctttttagataacatgatttgcctttttttttttactccccagaaaattagcaattttaaaaatggcagttacttatcagttgttttgggataggatgaacagaatcttgtttatttccagttaatctcggcttggagctagttttgatgagtaaaatgacaaggttttagaattttccctgagatcgttttgaagtttaggtttatgtgataactattaaacaagaaatgaccttttaatacacttcaaatggaatgcaacaatataggtataggttaacttcatggtacttgaggctttcgaggatgtctatagtccttgccaggtgggcttttctttcctgctttccccttcccttctacttccttttcttttccctttaactgattccttagtggcattcaggactttaaagagatggctcttccacactttaaaatgacttctcaaaagtgtttataccatcttatgggacttaggccttgagtaagctgagttcattggatatgttgttgtactgagttattgtaagtattttcagaaaagaaaggttctgaatttgtattatttgatcttggtgtatgtgtgtatattttctaatattttctatgtattatatgatcaattatatatgatctttatgttacatgatttatattgtaagtacctacaaagataataataaaatttaggatcacagtatatgtaaagaaaacatgaaatacacaaagtcataaaacagtttctgttcaggttcttgctgtgggtgttaggcaggagagaatataccaccagaaaaacattcagaaaatcatttataataacagacgtaaactatcctttttttttttgagatggactcttgctctgtcgccaggctagagcgcagtggtgtaatctcggctcactgcagcccccacctcccaggttcaagcgattcccctgcctcagcctccctagtagctgggactacaggagtgtgccaccatgcctggctaattttttgtattttagtagagacggggtttcaccatgttggccaggatggtcttgatctcggggtttcaccatgttgaccaggatggtctcgatctcctgacctcgtgatctgcccaccttggcctcccaaagtgctgggattacaggcgtgagccatggtcttttttttttttttcttttttttttttgagacagagtctcactctgtcgcccagcctggagtgcaatggcatgatcttggctcactgcagcctctgtctcctgggttcaagcaattctcctgtctcagcctcccaagtagccgaagtaaactatttttaaaacataatggggactggaggcaatggctcacacctgtaatctcagtattttggaaagctgaggcgggaggagtgcttgagaccaggagatcgagaccagcctgggcaacatagtgagaccttgtctctacaaaaaatcaaaaaattatcttggcctggtggcacacgcctgtagtgccaactgcttgggaggatcacttgagcctggaggattgcttgagcccaggaagtcaaggctgtagtgagctgtgattgtgccattgcactccagcctgggaaacagaacaagaccctgtctcaagaaaaaaaaaaagcataatggggtaacatacctttgataatttggaatgctaacttttaagaggattttagtacatgtttataagctgatatatgttaagctaactgtagttgctataacgaactagccacaaaaattatatattaatgactcaaatgttatttcttgcttacgtaaagtttaaaaagtggatgtttcagataagtgggtggcttttgcggagacatgggcatttccccctttatagcttctaagtttgtcttacctgcattaagttggaggaagggtaaagggcatggagcatcgtgtgtggagggtttttactggaccaggcctaggagtagcacacatcacttttactactacttcagtggctataagtcagtcagaggctacctgcaggggctggggtggatagcctagctatttgcccaagcaaaagaggaaactgttttggttaacatctggccagtctttgcctcagcttaacagccttagtgggggccattagtatgttattttgcccaagtgttgaggcaaaggaatgattctgcctaaggcttagcaaccatctgcctattctttctactgtgaattatctgaggaagagaagagaaggacattttaatgaaatgtccttctcttataacataaatgttgagattttctttttgatcccttaccatttgactttttctttaaaaaacaggttattaaattaagacataatttgctcatacttgtgttaagggataggtttcaaatgactctgtttaaaattgaaatccaggctgggcctggtggctcgtgcctataattccaggaatttgggaggctgaggcgggaggattgcttgagcccaggagttcataaccagcctgggcaaaatagcgagaccctgtctctatttaaaaataaaataaaattaaaaattgaaatctaattcacatatcataaaatccaccattttattttatgtatttatatatatattttttgagatggaattttgttctagttgcccaggctggagtgcaatggtgcgatctcaactcactgcaaccttcgcctcccagattcaagcaattttcctgcctcagcctcctgagtagctaggattacaggcacctgccaccatgcccagctaattttttgtatttttagtagagacggggtttcatcatgttggccaggctggtctcaaactcctgatctcagatgatctgtccgccttggcctcccaaagtgctgggattacaggcctgagccaccgcacccggccaaaattcaccattttgaagtgtacaattcagcggtttttagtacaattttcaaggttgtacaatcgccaccactaattccagaacatttttatcaccccaagaagaaccaccccctcatacctgttacacttacttctgcttttctgcttccccttgtccctgaaaaccactaatctaatttttgtctctatagatttgcctgttctggacatttcataataataggatcatacaatatatggtcttttgtgactggcttctttcacctagcataaaggttcattcatgttgtagcatgtgtcagtacttccttccttttcataaccggataatattgttttatgggataccctccacccccatttcaattgcctatatatcctgctagagctagaaacaaccaaaactctaactttgctatctgaaagtctgtagtaatacagttttgaagagctgagtataatgaacaaccactttgggaagatattccttgggtttcctcttggcatcttgacttgtttagttcctcataaatgggtaagtagataacttaatgtttgaaccatctttacaatgctgtggttgcctactaggagtaggtagtatattagtcatcttgttttatttgtataattagctatcagtgacacatctgaatataactaagcagaatgataaaccttctgtttaattttaatgggaaagataaatgaattagttaagggccttaagtaagtagactgaggtgaacaggctctcatttactcctctactggagtggagaggaagatggaagtggatatgatacttatgctagaggataatacttaacgtctaatttatgtagatattttaacccttttattttttgtctgcttttattttatttttttaaaattccattttattattattttttacttacttacttacttacttatttatttatttatttttgagatggagtctggctctgttgcccaggctggagtgcagtggcacgatcttggctcactgcaacctccacctcccaggttcaagcagttctcctgcctcagcctcccaagtagctgggattacaggcatgtgccaccacacctggctaatttttgtttttagtagagaagagatttcaccatgttggccaggctggtctccaactcctgacctcaggtgatccacccaccttggtctcccaaagtgctgggattacaggtgtgagccactacaactggccctggcctgcttttattttagatgttgcaaaattcagtatttttcctgttatttaacaggttacagacaaaatacatttatatgaaaagctgagacagaggttaatttaagtatactttatgatttattttgtatcaaaaacttagcgaaaagatagacgtggtcagcatacaatttttttttttttttttgagatgtagtctcgccctgtggcccaggctggagtgcggtggcacagtcttggctcactgcaacctccacctcccaggttcaaacgatcctcctgcctcagcctcccaagtagctgagattacaggcatgcaccaccacgcccagctaaatttttttgtattttttgtagagatggggtttcgccatgttggccaggctggtcttgaactcctgacctcaggtgatacgcctgcctcggcttcccaaagtactgggattacaggcgtgagccactgtgcccggccagcatacaagtttctaatatgtaacagtaagttgaaaatatcttaaaataccactttttgtgcattaaaaacatgaaattttgtgtgtgaaagagatagtaaaagtttgagacctgtaattttaagacctttagctcttatgaaaataacaggcataaactatggtaatctagacaatggaatattagtcagtgctaaaaagaaataaactgtttgtccaggaaaagacgtggagtaggttgtgtgtggtggctcacgcctgtaatcccagcactttgagaggcggaggcaggtggatctcctgaggtcaggagttcgagaccagcctggccaacatggcgaaaccctgtgtctactaaaatacaaaaattagccaggcatggtggtgggtgcctgtagtcccagctactcagaaggctgaggcacgagaattgctcgaacctggcaggcggaggttgcagtgagctgagatcatgccactacactccagcctgggtgaaagagcaagactctgtctcaaaaacaaacaaaaaaaagatatggagtaacctcaaatgcatattactaagtgaaagaagccaatctgaaaaggctaggtactatatgattcccactatgtgacattctggaaaaggcaaaactatggagacagtaaaaagatcattgattgccaaggtttgggagatggtagggagggatgaataggtggagcacaggatttttaaggcagtgaacttattttgtttgatactataatggtggtcacatgtcatatttttgtcaaaagctgtagagtatacaacaccacgagtgtaccctaatgtaattgatatattttgggtgataagcatgtgtcagtgtaggttcatcgattgtaaaaggtataccactctgattctggatgttgatggtaggggaggttgcgtgtgtagggggctgcaaatacatggaaattctctgtactttcattcaattttgctgtgaccctaaaacggctctaaaaataaagtctattaaaaattaaaagggacaagtcatctgtaactccaggtagtttgcatgtgctaaatgccctttttctgtgataaatggttgctattaaataaaaaaatatagatatgtatgtatattatttatatgagattagtaaatataaccatttcaccttttgaaagagatggttagagaatggattgatagtttatcaaatgttatttctgaggtgaaagtaagactgtgttgccaaatggaagtaaatttagcaaaaagtaaccctgatgggttagaaagctgtgaatggaggctgaaggaattaatgatagaaataattcaaaatgcttaaggagaacaaaatgattactagaactttaaggaatttttatggatgaacctaagcttatgtgaacaatggtcatattcatttagataaatattggaaatctcccaaaattaatggtgtattctgttatatgtctccttcccacaagcctttttttttttttttttttttttttttggagacagagctttcgctcttgttgcccagactagagtgcaatgttgtgatctcacctcactgcaacctccacctcccaggttaaagtgattctcctgcctcagccttctgagtagctaggattacaggcgtgcaccaccatgcccagctaatttttgtagtattagtagaggggtttcaccatgttggccaggctggtctcgaactgctgacctcaggtgatcagcccgccttggcctcccacagtgctgggattacaagtttgagccaccgctcctggcctaatctcactattaagtggtgtacatttgacacaaagcaatgcaaacaaattgattaggaaactggcataaaatcagtcaggacctgactttgttttgtggcattataatgttttgttctgtaaggtataaacccagctctctgaccaagtcagttgacaaacatcttatataaaagcttctctcggtggggcgcggtggcttacgcctgtaatcctagcactttgggaggccgaggtgggtggatcacgaggtcaggagatcgagaccatcctgaccaacatggtgaaaccccatctctactaaaaatacaaaaattagctggatgtggtggtgcacgcctatagtcccagctactcagggaggctgaggcaggagaatcgcttcaaccagggaggtggaggttgcagtgagctgagatcgcaccattgcactccagcctggggacagagtgagactctgtctcaaggaaaaaaaaaaaaaacaaaaaaaacccttttctctgaggtttgcttaatggtataagtcagctagggccgccataacaaaatattacagactgggtggcttcaatagcagaaatttatttctcacagtctggaggctggaaatctgagatccatggtacaagcagatttggtttctcctgaggcctttctccttggcttgcaggtggctgctttacctctgtgtcctaatatggccttttgcctatctcttgctgttataaggataccagccctgttggatcagggccccaccttaatgacctcattcaaccttaattacctaccttcttctgccttttttttttttttttttttttaaaaagacaaagtcccgctctgtcaccgaggctggagtgcagtggtacagtctcagctcacggcaacctccatctcccagattcaagcgatcctcctgcctcagcctcccgagtagctgggattactgctatttgccatgacgcctggctaatttttgtatttttagtagaaacagggtttcaccatgttggccaggctggtctcgaactcttgcccaggtaatccacctgcctcggcctcccaaagtgctgggattacaggtgtgagccacctcgcccggcccttaattatcttcttaaaggccctatcccccaaatgcagtcatattgggaggtagagcttcaacctatgaatttggggggtgagggagcacaattcagtccataataggtcaggagataagagttctctgtggggatgggaagcaaagagtgttgtgacttgacaatcagatccagaaaagtcttacagaccattgtaagaatttttttttccttttaaaaatgagatcggaagctttgaagttttgagcggttagtcactgtttgattccatctctattttgagaatgtagggaacaaagactaagtagagaaactagtcaggagactaggattattattgtaataacctaagcaagagatgatgtcttgggtcaaagtgagagtgatgaaggtggtaaaagtggtgagattctggtttttggtttgtttgtttgtttgtttgtttgttttttgagatggagtcacactctgtcgccaggctggagttgcagtggcgcaatcttgtctcactgcaacctctgcctcactgcaacctctgcctcctgggttcaagcgattctcctgcctcagcctcccaagtagctggaattataggcatgcaccaccacgcccagctagtttttgtatttttagtagagatggggtttcaccatgttggccaggctgttctcgaacttctgaccttgtgatccgcccacctcggctctcaaagtgctgggattacaggcgtgacccaccaaattttctttatccagtctattcggtaacatttttgttctctccctgagaatgctacagtcagagcaataaagcttgtttgttatggttctgaatagtttgtttaaatcccattctacatgttgaactcatagccattgtaggataacataaggaagaatgagtattcaagcagaggaaagtgcctgtgtgaatggatgcacatcgtgtttgaactgaggtgggctggggctatacaggcataaatacatcagatcactgactcctccccagaggtaactactatcctgacttgtaacatttcagattagttttgtgttatgtctttgaattttgtattcttttgtttctgcttctttccttcaatatcatatttgtgctattggtccatgatgttgtgtgtggcaataatttgtttattcacgttgtacagtattccagtacatgaatatttatccattctactcttgatggacagttggattgttttcagattgtgcttctttgaacattgttttaaatacctttgggtggacatatatataggctttctagcaatgacattgttttgtgatagggttggcaaacattcgaaacttaactaaatcttgccaaacagttcttaaattgggcataccaagttacggtgtatgaaaccatacaccacagtttatgaaagttccagtagttccacatccatactggcacttggtgtgttgtgtttttcactgtagccattcagaagcatggtggtgttgcattttggttttaatgtgcatctccctgacttgggtacacattttgcttggcagtttgatgccctttgtatcaaagtatctgtgaatgggttgtttctgtaagaacagaggagttttttgtttgaagcatactcccctctgcccaaagtgatatcttaaagtaaactccaatatacaaaacagattaaaatgagtatttgctgagaagcagtatagcatggtaattaagaacacagattctggagccagattctgataggaatccttgctttgccattttctatctgtgtgactttgggcaagttacttagctcctatttgcttcagtttcctcatctctaccatggatgtaataataatactttcatcgtaaggttaatgttaggctcaaataagttagtttatatgcagttcttaggactgtatggtacatagtaagcacttgatgttgttggctgctattagtagtggtggtgttggtgatacaaatttatttatgaatttatatcagctgacaagaataataaggctctactattgagcacaaatttgaaattgaggattatgaatgatagttggattttatttcagcctcagcatccaatttttgtttttgttgcacattatcaagaaaataatgattcaaaaagatgaacaattgaaaatagatatggtttgtccagtagtctcagaattcctttaagcttttaatcagtttaaatgacaagtagtagaaaatgtttattttgaaattattaaatatccataatttgcttggatttcctgtttttaaataaaaatcatagaattaaattttattaaaaattaatttgtggttttagcatctattattttatcacaacacatctgcataataaatttgcttattatcgctttcagccacaggataagatgagcagcagatgtattcaacacttgtgtggcatgataaaatgtgctccgtgggtactgtagtgtgtgtttgctctctggtgcaaatgtaatgagccagcgacacataagcttgaattagaaacaaatcaaaacaaagacagctacagttttcctaatcacatattttcaagatatttaaacaaattatggcaagtaaaggtacacaaacccaaaatgaattttctgggcagcacaaggtatgttttgtttggtgtctggtgtgttaatactaggaggcatataaaacattcatttatctgctgtcagaatattagttcatactagttccttctacagctgtcctccacagtcaccagttgtagattacacacagccttgcctgtttgcggccagctgacccttaaacccagggaacattttcaactatgctaaggctttccaacagactaaatgagtaccctgataaactcctctagcaccagctttatttctccccagactgtctcccactgctccttagccaagtatgggctcctccagtctggccagtctcccctctgcctcaccaccaccctctgcctcaccacaggcatggttttgtgttcccttctctgtggtaacagtgtcaggaatgctctcattaccatctgtcttgagtactgtaatttcttcctttgtggttctgtgtggacaccacctcctccctgaatcattcctctttgctatcagttattctttcctgtggaatcctgtcctgacattctgtatctcaggatctattaataaaactttttttttttaaatatcctgaagttgtactctgtgagcactacctcaagtcagtgccactcacaaaacccatcagcagagggagctaaataaaagaagatgagtccctgaaattgaggagacctgaagcagaaaaagtacttataaacaatcaactttcacaaactgccagtgctaaagagcttgagtagtgttggaaatacattatttgggccctaatcccagtttaaaactttgatgaggtgatttgtgtttttgaaagagttaattctgtatcatgttaaaaaaaaaactgtttagggggatgacctgataaatataggaatattagagaaccaatctaaggtattccgctcgtctgaaagttttcattattaaggataatgaaatgaggtcactgctttgtgaagacttgcatatggaacactgagtctgaaagttgctaaggattatggatagcccattctgagtctaacatgtactttttcaagtaaatttcttattttgttttgatcaagtgtatgtatcttaatttcagttagcagacttgaagaaagagaagcagaactgaagaaggaatataatgcattacatcaaagacacactgaggtgggtttctaggtttttcattaccatgctattattgagacaaagaaatgaaccttagaaaatatgtcttaatttttctttgaaaatcagaattttttaaaaaagaataattcttggggattctttcaagaaaacattaaatttcatgtggcatttacctagttaccaaatgtcaacttttcttggaattagcttttcatggggtgaattagtatgctacagaataatttagttatttaaggcagctatagtacttctctccttggctggctaagcaaaaacctatgtgcacataatgaagtttctgtgatgcttagatgagagaactgatttgtttttttatgagtttggaaattatggattggtaagttattggtaaagggtctctacatctattatccattgtaaaggacttatttgcattaagctcataacaaataatataagcacaaattataatgtgttaaaataactcaaaagtaggttttttgcatgagttttcagtattttaaattaacagtttcagcacagtctcctcaaaggaaattagaaaatgtacttgagggttttttaacctttttatgattccctgtcagcctttcatgttgcttttgtttctgttatcttaatgtgaaaattatttttgtatgtcatggtcagtctgggtttcacatacccagataaatataatttttatagttttatacaatatttgttacatgaaaaaaataattcctctctctttccccttgctagtcctatatttcccatgatacatatggttccagtcttagcccgtttttttgtttgtttttttttctccctagtttgtgtgatctcttatcctgcgtctggtagaaactatgttgttgtttttctttagaagagtataaaaacctttataatctataatcataaaacaatttaaaatcatgttttggagaatatccacacagattgtattctgtatacagtaagcatattaatgctacaaagattgtatttacattattatattgtagctatattctgttgttgcttgtgtgtgtgtgtgtgtgagagagagagtcttgctctgttgcccaagctgtagtgcagtggcgcaatctcggctcactgcaacctccatctcctgggttcaagcgattctcctccctcagcctcccaagtaactgggattacaggtgtgtgccaccatacccggctaacttttgtatttttaatatagtagagacaaggtttctccacgttggccaggctggtcttgagctcctcacctcaggcaatccacccacctcggcctcccaaagtgctggcattacacgtgtgagccagtgtgcctggacgttgctgtttatttatttatttaaaaaaatgttttaatactagccattgcttttaaggaacagaaaaccccaccacacattgcatttgaataatgtggttagcactttcttggggtagggtgtagaatttttccctgttagccttgacacgtgagatttgattattacaatcttagcttaataaccatacccaaagcatgaagtatcacagaattgatatccagtagcagatggaaaggatggtccatgaagggcttgaaccatagagctcagggaagacaggagcaggttatacagcagctttttcagtggtaaaaaatacccacatttggccaggtgcggtggctcacacctgtaatcccagcactttgggaggccgaggtgggtggatcatgaggtgaggagattgaggccatcctggctaacacggtgaaaccccgtctctactaaaaatacgaaaaattagccaggcatcatggagggagcctatagtcccagctactcgggaggctgaggcaggagaatggtgtgaacccaggaggcggagcttgcagtgagccgagatcacgccactgcactccagcctgggcaagagagcgagactccgtctcaaaaaaaaaaaagccaaaaaaacccacattttggctgggagcagtggctcatgcctgtaatcctagcactttgggaggccaaggtgagcggatcacttaagcccaggagtttgagaccagcctgggcaacatggtgaaaccccgactctaccaaaaaaaatatatacaaaaatagccaggcatggtggcctgcacctttagtcccagctattcaggaggctgaagtgggaggatcacttgagcccaggaggtaggggatacagtgagccaatattgtgccactacactccagcctgggcaacagaccctgtctccaaaaaaaaaaaaaaaaaaaaaaagccctcacattttaatgacatttgttagccattaaggtttaattttagtggatattaagatttaatggcatttggtggatattaagatattaaggttgctaaaaggcctgttactgattttcacatcattcatctcagtgcctaaacaatgtactctatgtactgtttgcttaagtagtacttattaaagctgataattataaatacatatatgttttatatatatatatatatatatatatatatatatatatatatatacttttttttttttttttttaattagggtctcactctgtttcccaggctggagtgcagtggcgcagtcatagcgcactgcagcctcaacctcccgggctcaagcagtcctcccacatcagcttcccaagtagctgggaccacacacgtgcatgccaatttttttttttgtgtgtgatggagtctcgttctgtcacccaggctggagtgcagtggcttgatctcagctcactgcaacctccgcctcctgggttcaagcgattctcctgcctcagcctcctgagtagctgggattactggagtgtgccaccacgcctggctaatttttgtatttttagtagaggtggggttttcccgtgttggtcaggctggtctcaaacttctgacctcgtgatccatctgccttggcctaccaaagtgctgggattacaggcgtgagccaccgctcctggccagtgcacgccaatttttaaaatgtttatttcatttttattttttgtagagataaggtctcactatgttgcccaggctggtctggaactcctgggctcaagtgatctcctaccttggcctcccaaagtgctgggattataggtgtgagccactgtatccattataattgataaatttataatttataattttataaatatattataaatatatttgggggaagtaattgatagtgataaataataaacaatgtttttgtttttaaaatgaagctctaatcttttttaataattgaaaattattaaattatgctatattaaagtataaaatataaaatacatacttttttttgttttttgagatggggtcttgctctgtcgccaggctggagtgatcttggctcactgcagcctctgcctcccaggttcaagtaattctcccacctcagcctcccaagtagctgggattacaggagtgcaccaccacgctcggctaatttttgcatttttcatagagatgggatttcaccatgttggccagcctgatctcgaactcctgacctcaagtcatccacccaccttggcctcccaaagagctgggattacaggcgtgagctaccatgcctggcctaaaatatatacattctttaaaaataacggtaaagtgaaatttcatattttttccatatatttaataaaggtgaagatacgcttctataaagaagcctgacatactaattttaaatgaaaacatatacttttttttttttgtctatttctattccttgaggaaaagatagtctaggaagaaaaaaagatctcaggaaaaattttaattaccaagtcagagagctaggtctgtccagtaaccaaggcagatttcccacgccgcccaaaagctcttttcatagatctcctccctcagttatgagcagcttctatcctctgacctgataggctccctatattttgttttgcctcaaggaaggaaggtttatgtaacatatatagggctgctttgaaatgtgggtctgttctgctctagcccacaattttttctgtttatacatctgttctagagatgtcattcaattagcaattataaatagctatctaaagccaaagaactaggcgcccttaaaacataaactctgaaaacattcagggaaaggaagcctgaaggggtttaaccttaaccttttcactattatttccaaagaagataatgtcttttaatagttgtttagcacttttatgaaacacattcattgttgcttaagggaaacctaccgtggctttttaaaatttgatttaagaataactattcttaaatttaaatagtcaactattcttaaatcaaatttttgtatacattactgaatttgcttaaaagacatgccttaaagagggcagtggaagaaatataaaggacaattttgaagcactcgggcccacatgtgtatgctaatcaccaaaaactttagccctttggaatcttgggagagtctcacatcagggagtgtttgaatgcattctcattttatcctttgaccaaattctcatccattcccattttacagattgaggtttagaaagagtctataaaatgatttgccccaaattctaggctagttagtgactagatttgaagccaggtttgtcagattctattgcctgatttttttttaagagggagtctcgttgtgttgcccaggctggagtgcagtggcgtgatctcggcccactgcaacctccgcctccagggttcatgtgattctcccacctcagcctcctgaatagctgggactataggcacatgccaccacgctcggctactttttgtatttttagtagagactgggtttcaccatgttgtccaggctggtcttaaactcctggcctcaagtgatctgcccgtcccggccttccgaagtgctgggattacatgtgtgagccacagcacccagtctccctgaacttttaataacactaacaccttggccgagtgcagtggctcacgcctgttatcccagcactttgggagccgaggtggggggattatctgaggtcaggagtttaagaccagcctggccaacatggtgaaactccatttctactaaaaatacaaaaattagccaggcatggtggcaggcacctgtaatcccagctacctgggaggctgagtcaggagaatcgcttgaaccaggaggtggaggttgcagtgagctgagattgtgccactgcactccagcctgggtgacagagcaagcctccgtcacaaaacaaaaaaacacactacacctttagttccactagacatttttcttttccctccctccctcccttctttctttttctttttgttttttttttatttttaaattctctttcttcctttcttttctttctttccttccttccctttcctccctcccttcgttctttcctttcttccttcctctctttttctctctctcttcagttgtttattgctgaattgactcctgaatgtgtgaattaatatgcatacctgagaaaattgagaattgcagttctgagaccagaagcaatggacctggtggacccaagaatagattatctgaagcgtgtcctattttactttctcacttctcttttctgtctaacaacactggtgctccctcccactcactttttttttttttaacctgagtgatactgtgaggccttattaatatttaaattgttatgtataatttttgttcttttttgtgtgtttatagactatagtgcatatcattttattccagacatcaggaaatgctttagggtatgggattttcttgtgggtatgaggaagaaaggacaatgggctcattgcctgctcagagaattaagtacaaaggcggcctgagtcctgtaattcttaataactcagatgactgagtcaggcaggccagagttctggccccaaagctagtgacaacttgaaaagttagtcattgaccagacaatcaacttggagtttacctatgaaatcatgatatggtgaggattaaatggagaaaaaatggctgtaactgcactgactgacttataattggtgctcaataaataatagctgccattttgttgttattgttctctcttttcttttccccctcagtcatttttggttgtcagttctttcctttaaagtgctagtttggttgagttagaattgatttcattatatagataattttggaatgtcagaatactatatctgtaattacattggactagtcattaaaagaaagtttagaataagataatagagaatcagtctgtagaatggctattgggggagaactatttttgcattttgcttgtcattctttttctatattgagttcatagattactatacagcaatctggggtgagtttgttttcttcatctgaatgcttaaggaaacttaggtcctccatttgaacaaatcaatcccatacatacaattactttactatccagtgtatataagaattcacggctgggcgccgtggctcacacctgtaatcccaacactttgggaggccaaggcgggtggatcacttgaggtcaggagtttgagaccagcctggccaacatggtgaaaccccgtctctactaaaaatacagaaattagctgggtgtggtggcgggcacctgtagtacccagctacttgggaggcagaatcgcttgaatgtgggaggcagagattgcaataagccgagatcgcgccactgtactccagcctgggcgacagagtgagactcatggttcactgcagttttgatctccctggctcaaacgatcttcccacctcagcctcccaagtagctggtactacaggcgcatcccaaaatacccagctaatttttaaaaatttttttgtagagacagggtctccctgtgttgctcaggttggtctcaaactcctgggctcaagcagtcctcccacctcagcctcccaaagtgctgggattacaggcattagctactgcacctgacctcttttatttttaaagtggtttttttttttgaggggtctcattctgttgcccaggctggagtgcagtggcatgatcatagctcacagcagccttgaacttctgggtccaagcagttctcccacttctgcctcctgagcagtagggactataggcgagtgcctgctagttgttgtatttttttttctagagctggtgtcttgctgtgttgcccaggctgatctcaaattcctggcctcaagcaaacctcctacctcccaaagtgctgggattacaggcgtgagccactgcaaagccttaatttaggccttctaaaaccttttgaaaatttaaattgagattgattaagcctgacagtcactttgttatattagtttcagtttgatttttgttcctgaaaattcttcctgacacaaggaagctcattatttctgacttgctgatagatgaaaggtgtatttctccaaaactgttgtgtaaatggtggtaaaatctataaatttaaaataaaaagtatgtcaattaaaaaattttaagatactatattcatgtgattctgttttcattctttgtggataacatttgttgtttggactagtcttcattgaggaacagtctggttaatttgttttatttcatgcatcagagttcagctttttgtttatttgatgataaataacatcttaaaattaacttacatttcctaatatttgtacatgccaaataaaatttctacaacaaaagcaagctttgtaaagtgaatttaaactttttaaaaattttattttgttacttaatatgctacagtgcatattttaagttataaagagattgaaatgcatcttaatacagctaaagtttagtgacttccaaagctattctatgtacagcgttaagaattcaagtaatattccttaggaatggtgagaagggacattaaaaaaaaaaagaattcaagtaatattcccaagaaagacatcaacctttgcttgcctcttaatatttacaccctttaaatactaacacactatttcttgttttttaaaattcatttttttcttattcatatcatgttagtatctctagcaaaggccttttgattttatgtcttaattccaaatttaggctttttaaaagtgaaactatatattatcaagaatcaaataggacattagaagttcttggcagtttatgtactttatattcttgaagtttttactttcttattcagcttgtctgtcatatgattccttatctaagactcaaaaagtattctaattttttacatttgtattaatttgctgctgttataatagatgattataccaagtaatgataccagtaacagtcaaaggagaaagtattttaacattctttcaactaaatataccgaaagaagaaacttttcttggtattaaattaattaaattgaaagtgatctttattctgttaattccttttaaaatggaagagatcagcacataaggatatggtttcttcagaagtttcacattaatttctttgttgtgtctcattttagtgaatggctttctcaaatgccatctattatttttaaccaatggtcttttatgacttctttcccagtgtctgtttactaatttgtgttctttatatcaatattattttaatagcatcacatattgtaaaaaaagtgggttttttttttttttttgccatcctaagcaagatattagctacttttgtggacaccagcatccttaaatgtaagcatttgcatattactttcccttaaaatttttttcattccttaatattctcttacttggaatcgagtagtctgatagataagaaaattgtaccaaaatgttttccttgttataacactatgattttattccaggtattagccttaaatattgtgtattttttctttctttaaaatagatgatccataattatatggaacatttagaaagaacaaaacttcatcagctctcagggagtgatcaactagaatccacagctcatagtagaattaggtaagctttgttatatattttgccttgagaaaaagtaaaataaataatatgtttgtttctgtttttctctgttctttaatcctggaacaatagttaggctgattcaaaaagctctccactgtggttggaatgctgcaggagagaatagcacagaaaagtagaaacggtttttaccattaaaaagataaattatgagccatccatataagcagcacattgagtatttagattgttttctgatacttgatggagattatactaggtttaaaattttgtaatttatgggaatgctgaaatattttatttctcccgtgtaattggtttgaagtcctttttgttacagagaggcatgtttgaaagggttagctagccatctgtttggtgtaggagtgtgaataaattatgtagatcttcaggcattgtagccaatgagctaagccaggactcttagtggaggggaaaatagttaataggctggctgtcgcttggggttgctgcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcaggtactcccatctctcttagaagcccctgcttagctggtttttattaaatttttagctcaacgggtctgctttgtaacaatttctgttgcagattgaaacaatggaaaatggcctgaagctaggatttttgattctaatttatagtaatttatagaccatcagttaggattatagctttatgtttggaaaccactaactaaagaaaaggattttcatattgtacttacacacaagtacaaggtcagtgtggtcttgttttaagcagaatgttcaaagtaaaagaagagcaagagtagagcaccggctccaagtttatacaacctctgcatttagcttctgagcatttagggacaaatatcttttatgcttggacttgcagtcagttagatacaggccgtaagcttattttgttttaattatcctttgaatgatagagtttcaggtatcatttttgtaatttttgataatagctcatgggaactgacaatttaaatattttcctcctaaaacaaaatatgttttaaagtgaaaaaatttaagacttttaggttaaggaatgcctttttccccattatttacacatcaaagttgtgaaagctttacaaagcctattcactattgttttgtcagatgttgccctttcttttctttgtagtcttgggtgacaaatatccatgcctgcttgtgggggtagtcattaatctctgtagctttactgttgctcactctacttacaccctgtaagagccatcttctgtattttagaggcttaaggttgtggtttcttttgttttctaaaccgtcagactagcagtctctgatttgttcagatttctgctttgtgcatggttttaaatgaaagttcatagtatatagtttttatttattatttaaatgtttataaaatatttaaaccctaattgtagatttagataaattaagaagaattaaagtagtaacttcccttaatgtgtttctttttattcataggtcagttcaagtttaatattagttgaaagcccagaaattaaatttcatcaatgacttaaaactagatacttggtcttttattttctttcctgatttataaaaattgggaataatcttactacttgtatatatattagtacataaaatatttgtgtacgtgtatctgtatatttaggctttgaagaaattaaaagcaactgaacttaagaatatgtagaatattaatataagactaatgttaaggggatgtcttgggtttaggcttcatttgagagggcagtgccgtgagctgctgtgcggcgcctgcaagtgggtacaacaaggctttggaattgaactgcctgggtgcaaatgctctattgcacgtggccgtaggagctttggcaagttgcttaatctctctgcctgagttttctctcctgatgggacttaccccgttgggtggttttaaaaatcaagtgattttattattttgtatttaattatagttgtaagatatatggtaaattacttgagtaaataattttcagttacttatatgtgtccatttttagcagaaattgttttagctacagctaaaataccttataattaaaattttaaagttctttaccacaaaaattgctactgatctgattaaataaagatatcaaagtctttgatattaagattaaattgtcaaaaagttggtagttccaagtaggaagttccaaggaaagcaaagggcttggaattgaacagtactggctttgaatcgaaactctgccaattactagtgcctaaaatctctgagcatcacttttcctactctgaaaaattggaaaaataatccctgtttcttgataaggattaaatgcgataatgtaaataagtcatctagctcagtacccaccacgtggtgagtgttcaacaaatgtactttttcttttatctgcctttatatataaagcagattttactaattagttgtatcaaatgtgaatatagccaaaaagctgttccaaaaatgtagttgtaaaattatttatatacataagctaacatttaataaccaactcaaaaatggatatatggaagtagggcaattaagaaaaaagaattctgatagttgttgatagcttcgttttctagacaagtaatagcagatgttttggtctgcaggtataaatctgccacttgatagttttccacgtgtatctcatttttttccttcttctgtgagtttgaagcatttaatgcatgccaacatagtactggactaatgtttacctttcagggtttcttttcaaaagtaggattctcatgaacttgcctaattatgcgtccttctctcccttaccccaactgtatgtaatttgtaagtaaagtaaggggaggagtatgtagtaattattttttcagagttggaacattgtaacctagagcatcattgacccacttgacagatagctgtcagtctctgaagagatctcccctccctgtagagtagtttctgaatgattgatacaagcaaattaaaaaggtgggaattctatttgcaatttgggttgtagattttgttgactgttgattgtagattttgtcaactgattttgtttactttttggaaagtaaaatttggattcatagaagactccctcccccaatagttttaaactttttcaatatttgttatgtgtgaaaatgaatggcttatattttgatttctattagtgtgagggagtcttatgaagtctgtatatcatcttcctggttgtctttgcattttgagttagagagctttccattatattcagtcattaaattcccagtcaccttttgcttaactcattaaggtatgttagaaaataaataaaagtcagctagtagctcttagtccccttggattttcggttcacaaaatatggggggaaaacatcagattgacaactttttattttgtccagaatgaatatgaaaaggaaatctagctacttatcactgtcaccatcatttaatgaaagaaagggcattttaaaatcaaagaagaagaaaagatgtaatttaaaataagggtcagtcattttcaagaaagaacagggttctatagtatatgggaatgtgtatgtgtacaataggtactatattatctatgcactaaggaaataataaataacgcctcttttttcatggacttattataaaaactttgttgctgaacagcatttgggaataactggtgtaaacatggtagctgactagtcactttaatttttgtcatttggttgtcccggcagctcatagtcgcaaacttagatttggtgttaaaatttaccctcttggccaggtgtggtggctcacacctgtaatcctagcactttgggaggccgaagcaggcagatcatgtgaggtcaggagttcaagaccagcctggccaacatggtgaaaccttgtctctactacaaatacaaaaattagccagacgtggtggtaatgcctgtaatcccagctacttgggaggctgaggcaggagaattgcttgaacctgggaggcagagcttgcagtgagccgagatcgtcccactgtacttcagtctgggcaacacagcaagacacaaacaaacaaaaactaccctcttattgtactgccttcctgcttttgaattttccccctaaatcaaagttctgtttttaaattttatttccttgtgcatacaactttgactaaatgtagtctctcaacccctttgcttcacctcatttttaagaaggcattgggatagttttactagtccttttagattgttaggaatggaagaacacaccctttgtattaagtgaagacacatttcaaaagtggctgaagtttcttggaataaaaatgaactacagaattaaagacttacttagcaaaactgaaattttcccactttaattaatgagctcattgtttttattctaacttacattcttaccagtagaggtaggaattccaggaggcaccaaacctttagtgtatcatttctttctagtttctacacttttgagttaatgacccaggatgacccgttagtaggcttgtttccaccctctaaaagctcttcgatttggaatcttgtgtgcatcaacaaaggatgtgtttctcgttgaaattctgttagtattaaaattgtaactcttgttcattgaaacttctcacaaagcattggaaattcagtaatcttttatagaattatttgaccttcttatttggaaaaaaccgacagtggttttctcatatgtactgtgcttgaaaggaactcatatagtggttctgtagaaaaacagagctttcttacttgggtggtggggagaaagatattttgagttcttttcatcatttaataggtagccctgatttagataatatattgattttcctctaggcaggaaagtcataccctgaagaagcttcagtaaacatccagggattagcgagaggatttgggaagaaatgggttggattcacttccaaagaaggaggttgcaagttccctagggctaagctacgtatggttaaaaacccagcagcagctcttctccagaccacactagaccactgactgcttcttgggcaaggaactcgtcagtaacttttaagatttccttaacccttcttaccacttttcttagttgatttcttgaggctaatttcctgaggctaactaaactgagactgtccttcctctttggtaagtctgttttattcagatgggcagacagtgtcatttttgagtgatggttgtaaaacagtggcagtccaggcttattacttatagtcatggcaaataaaaagtcaaaataaatgaatgccgaattttttctcccctcttcaaatagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtaagctttatgctgctgaaattgtgtcagtttatatttcataaactttcttatcctaattgaagtgctagacgaccacagtatagtaaaatgtaattgtttgtatacatttagtttgtaaaattggttttttaaattggaaatgagctcttaccaaagagtgtgttttttactattttatttcaaattatataggaaaaaaagtgaagcattatatcatcttgattagtatactaatgacaaaaattaatttctatttgatttaggctatatgagtttagagtagggtaactagtgaacctaattatattagaattgaaaatcgctattaccagaaagtcttggttcatgttagaggctttccaatttagtagggtttcacttacagaaaaacaaaacaaaacaaacacactgttccttctttaaaaccgcttcatagagcagtctacaaaaatgcattatgtttagctaaaaaggcgtggtgtaaattaattatagatatgttcttgaccaagaacttgtcatcaaataagtgataaatataaacaataatatatgctgagtggatataagctaataattaacttttaagaatatttgaagttctgtatcttttaaaatgaaatattcatcatattgattataaaagatcttttgttaccttataaaatcaactcatcatgaaacaggccacctgcaatgagtagaaatgagttacatgtatcttatttccttttcctgctttatttttctccataatacttatcatggtctaagcatgtaaagatagctcttaacaatgcttctaaaatactgtcatttactgtatttagttgcctctagactcttccctaagaacataaattctatgaggtttatttactgctgtatcccccagcacttggaaaagtgcctagcacattataggtactcagaacatgtttgttgagtgaatgatttgttttagatgttagaaggaatctttggggacaatataagtggtctttctctcaactctagaatgtagaggcattcagaatcattctattgacctttgaaatgtgctcaaaacagtaagcagttgataaatatttgatagcttttctcccactgaaaatcatttttaacaataggggttaccttaccttttctcccttcttgccccaatttgttagaagctaatagtgctcagtattagcccacagtgatgttactgggcaactcgctcgctctcacttttttttttttttttttgagacagagtcttgctgtgtcgctcaggctggagtgcagtggtgagatctcagctcatttcaaccttggctcactgcatcctcctcctgggttcaagcaattctcctgtctcagcttcccaagtagctgggattacagcacccaccaccacacctggctaatttttgtatttttaatagagacagagtttcaccatgttggtcaggctgacctcgaactcctgacctcaggtgatccacccgcctcagcctcccaaagtgctggaattacaggcgtgagccactgcgcctggctgcaactctctctttctttacttctgtaccacaatgggtcttttagccttcctgcaggtttaatagattttccaaaacactcatctctcaattgcctacttgctgtgtgtgctttcccaaaacaaaagtaggagggatacttttagtacaaaaaaaagtatcccatatggtaactatattttaatactacccaaaagtgcgccttaagagattattataattctctttattttttactccactgataggctatgccagaactttattgacaacttataaaccgattaacaaattattagtatagacttaagcagaggagtttctcgtgtcctccctagaggaggacttgccttagtataaggcaggtactcaccagagagtttctaaaacaaaaccctgtctctctctacttggtctggaactggagccaccgaatgagataaagactcaatgaataaggatttccaggaatggggtggtgcttacaaaatggcaaaagtctagtttgtaaatcatgttactagttgggatgtacagtattttatttttcacctaagcccttgtcgttcactagataactttctactttaccagggctggaagtcaggggtttaggattcacttgtgggctatgccacaggtatgtcacatgccctgtcattttggtttctgtgtataacaggaattggactagactctaatttaaaatatcatttcccctgagattgaggatgacctagccatcttagggcatgttttgacttcattatgaaaaaatggaaggtgtaaatttataattaatgttagtgttactaccacaatttttctgtgaagtaaggttaaggtgaaaatttcctgtgagagaacgacagaaaactttgtggcagaatagcagcagataaggggatttgccagtgattgtaaagttatgggccttctttgttggtgtattacaaatttctcactgtgagagacctgtggtgagtgaggttgtaaataatctaatagattttctaggaatgatgcacctagaaaaatgtacaagttcttaaaaagaaatatttgtacatattcttgatttatcacaatctcatggagatcgacaaacaagtaaacaaataaatgaaataatagaacttcaagtattgttaaagcaaggtaagctaaagagtaattagtaaggatgggtactcattttagggtatgagagaaagcctctggaagatgactttcatcctgacatggggatgtgcaggtgcatggaaaggtctggaggagtacgtgttgaggaagatgagatggcaattgtgaaggccctgaagtggggaagcacttcagcatgtttaagtggtggttttctcttcatcacactcagactttcagtcctacctactgcaccaacatgccttctgtcaagggtgccaaaagaatccatcgttccaaatataatggaaaattctcagtcctcatcttaccttttagtagcatttatatatttcaatatattcagcttcttgaaatacttccttcagttttcttccaggattccccatggcaaacacacactgattttcttcaccattccttctccattgctggtttctcttctgcttttggacctctaaatgttggggtactcgtcagcccttctttttacttaatctgggtagatcaaattccatgtctgtaaatgccatctatgcatcagtgctcacaaatttgaatctacaactcatatctcttccctggactctagacctctgcatctaattgcttttctttatagtttcctcacatacatatgctttaccttgcctagattaccactagtaaaaataccctaattcaaggccagtgcaaataccacagtttacatgtagtctcactaacgccctagagactaacaccctgttgattgtcctcaaatcgagtttggagatcagttcaagaagaaagcagaggagttttgtattgcttcattaacaggaatttcgtaccgggggacttctagtgaaattgataaaaagaaactccttatattaaattatcaaagctgttgcgttaaagagcatattataaaagtgctataggctggacaggtggctcgtgcttgtagtctgagtactttgggaggccaaggcaggaggatcacttgagtccaggagttcaaaaccagcctgggcaacgtagtgggactccgtctctttttcctttttttaaaaaaatgtttatacacacacacacacacacacacacacacacacacactatatatatatatatatataaaacacatatatttacttattttatttatatatataattttttttttttatttgagatggagtctagctttgtcccccaggctggagtgcaatggtgcaatctcggctcactgcaacctccacctcccaggttcaagtgattctcctgcctcagccttccaagtagctgggattacagacgtccaccaccgtgcctggctaatttttgtgtttttagtagagacgaggttttgccatgttggccaggctcttgacctcaagtgatccacctgcctcagcctcccaaagtcctgggactacaggcttgagccaccgcgcccggcctattttttatgtatttttaaaatttattcctctagtgtcaagcgactctgtctctacaaaatatttaaaaatcagctgggcatggtggtgtgcgcctctagtcactgctactcaggaggcacaggcaggaggatcaacttgagcctgggaggctgaggctatagtgagccatgatcatgccactgcactgcagcctgggtgacaaagtccttgtctcaagaaaaataatgaataataatagtaatagtcatgggctaagactgagaatggacaaaatgttaaggtgagacagttaatcttactgaattatattcacaaagaagctacaaatgaaggaattggaaaacaaaaggccaagtataaccaagacagtcctgaagaacagtaagtataagaacttgctctaccaggtattaagatttactataaagcgtaattattaaggtggtatagtattgcttcatcttccctttctctttcctttctgcacaatttagttctaaagccaccaggcagggcagaggaaggtaaggctttccatggtgcttaggagcaggggtggggttgttatcataacctaagcaaagttacaagggtaatccatatggggtagcctggtgtagagagtcagggccccagcaacattaaggacatccctgcaggatggcagccaggcttgggggtacaagaccctaaacaggatgatgagagcctccccaaggagaggtcccaggtatagagtgtcagagcctgagcagatgaggaaggcagcatctgtgtgtggtagggggagagggggctggagtggagaagaaagaagatgcatgggaaaagaagggcattagtggagggctgtagtggcagagaagagagaccgtaagagacttgagcgctgaaagtcgaggcacaaagggagttttagaatggaagaagatgtcagcagggtcagctggtgtggggaagtcaagtagaatgaggactgaatttgtaaatttataggtgtagatttgagcagtttaagttgtagggccagtaacaggagtaactgtaaatcataaaaagaggaaataacatgtgtagactactcaaaatggtgattgtggtgggaggagagaaaaaggataacttgaggtggagattggcagagcagagggaaaagtatagaatgggagagactgggttgttgctatgcttacaagaagggttcaatagagagaaaaattgaagacaagggagtgaagaaagataattgatgtatcagaatcttagaagaagggcagaggggaagggatcacatatcccagctgcaattcagatctccttcgttgctgagacagcttcatttttcctagtcttttgctgttacaaataatactgtggtaaataaccatccaaggcctagaaagcatcatgaaaattatatggctggcatagaacatgcacacacatgtatgcatgtgtatacatatgtactccaaaaaagtatttttttctttgaagagcatccttggttgttgattattagtagaatgtgacctttagatctgagaaaagcaattttaactaactaaaccaattggatagacacctacttgtgaaaattttagagagttctcataaaatcacatgacttgtgatactttagtaaactgctgtgagaagctcttgttagcagagtttggtatgtaaagccagtcaatgtgtgctgcattcttcaggggatgtgcttagcatgcagaacaggaaatgtctaaacagagccagcattcttgttgagagaattttccatcctcctccatttgtggttaagttctgaaattgttcctatttctttagtttctacaagctttaatctctatagtagttgaatcatatctattgttatttgcaattcctattataaaatgcatatgtaatttaaaaagttaaagttcgcagttttaaataacttttttgaagtaattttagacttacagaaaagttgcaaaaatagtgcagagttccatatacccttcacgcagcatcccctgatgttaactaaccataatacaatcatcaaagctatgaaattaactttggtacaatactgttaggtaaacctgtattcgagttttaccagtttttccactaatatcctttttcccttccagaatccagcccaggatcccatattgcttttttaaaaaaaatttttattacagacagggcctcactatgttgcccaggttggtctcaaactcctggcctcaggtaatcctcctgtctcagtctgccaaagtgcagggattataggcatgaaccagcacacctggcttccacattgcctttgtacattatgtctcgccagtgttcccagtgtgtaacagttcctcagtcttgtcttgtctttcatgaccttgagacttttgaagagtactggttagttgttttgtagaatgtctctccctttgggcttctctgatttctcattattagattgaggttatgtatttttggcgagaatataacagaatctagtatcttggtgtggatatactttgagactgtgcagataccctgtttctgctcaaactttcattcactgattttagcatccacagtggattttgcctacaacaattattagtaaaatattgctaatagttattttctattttcttcattctacatttattaattggaattcttctatcagggagagttgtcttcttccctccttccctccagtccagtttgaattcaagggatatatacatatattattctgtgggctatgcgaacctatcatttctttggtttctcaaatttttctagctttggacattgagagctctttcaggttggctcctgtgctcttttgacataccccatccttttttgaatgctttcttccttattggcaccataagatgctctaagctgttgtattttccctgccccactcttaaaaattggactacttctcaaaggagctctggcacattttttgggagaagtgtatttaggaaccaagatctaggcattattcattcatttacttctggtttgggtttttccattagtttatacctcctttatagaattttgtattagtgtgcctactagggtaaaataaaagtagagttttaagaaaaaaatggattatgtgttgtaatatttcatattgttttgtttatgacagtggataaggaatttgttctataaactcaatttttgcttataagcttttttcctcacatatatcttcatgtgataactttaggaaccacctataggtgactgttagggtttggaaggaaaaaaagggtaaagattctattgtgttgtatgttgaccaagatgcctattatgtatgttgagaatagaaactgataaagatgtaaataagcagcactttcaaaatggcggtgtttaaagcttgtattttaaatgtgacttcatctgaggtaattggcacataggtatttattaatacttacatttactgtttaaacagacttttagaataggagaagttgtttaacattttctactgaaaaaattacctttttcactcaaaaaaatttattgatgctcactgtgttaggcacaatgccatgtactagaaatgttgttaaggtgctcagaggtccaaatattttctaaaagaggcctttataatttcttttaaaaagttattttactactcaggaggctgaggtgagaagactgcttgaagccacgaattccaggttgcagttcactgtaatggtacctgtgaatagccacggcacttcagcctgggcaatatcgcaagatcctgtgtctaaaaaattatattaattcagtttcacaatttttagtaatactgaagaatgtggagtaggaatgggaagtttcttcaaccctaaatttcattttttcccccagtcattgtaaatagttgatgtatccttggcctttttctttacaggtgcacatagatataatatctttttaagataagtgggtttataagtgttttcctgctgcttgcttttttttttttttttcatttaatgacatagcttgacaatctttctacttttatatagagagagctacccaagtttttacctagtttttgatgaagagaatgattaaagatgatgagaatctagaatcaaagatcttataaataaacattaagtgctcttaccaccaaaaaaagtatgacgtgctagatatgtttattggcttgactgtggtgattgtttcacaatgtgtattaaaaaaatcaccttaactatatgctgtatttgtcagttatatctcaataaagctaggggaaaaaaaaaaaccacatctgttaaagaagaggcagtctgattcctacaaagtgaatcatgccttgttaatctgtgtattttgtattttttatttttttttgagatggagtttcgctcttgttgcccaggatgtagtgcaatggcgtgatctcggctcactgcaacctcctcctcctgggttcaagcgattctcctgcctcagcctccagagcagctgggattacaggagcccgccacaacgcccagctagttttgtatttttagtagagacaagtttctccatgttggtcaggctggccttggactcccgacctcaggtgatccacctgccttagcctcccaaagtgctgggattacaggtgtgtgccactgcggccggcctaatctgtgtatttttaagggcataactgagagctagcagcctttcaaaaagactttgatgaatttccagaccaagagtatttgaaactgttgctttgtatttaagagaaacacatccgtctcatagagggaaaatgtatagatagaaataaagaatatgaataaatagatttttatgaaaaaggatttgggactgggcacatggctcatgcctgtaatcccagcactttgggaggccaaggaagatggatcacttgagcccaggagttcaagaccagcctgggcaacaaggcgataccaaatctctactaaaaatacaaaaatttatccaggcatggtggggtacacttgtagtcccagctacttgggaggctgaggtgggagaatcacctgaatcctgcgaagttgaggctgcagcaagccgtgatcgtgtcactgcactccagcctggacgacaggagtgagaccgtgtctcaaaaaaaataagaaaaaggatttggattttggtgatcctttgatcattagtgttatctaactaattcagaaatgatagaaggaggtgtgataaacatttctgagtatgctgcactggattattagcatgttaaatagtcaaagggactggaataaacatcaggaagatttcataaagtggtgtaagtagaaaaaaaaggttaaacaatgagctgcatgttgataagtataagacactgatccaagtggtggcttctgaaccatgatattacttaaactagagtgttaaggtcagcttaagtcaaaataaaacaaagcttccaaaccctcattttaaacacagtagataatagatgaatcttgtatcttgggagatagtacaagccaaagttacagctgtgttaaaacctagtaaacacataatttttttctcttttataatcttccctcttcctaggtcagcaatagtcctgaacctcagaaggctgtagaacaggaggtgagaatggtgcttcttaacattttgcaaaaagtatactaaagtgattaactattgattacttcctcaactgctattctcaagacatcagatgctcagcttggaagactattgttgtaattcactgaaatataaaagaaaattatttccactgtagtggttgtcagggctttactgcaatctgtaatttattccttccccaaagtaagcatttttaaataaaggaaagaaaatataagtaaattctgtgaaattcagcctgtttgcatttatccagctctatgtaatggtatactttccagaaataccttcttcagggcataatgtatgtaacttgtatttgtcctgaatgtggcctagtgtgtcatcttacagtggactgcttccttagtttaatagagttcttcatctccagtcagggcaccatccagctttattcatcaaacatctgttaagagcctactacaggccaggtgtggtggctcatgcctgaaatcccagcactctgcccaggcaggcggatcacttggtcaggagtaggagttcaagaccagcatggccagtatggtgaaatcttgtctctactaaaaatacaaaaatcagccaggcatggtggcagacacctgtaatcccaggtacttaggagtctgaggcaggagaattgcttgaacccgggaggtggaggttgcagtgagctaagatggtgccactgccttccagcctgggcaacacagcgagactccatctcaaaaaaaaaaaaaaaaaagcctgctacatgtcaggcttgatatgctgggcactggggataacaggatatctgtgactttctcctacgtgctaggtcaggggttgacctgggtccatggaagccctctagcatcaacagtgaaacagtatcctcttcctttgaaatatactcagagttaggacattcatacctttcctttaataatttgaattctcttgaagctaccattctgtttacacttagatggattttacctaaatgtgagtatctagagttaaggtttttagtgtttcctttgggtcacagactcttaggagtcaaattatttgaaactctccagaagaatgtatgtacacaccattttgtaactcttttatgccacatagctgtaaatcaaaagagttttaagaaccaatgctttagagacttacttttacttggggagaaagaaatgtaggtataaaagtatatttgtgttaatagtgagggatcctatgtggggctagttacttgtttgtagttttgtctttattttcatttggcttaaaaccctcaaatctaagagacaaacttaggtagcagagttgcttgcctttatatgacttatttcagaagttaggctactcaggaaaacactacattggcatgtagtgtctgtaagttgaactgaatgggataattcattttctctagttgtaaacatagtttatagtctgttagaaaatagttatgctgcaatgccagataatccatgacatatatattctgtatagcactaagcacatggtgcatttggtaaatggaacaactgaaaatattttgaagagcttatagacttttagcctgatatctaaaacccataagaaaatggcacaaagaccagattgcttttactgcagtatctcaagtgaaactgaaagtaatgacgtttattttgtgtgtgtggtaaaaacacataaaaattaccatcttatgacctctgatgtggtctccacagggaggaaaaaaatgaccattttaaccatttttaagtatatagttcaatagtgtaagtatacagttcaatagtgttatgtatattcatattattgtaaaacagcaccagagctttttcatcttgcaaatctaaaactctgcactcattaaataataacttcctttccaactactgtagccccggaaactaccattttactttatgtttctatgaatttgatgtcacatattaaataccgcacataaatagaattatgtagtgtttgtctttttgagactggcttatttcatttagcataatgtcctcaaggttcattcatgttatagcatgtgacagaattcccttcctttttaaggctgagtaatatttatttgattgtatgtgtacaccatattttgtttatttatttgttaatggacatttgggttggtttcaccttatggctgttacgaataatgcttttgtgaatacatacccagaagtgagattgctggatgatatggtagttctatttttaatgtttttaggaactttcatactgttttccagagtggttgcatcattttacaatcctaccaacaatgcacaagtgtctaatgtattcacatcctctttttcttgatagtggtcatcctgatgggggccaggtgatgatatctcattgtggttttgatttgcatttctccagtgattagtggtgttgatcatcattttatatgctttttggccatttgtgttacatctattttttttcaaagcacaatttaaatatgcacagacatgccattcttttatatgcacttccaaatcttgtactagctttttgtgaacattctctagtgacatgtacacctatgatgtggcagttccctaaaggctctaaaggggaaaatggggctataaaataaatatgttagaaagagacttgatgactgcgtaagtctccatgtttgccaccactcatgccattgaaaaagatatcttaatgatgtcagacaataggatttgataggctagtggtcatttgcagtcaagagtattagccaaaacagcacaacctggcaagtgacctgtaaagtctaatataaaataggaatttgcagtgtcaagaagccacagattgaatgtgaaatgacagcatgcaactcccctggaactttatgttgaatgattcataataaatgcttttcaattaggacctcttaagaattttcccttgtttgcatacatagtcatgtgtcgcttaacaacagagatacattctgagaaatgtgtacttaggtgattttgttgtaggaacatcatagagtgaatttacccaaacctagacagtatagcttactacacacctgaactatatggtatggcctgttgctcttaggctgcaacctgtgcagcatgtactgaatattgtaggcagttgtaacacagtggtaactattttgtgtacctaaacatagaaaagatacagtaaaaatacaatatgaaaaatttaaaatggtatacctctatagggcacttaccatggatggagtttgcaggactgcaaatgctcttggtgagtcagtgagtgagcagtgagtgaatatgaaggcctagagcattactggacattactgtagactttataaaatgctgtccacttaaactatactacatttatttaatttttttcttcaataataaattaaccttagcttactgtaacttatttactttataaactttaaatttttttacctttttgatttttttgtaataatgtttagcttaaaacacaaacacattgtatagctctatgaaaatattttctttatatccttattctataagcttttatctatttaaaaaaaattttttttttttttgctttttaaacttttttgttaaaaaccaagacacacacatattattagccttggcctacacagggtcaggatcatcaatgtcagtatcttccacctccacatcttgtcccactggaaagttttcaggagcaatgacacacatggagctatcacctcctatgatgacagtgccttcttctagagtacttcctgaaggacctacctgaggctgttttatagttaactttattattatttttaagtagaaggaggagtatactttaaaataacaatgaaaattttagtaaatacataaaccagtgacataattgtttatcattatcaagtattatgtactgtatagaattgcatgtactatacttttatacacctggcagtgcaatagttttgttaacacactagggcattgcactgggatattatgacagttgcaacatcactgggcaacaagaatttttcagcttcattttaatcttatgggaccaccactatatatgctgtatgctgtctattattgaccaaaatgtcattatgcagatgtggcacatgatcgtattatcttatgagtgtactgttgaccaaaagtagtatattttaatttttaacaggtcaatgattttttttttttttttgagacaaggtcttgctctgttgtccaggctggagcgcagtggtatgatcttggctcactgcaacctcttcccccttctggattcaagtgattctcgtgcctcagccgcccaggtagctgggactacaggcatatgccactacacccagctaatttttgtatttttagtagagatgagttttcaccatgttggccaggctggtctcaaacttctgacctcaagtgatccacctgtcttggcctcccaaagggctgtgattacacacatgagccactgtgcttagcctcattctgtctttagttggaggcagttagtgaggtataatgcaagaatattgtgcccctggccaaatactttgtccgatttcccatctaagtgcttttctgctaatcttagaagctttatgtcaccactgcctgggataccaagaagaaagacctctttcaaaaatggtttcccggccgggcgcagtggctcacatctctaaacccagcactttgggaggctgaggcaggcggatcacctgaggtcaggagttcgagaccagcctgaccaacatggagaaacctcgtctctactaaaaatacaaaattagctgggcatggtggcgcatgcctgtaatcccagctactcgggaggctgaggcaggagaatcacttgaacctgggaggcagaggttgcggtgagccaagattgcgccattgcactacagcctggggcaacaagagcgaaacttcgtctcaaaaaaaaaaaaaaaaagaaaagaaaaagaaaagggctcaacccctaaaatcagagcttttcccttctcagctctcatgctgtatctctgggatctagttgtcagaaatatagcccacacattgggctattttaaagagtgtaaaatatttttatgtggtaagtataaaagggaagtaagttacatataagtaaatttcattttatttggatagcctaggataaatttaaaacataattttcttctaagtagatctaaattaaccacttccttgtagcctgaaaccttgggattgctgaggtatcatggtccctttcctgttttaggttcagctctctcctggttattttttttttttttttttattttttctcttttcaccccatgatatctagactgtctcctggttattttatttcatgctcccagatccacaaatgaatttggaaagtaggcctttgccacacttcatatgttgtgaacttttaaattactaaatacaattttttctgaggtgaaaataacctgccttttgtggggagtgggggactggaataataaggaggaagaagaaataatttctctatatttaagaggtaaatgagaattccaagattgacctcaaattatttatttttgacatagtttcaaaggcatatcactttctcatatagatgaactcaatattctctagggctttctgaatccgccgtcttaatgggttttaagtgctttcatcaacactgtttatcagaaatacagactgtttattttatattttttaatgtgtgttacgtttgaaacttttaaagaatgagaattcatgtacatgataacatgggtgcaatctgagctcactgcagcctctgcctcctgggttcaagcgattctcatgctttagcattcctcgtagctggaactacaggcgtgcaccaccatgctgggctaatttttggcatttttagtagagacagtgtttcaccaggtttcccaggctgatctcaaactcctgggctcaagtgatatgcccacctcaacctctcaaagtgctgggattacaggcatgagccgaccgtgtccagccaaataccacttattttttaatcgagtatacatcaaagcaaagacaatgcaaatggtgctcagagggacttgtagttgttttcactatcaatctctttggctccagaggtgttaaatactgtcagttttttttttttttaattaatactgtcagtctttttgactcaactccaaacaaatgaatttgctggaattagtaggtttctatcagatacttttatattttatattgggtgccagttaccaattcaagaaaatagcattttttttttttttttttttttgagacagagtctcaccctgtcaccagactggagtgtggtggcacaattttggctcactgcagcctccgtctcctgggttcaatgattcctctgcctcagcctcctgagtacctgggattacaggcatgtgccaccatgcctggctaatttttgtatttttagtagagacggggtttccccatgttggccaagctggtctggaactcctgacctcaactaatccacctatctcggccttccaaagtgctgggattacaggcgtgagccactgcacctggccaattttttttttttttttgagatgaagtcttgctctgttgcccaagctggagtgcagtggcgcaatcttgcctcactgaaacctctgcctcctgggttcaagcgattctcctgcctcagccttttttattttattgtggtaagaacatttaatatgagatctaccctctaaaaattttaagtgtacaatacattattattgttttatgtgatgggatcttgctgtgttgcccaggccattcaagcgattcttgtgcctcagcctccgaagtagctgggattacaggcatacatgaagtattgtacaattttttttttttttttgagacagagtcttgctctttttgcccagactggagtgcaatggtgcaatctcagcttactgcaacctttgcctcctgggttcaagtgattctcctgcctcagcctcgctaatagctgggattacagacgtgtgccgccacgcccggctgatttagagacggagtttctccatgttggccaggcttgtctcgaactcttgacctcaggtgatctgcctgcctcgtcctcccaaagtgctgggattacaggcatgagccaccacgcttggccaaagtattgtactcttaacatggatatgctattttatttttatatgttgtgtaaaatatattgtacaatatattataattaatatgtacaatatactgtaattaatagtgatacagtattgcaactgccattaaaatgatgttgacatcagtgtgtaattttatcactaatgcttttccttttttggagagagtctcgctctatcccccaggctggagtgcggtggtgcgatctcagctcactgcaacctctgcctcccgggtagctggaattacaggcacctgccaccatgcctaatttttgtgtttttagtagattacgggtttcgccatgttggccaggctggtctcaaactcctgacctcaggtgatccgcctgcctgggcctcccaaaatgtcgggatttcaggcgtgagccaccgagcctggctgctaatgcctttcgtattgtattttcaaattttctatttagaaaaatcggctgggcgcaatggctcacgcctgtaatcccagcactttgggaggctgaggccagcagatcgcttgaggccaggcatctgagaccagcctgggcagcgtggcaaaactccgtctgtaccaaaaatacaaaaaattagtggggcatggtgacgcacgccggtaatcataggtgctcaggggactgaggcacgagaatcgcttgagcctggaaggtggaggttgcattgagctgagattatgccactgcactccagcctgggtgacaagaacgagactctgtcttagaaaaaaaagaagaatttcatgtacgcctggaaaaatacgatttacttaaatatttcccaattatttgcagaggagctagagagattatttattgataatcggtgactctttattgccttttaaaaaaattgtgactttctctgggcaaatttatttcttaaccaatttttaaagtactttagaataaattactcaattaaaatttcttttaaattacttctatttgtaggttgaactttctgatgttagccaaggtggatctaaagctaccacttcagcatcaatagctaaatcgatgtggcaataattcctgctgatactcccttaagggaattatatatagtatatataatttataattaaaatattataaattaataaattataaaaatatataattatgtattataattatactaatagttactattataatagttataaattataaaaatatataattatgtatttagaattatacaaatagttactattataataatagttaatattttaaattcttagtatgtgtgaaacacattgctaagccataatgtagaataacttaataagaatcttaagaagtagatactgttatctatattttacagatgataaaacaaaggtttagaaagaatacattacttacccaaggtcatacatttagtgaatgataaattcacttaatttaccctaaccctgatttattattattattattattattattattattttgagatggagtttcactcttgttgcccagactggatgcgatctcagctcactgcaacctctgcctcccgggttcaagtgtttctcctgcctcagcctcccgagtagctggaattgcaggcatgcgccaccatgcccggctaattttttgtatttttagtagagacagggtttctccatgtttgtcaggctggtcttgaactcccgacctcaggtgatccgcctgcctcggcctccaaaagtgttgggattacaggcgtgagccactgcacccggcctattgttattattattattattattattattattagtggtggtggctgtaaactttttgtcagtttctcttttcttaaaacctgggtgctccaaaagaactgcttcatttttgatagccactggacaattgtttataattattttggagctgcaaacccctttgaatatctgataaaagctatgattcttttcccagagaaatacattgtacacaaatttttgcatacaatttcaatttgcatatacctcttgaaacctatctgtagatcctataatagtgatcaaatttcaatgagtatgtaactcacctggattgcttgttaaaatatagatgacctattctcactgcccaaagtttggtgcattaagtctggagttggacttagactctgtctactcctccctactccctactcttttctcttttttcaaagagacagggtcttgttgggctcaagggatcctcccgcctcagctgggattacaggcatgtgcgtggctggaatctgccccctctccccgcttttttttttttttttttttgagatggagtctagctccgttgctgaggtgggagtgcagtggcgtgatctcagctcactgcaacctccgcctcccaggttcaagcaattctcctgcctcagcctcccaagtagctgggatcataggtgcctgccaccatgcctggctactttttgtatttttagtagagacggggtttcaccatgttggccaggctggtctcgaactcctgacctcgtgatccgcctgcctcggcctcccaaagtgttgggattacaggtgtgagccacggcgttttaacaagcacttcaagcacttcaaatgatttagatgcaggatattttaataccacactttacaaagatacccgaggttaagaatttggttattctacttctgttttagatcagctattacagagtatgtgttctaaatgttctaaagtaggtctttattaccaagtgactgtacaatattgcaattgccattaagaatgatattgacattaatgtatagttttattgctaataattcttttattttcaaattttctgtttagaaaaatatcatttgaaaaaatacagtttacttaaatatttcccgattatttgcagagggtctaaagagagtacttaccggtaatcagtggctctttattgcctttattttggaaaaaaaaatagaactttctttggtagatttatttctcaacccatttaatgtggtttagagtaaattcgtcatttaaaattttattttaaattatttttatttgtaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggtgagtgaccctagttctttacttactaggaaagtattcagtaaacctggataatgtgggtatgagaaaatatgtctttgtgggtgttgcctgctttgtatttataaaataggcagatatagttggccctctatatctgtggttctgcatctgtagattgaaaatatttgaaaaaaaaatgatagctgtgcctgcactaaacatgtacatacttttttcttattatcccctaaacagtacagtatgacaattatttacatagcatttacattgtattaggtattataagtaatctagagatgatttaaagtatatgggaggatattgataagttgtatgcaaatacaatgccattttatataagggacctgagcatccatggattttggtattgtggtgggttctggaaccaatcccccatggatactgagataagactgcacttaattgtattcaattgtaaataagcttaaaagaggtaatgtttaaatagtcttggagagaaactattggggccaggagttgggggccaggaggtcacagaacccaaaagacgggaggacagttcttttctgtcccctatcttagtttagtctttgtctttagttcctttaaattccatcttttaaataagaatgaaagcagggccttggatacattgtactgtgtgttccacgaaacacaagggaaaactttctttggttgcttattagtttttgatacaatctgttaactgaatatgtgatatattgtataatgctgtatttcctaaaatccagtcttgcacattttaaaaaaatgttcaaatgatacctttacacccataaaaacaacaggatttttatattggggtactgtgtaatatatgtattgtttatttcatcatgtccttttttaaggctctgctgaaaatgaagaaaagtcagaagttcaagcaatcatcgaatctactcctgagctggatatggacaaagatctcagtggatataaaggttcaaggtaacataaatgttagatgaagacatattctgcgccccccacccccaactcccataaacactgttctccagtctctggacaaaatggattcagatgttttgttgaagaaatgttagtattatattctaattcctattcttgaaactggacactgtacatggtttaaattttttgttaaatgttatctttgcaggatcacaaattaggtgtatgagcaggaaggatggtgtcttagtctattttgtactgctatagcaaaataccagagtgggtaatttatatatttatttatttgtttatttttttgagacagagtttcgctcttgttgcccaggctggagtgcaatggtgcgatctcggctcaccgcaacctccgcctcccaggttcaagcaattctcctccctcagcctccctagttgctgggattacagacatgtgccaccacgcctggcttattttgtatttttagtagagacggggtttctccatgttggtcaggctggtctcgaactcccaacctcaggtgatccacccgcctcggcctcccaaagtcctgggattacagtcgtgagccactgcgcccagccttgtttatttttttgagatggagtctcgctctgtagcccaggctggagtgcagtggtgcaatctcagctcactgcaacctctgcctcccagggtcaggtgattctcctgcctcagcttcccgagtagctgggattacaggcacccaccaccatgcctagctaatttttttttgtatttttagtagagacggggttttgccatgttggccaggctggtgtcaaactcctgaggtgatcagcctgcctcggcctcccaaagtgctgagattacaggcatgagccactgcacctggccaatttataaagaacagaaattaattttctcacagttctggaggctaggaaggccaagatcaaggtgctggcagggtcaggtgtctggtgagggctgctctttgctttcaagttggtgccttgttgctgcatcctctggaggggaggaactctgtgtcttcacatagaagaaggacaagtgagccctgaacactggataaagcctcattattctataaggaccccaatcctgtttataagggagaagcccttatggcctaatcacctcttgaaggccccatcttaatactatcacattggcaacagctgaattttataggggacacattcaaactatagcagataggggaaaaaagacagccaagacatatcccatactttctgtaacttgaaaaaaccaagaagcgggagtgaaggaagtaacagagtggacatggcagggctggcagcggtgctactttgagggcatgaaacacaccgttggctatggagcatgcttattttagggccagcagccgggtactccagcctgccggacacttcagtccagccccctcctgactggggcttgttactcacaagattgcattgtcccggacactaacttgggtccagggcccctccccctagcacttacctggagtttgtgcatgtttcctgctgctgggtgggttcagaaggtgatttcttttttatgtgtacatatgctaaataaatgtgatttaaaaaacaaaacaaaaaagtttgaacaaacttttgtaccttccaccagatcaggaagagagaatgtacttccatcttgagaagtgtaatctcattattggaagaaattagtctcattttggtatcattttacatgggaaggctgtttagtggtaggaagaaaatagttagatctcatctttttttttttgagatgcagtcttgctctgtcgcctaggctggatgcagtggtgctatctcagctcactgcaaccttcaccccactcccacccccaccccctcccccgggttcaagcgattctctcacctcagcctcccaagtagctgggactgcaggcacacactgggctactttttgtatttttagtagagatggggttttaccatgttggccagactggtcttgaactttgaactcctgagcaccagtgatccgcctgcctcagcctcccaaagtgctgggagattagatatcatcttaatcaggattatccaaaatacattgatgctcaagaatgtcagacaggagctactgcctttcttttcatttcttccataaagttgatcctttaattaattaatgactataaaaatacaagccatttattgatctctgttaagcattgtgcagtcagtactctgtagcggttaaaagcatagaccctagagtaagactgcatgggttcaaatcctgtcttggatttgaatcttaggtatgttttctcatttataaaacagctttgtgttaatacctcagatggttgtgaggattaaatgaatcaatatatgataaatcattgcaaaatgccccattcaataaatgttaagtaatattgttttcatcatgattttatataatttgatcctaattacaaccttatgaggtagatctttttatccttattttataaataaagagacttagaacttgttcaaagtagcttgtcccagattaccaagctagcaagaggtggacttgggattcaaatccagaaccctctgtctctctctctctctctctctctctctctctcagacaggttctcattctgtcgccactcttcttcctggatcctacatcaccctgcttcttgatttatgcctttgttttgacagagcatatccttactagctttctgggtaaagggtgcacaactctatcacttcttagctctctcttatgctgtttgtcttcaggtatctaaaataacatgttcgtcctgcccctccttcatccctccctttttcagctgagattctgtgagaaaatgtagtcctaatgccctaaggcatctcttgtatataatgaattagctatgctcctgtgcgtctagaataggattctaggtatgtacttaccttgggagaatggaaaaaatactcacttaaatccttttctgtattttgtagatcaaatacggaaccctggttgaaaaaggctgtgatgctagctgttggctttctgtagtagatgaggatataatgcctaaaccaccatcctttcatcctcctaatattatatatttcaaattctgttagttaaattcattatttatatcagtatgactatataaaattaatctgtaattctacttagccacagaatacagtataattacatttcatttatttttttatttttttccctcctccgagacggagtctcgctttgtcgcccaggctggagtgcagtggtgtgatctcggctcactgcaacctctgcctctcaggttcaagcaattctcctgcctcagcatcctaattgggattacaggcgtgagccaccatgcctggctaatttttgtatttttagtagagacggggtttcaccatgttggtcaggctggtctcaaactcccgacctcatgatccacccgccttggcctcccagtgctgggattacaggcgtgagccactgctacggcccatttcatttcttttacaactttttgttcttctgaaattaataaagccttgggttattttgtttcttttccttatgtttctgtggacctgttactaaatcactggcagacactatgcaattcataaatgtaaaagtccccaatatgaccaaacacaaaacctgcctgtttcctagggcttactctcctgcagcctcctattcccattctccaattgagactgctgtcatatttgttctggttctggaatatgccctcactatcatccctggaattcttttcacctttctcctctgttgtatcttttgtttcctggatgccacatcatcctgcttcttgatttatgcctttgttttgacggaacatatccttactaggtttcctggcaaagggtgcatgacaagtaaattttttttttttgagcactatgaacttgaatgttacaaatttcctaagaagacatacttgatagtttggctagataaagaactatatgggttgggagattttttttccatcagaattgcaaagacattacttcattttcatgctgagttcagggtgttgttatttgagttcttgctcatttttatatactttctgaaatcttttaagattgtcactttcttgattttttaaaaattaatgatactgtgcttggtgtaggtgtcttttttgtatcttcttatatgaagtaagtcttttcatctgaacattcctatcttccagtcctgggaaattttatctctttcttcttattgttgtttcttctgctctcgttctggaacacctcttaggtatgcattgaacatcctggagtgactgtcataatttattttctcccctctttcctatctcttttattttatactaattgctggcagatttttttttaaaccctcattctttttttttttccaaattctttttattggttggtactttttataccatcttgctattttacgaatgcaacatttattctgaagaaaattaagtgctttgtttttttgttgttgctgctgcctgcattgtctttttttgctcttagtgtctctgtcacatcctctttgttttgggccctttcttttataatagaggccttctttagacatctggtactctgtggctgttttattcatacttaagtaaataatgctgattctccactttcctgcctataacatttaaacttggcttccattattagggagctgtgccaagagaagggaggtctcactgttctggaggattgtgtctaggtcctgtaccgccttttgtacagtttttttaatcctgtccttctgtttcatgttcctccctgcatgccctccctgtggttgctggtaccttcaagtcctaggcctttcaggggttctggcagcatattgacctcctccctaaaccccagtggcttaggtttcagctttctctggtctattgaatcactttctactgtttgcccatctgttttccatcttacagaattttgttcacatttcatctgctatagtttctttttctattctctttgtccttttgggtgtatacctttttaatttcttaactttcattttagttgagcttctgagttattaggtgataaatgactatgttctctccaccatatttagctggaaatggtctacagagttttttctattaataatagtattcaggcacaaacatatacacttccccattcccctatacacccctgcaaaatagggcatatagtatatacactgttttgcaacttgattaaaaaaaaaaacctttgtatcatgggtttctttagtttataaagctctatttatgtttttaaccttaaaggtaaaaattttaattttgtatgtgtataacttacctcatctgtcccctgttaacagtcatttaggtcatttcagtttttgccactgtgagaaatgctactctaaccagcttttacatacataattgccttcttgtgacataggtaatctatgggaagcactgagaccagcacctggtatagagcagaggagctgccattattgcttgtgtttgctgggatcacacaacaaaaacattctataatttcttcaccagctatttccatggagcttagtgagaatttcttaggaagcctttgagaaatctttttaagttatattttctagtaaacgtaaattataggtaagaaagtcctatgtagcttagcctattgtattcattttacagcgtcaaaaaagtctttgtcatttgttgatttggttttgttgttcttgttgcatagcactcccaccaaaggcatagagaacaaagcttttgatcgcaatacagaatctctctttgaagaactgtcttcagctggctcaggcctaataggagatgtggatgaaggagcagatttactaggtatgatagctcatctgaagaaatatcatactgtttttaaaattgattttttaaatgatttaattgaaaagtcctttaaaatgtccccaactgctcagtgatacagggttattgcccttttaggtaattattgggaacatattctttgtgatcatgaaagttttaaatgaaagcacctttgcatatgggtatgcttaaaactgaattgcatttaaattcatgttttgaattcatacaacacaatttattgaactcctgctatatttcaaaacagataactacacataagaacatggtgatgtgtgtgtgtgtatgtgtgtgtgtgtgtatgtgtatgtgtgtgtgtatggattgatgcctagttatcccctggcttacataaatttcattatattctgttgactttaattaaataagaaattataacacttgatttttctaagttttctcagagtatattatgttttagccctatggtaaatataatcattttaaagtttgtgttctagaagaatacatggtctgaaaagaatattgcatttggctcttagactatttgcctgctgacctttgccaagtgtcttaacctttttggaccttaatttctttgtgtgtaaaatgaaggagctggaccctagttcaggaatctggcaaactgccgcttatgggccaaatccagctgaccccttgtgtgcgtgtgtaaataaagttttattggaacacagacaccaccatttacttattgtctgtggttgcctttgcctaccaacagcagagttgagtaggcaactgaaatctgaagcctaaaatatttactgtctggccctttatagaaagagtttgccaacccctgccctagatgatctctgaagttcctttcagtgcaaggttctggctcctatgaattagttttggtataccttccttataacttaggaccctatagaaattaaaaactatatggaattaaaaatatatacctttggagatactaagctaaaaaaatttgtatctattggtataattatagtacagattacactgttctcaaaaggtttcgtttgttaattgttatgactttggagtggagtgacattgcttgcattattttatgttaaatttattgattgccagttatgtccttgacattgtaaagtgtttttgaaggaaaacacaagttctatctaaatgtctatctaggccggttgcagtggctcacgcctgtaatcccaacactttgggaggccaaggcaagtggatcgcttgagctcaggagttcgagaccagcctgggcaacatggcgaaaaatatcaaaattagccaggcatggtggagtatgccagtagttcagctgcttgggaggctgaggtgtgaggatggcttgaacccgggaggcagaggttgcagtgagcctgggttgcaccactgcactccagcctgggtgacagagccagatcccgtctcataaaaataaataaataaataaataaataaagtatctagtaagagagattgaaagtattttaagtacatatagttagacagaaagggattgtcaccattaaagtttaagtaaaactttggaagaaattgaatgaattgcgtttctcatggagggctaagaaagttgtaattcttttttttttttgagacatagtctcactcttttgcccaggctggagtgccgtggtgcgatcttggctcaccacaacctctgcctccctggttcaagtgattctcctgcctcagcctcccgagtagctgggactaaaggcgcataccaccatgcctgactaatttttgtatttttagtagagatggggttttactatactggccaggctggtctcaaactcctgacctcatgattcgcctgtcttggcctcccagagtgctgggattacaggcatgagccaccatgtctggcctgaaagtttaattcttaaggaatactccatttttatatttaattttatgttttaattttagtttacatcaaattatacctgaaaagtttcttttaaggcataattagtttgagaaactaactccctggcaaatttgaggagcagatgaaaaaatgttagaagaattttaaaatgtatattcagtgcagtaaaattcaccagaatcaatatacatcaccccacaaaattcctttatgctgtttgtattaacaagaatgaagtaattctgaatataatttgtacactgtgttacctcataatgcagtaatgagtgataaaatgtttaaggttggtggccccaaactttcttttcttatgaagtatttagaagccccatagtacttagaaatatctgttgtcttttaaatcaattaaaagtaatatcctgatgctttggtttcttttccactttgaagataagaaacagactacaaactatcttttccattttgtagatgttgatacatttatctctagaatagttcagattagaatattttaatatattactgtaagtttagttacttatgaatatttttggtcaaagatggtaaataaaaatgttcctggccgggcacggtggctcatgcctgtaatcccagctctttgggagaccgaggtgggcagatcacctgaggtcaggagttcgagaccagcctggccaacatggtgaaaccccatctctactaaaactacaaaaattagctgggcattgtggcgtgcacctgtaatcccagctacttgggaggctgaggcaggagaattgcttgaacctgggaggtggaggttgcggagagccaagattgcaccactgcactctagcctgagtgacaaagcaaaactccgtctcaaaaaaaaaaaaaaagtccttggcttctcttctgtgtaattcagtgataacaaatttgaatcattatatatggactcagtacttcaattactgttttttttttttgaggtgagatctcactacgttgtgtaggctgtcctggaactcctaggctcaaggaatcctcttgcctatagcctcccaagtagctgggactacaggcatgcaccatcacgccagcgcaacctttttctgattttactaatttaaaagaatctcaacaatttgtcctttatcttgattggtgtctcatccctcaactttcttatttaaaactctctttgctgggtttctgtgatatcaacttgcctgtgtcctttcctgtctcgactcttaccttttcagtcatcttaacaggatccgcttcctttgctcgtctttcaggtatcagcgctcctgtcctaggcctgatactttgtttaagaaatcatgtttgctctcattgtttcttggttttcatggctaattactcccaagtttttacctccatctcagatctttttctagagcccaagactattatttcctaattgcatgctagacacccctaaaatgacttggagggctttacgtttgacatgtataaagctcagtttgttatctttattgttctgtcccccaaggctgctcttggaccaacaggcactgttttagtgaatgaatagctctccatcctgcacctctcactttccctcacagctaatcaccaaggcttgtttgttccctctcctaaatgtgtgtgtgtatacatacatatatgtatatatatatatatatatttttttttttttttcttttcttgccttgcttaagtgatacatcctccaggaattctgccttgatcccctaattaaagcttagttttccctgaaatgtattcccatggcactgcattttattataccactcttcatactttactgttattttttagttatctgtctccctggacagactataagctcaatgtggctgagacaactgtgtctttgttcactgttgcatatttagcacatagcaactgagtgaatgggattgctaaatagttctgacagttttgtttcacctcaaaatcggtgattcttctccttttgggattaaaaattcttcacaggtgaatttgtaagagagcaatgtacctttggaaaaacacacatgtagaactagataaaattgtgcatcttctcaagggattaccatataactctgaagctcatctatggacctagcttgagaatcagtgttaaaatccaaatgaaacttctgtgattttaaaaactgccaggcagttttttttttattttgcttgtttttaataagtaaagttttcaaatgtattagacctaagtttgtgcttcatttaagtcttgaatagaaatgaggccactttatgtttttcttataaagagttattgatcatttcaaaatgaaattttagataatcctattggttatatattcaatttatacaccatatattaagataactcttcattgggaatgtgtacatttaatgtaaactttatttatttatttttgccatctcggaaaggctttatttctacttcatccgggtctcatgcagactcaaaggcaccatcatgtgtttccatttggtatcctcatgactttttgtagtgttttcccttaagagtaagctctgtacattgccagttaatcttttaacgataattttaaaatgttgttgctgttgtatcattgatgcaaaaagaccaacaatagaagtacaatacaaggaaattcacaacatattatagtgggacagactgagtcacatttaggtgatggtgaggacgcagtagcagtatattcatgcacccaaagacgtgcaagccaagtaggataatatatggatcatacggtgaattttctaagcccactgaggactttgtaccttttcaaaaatgtcctgtataccctccagtttacagaattatctgtcttgtctactggcttcatggctaatgtaaactttagaaactatattataggatttgtttttcctgtagcacacatttcaatttttttcctttttataaatatttacacttcattgtgtttagttaatggtttctctacatcttgtcaatttctttgtttcctctctctcattttaaagtaaatgagtttagttcttgctttctgaaaacaatctaattgagattctcattcatttttctcttgggctgcttacgtaggggaatattctggtgtgtatgattttgaatattttaatattactgctttttaagctaggtgttcttggctgctgttctcatctaatgctttctcatcatttttttctgctcaactatttttttgcctttcatatattttcagcttccacgcttatctaactgcttgagagtttatagcaaacatagttactatataaactgttttcaaccagtctacattcttatttcttctgtctctataactttgttaaaaagttaacattcccagccattgtatctacaaaggaataaaaatttaacattagtgtttaaagcaaatatcttgccgaagatcattttggagttagaatttggaaacttttttgggacttttattttgttttgtttggtttcagtttgtagataatacataggtagatgattaatctatttctgatatttaattctttctggtgtaagtaccctgatctttgagaaaattagaatatagacaaaatatgagtccaggtacacagaatatgtagcattcctaggttggctgtttttgttttaagtaatttttaaatcatttggaaaattaccttttttaaaataaagggacatgttaactcctttgtcgtatgtagttttctttagaaagatttctttcctgtttacttgggttatgattattacttcttccattgtatgtgattttccaacattattagctcacaattccttgaagatgagtgactggtgggttttttttgttttgttttgttttgctttgattttttgttttttgagtgatattccctagtgtgttatttcatttcttcagtttcttaggaaaagcaaattaatagctttcttctccctaaagaccactccattggatcttgcattggatgctctacgtgcttatctcacagtagtcattaaaatgccaaacacgatcaaagacattcactcaagtgataactgaacattattattttataggtggcactttgaaggaaagtttgtattgttaattgaagattttcaatctaattatagttaatcttattgtgagaaagaattggtaaagcattttttaggtatatcagcatccttatgaatgaaggaaatcatctttatttctgtcttttgcacatcattatgcattaaatcataacattgtgattccagatgtttttcatatcatgtataaaactttatagattaataatctgttttcatgctgtttcttacgtaaaacatttcttgttctttgtttttgctttacatggaatgcatgggctttaagaccataatttctttggtaaggtttcatctgccttggggttctatctttctttagccttgtttttgcctgttctctattaataaggtctaatttttaggcaaaagcctacgaggtcagatgtgatttagaaacaatttcgatccatattaaagctgttcttttttaccctatgtagtgttggaatattagaatatttggcagaaaagtcttgatccttttgaaatattatctatgagaaatatagactaacagatattaaaaattggcctcattccctagcaagccgattcagatttaaaaaagaaataggccaacaaaatctttagccttgttcgtaatgaataattatttataattttataatctattaaagtaggtccatcaaatgaaattatagacaaaataaaattaataaaggacagataaaatttctaaaataaaacttgtgactatagcttatattttaaatgtatataattattgatgcatttattttcaaagtctttatcttttttcgtttgataggaatgggtcgggaagttgagaatcttatattagaaaatacacaactgttggaaaccaagtaagtatatgtgaaattttaacagaagataaagaattttcttcttgtccaagtcaatgacacttcatcgttttaacataatactaatggaatctccctgtcccatctcgttccccaactctgagtgtgcacacacacacacacacacacacacacaccctaatgttgggacctacactgccctgttagatatgttcccttgccctgtttttttgtagaaacacagattgtcatctccttttcactctataagtatccatgcctttttcttaatcttctaaatttgtcctggttttacactttttttgctccctcccttaacatttgtctgttttcttatctcttctcctggggtttcttttatttccacacaaatattttcatgtatactcagccttcctcttcagagctgtcttccatagctgtgcattcttgggtgcaatttgtggagtcttaagccctcagacacatttaatgggacagatccccagtcatgtggaaaagctgactgggttcctttgtcagtttgctgtgtcagagcaactttggaacatctgtgtatatccaagacagaatgcagttataataaggtcctatgcccactatacccaaaggaactggatatcagggttttttcttcagcgtagactgtcttaactttccagtttaaactgttttctcattatttattaaaggtaacatcaagaaataattttactttattgattgggtaatatattctgaggaattattaacaatagtaaccttttgaatgctatttttaaaatttaatcttctcactttttagtaattgatgatctgtcttgttttattcatttgataaatgagtaaaatcttagactgttgctttgtgttctttttgcatttatctacaaacaacattgggtagaatgtcttgaagtattaaattattattgtctatggttgtacagtttagtctacaaaggaatagctgaaagatggaaagaatatttatttgtaatgatgcacttgaaatatgtgtttcttagaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaagtaagttttaactgtgttgttctaaaccaaactctttgccagttatgccacaaagggttacagatgtaaccctgagactgagaccttctgtccactcaagcctggaaggccaagagctgcctgggagagggcaaagtgccccagcccattgcctctgctgtgagcaggcccctccagttgttagcctgtcatctaaatattattgtcttttgttttttgttttctgtttttttgagacggagtctcactcctgttgcccaggctggagtgaagtggcaaagccttggctcactgcaacctctgcctcccgagttcaagcgattctcttgcctcagccttctgagtagctgggattgtaggtgcctgccaccacacacagctaatttttgtactgttagtagagacagggtttcgccatgttggccaagctggtcttgaactcctgacctcaggtgatccacctgcctcggcctcccaaagtgccgggattacaggcgtgagccactgcacccggcctaaatattgttattttttatgtctataatgatgcaaaaagagttagagactgttcaaacatctttgttttgataataaggaaatttaaaacattatttttttatcccactttctttaatacctgtttatttctgaacaatgctatgatatgatgatactccaccaaatgagggtggctaaataccctgtttgggaaaagaaaaataatcctttagtggtagttaaaattgttgacctactcttatttttttgaaaagatgagctcaattcaaataacatgttttgttttgttttttccccactagagctcgggcagaagctgaagatgcaaggcaaaaagcaaaagatgacgatgatgtaggtttacaattttggactttttttcttaccttaccatgttttggtgtttcgggaagatcttcctacgtaagctttggatataatactataaagatttttaaaagtcaggagacatgtttatggtcatgaataggatagctcatgcttctgcatggtatccagatgctgagctttctagctccatgcagtgtgctcattttccctctgtgcctctgtgctcttacctgtagttgcatgttcaagtttgaggaccaactgggacattttggggtttttggttgttgttattgttgtttcgtttcaaattttgatttagaaatatgaaagcttaataataaaaattatttaacagtattaaaaagatgaagtctagaactttagtactagtcaattagttcatattgttgtgaacataagtacagaagaataaatatgagcttcttgctaatatccttagcatacccctagtctttttttttgagacagagtctcagtctgtcaccgaggctggagtgcagttctgcgatctcagctcactacaacttccacctcccaggttcaagccattcttgtgcctcagcctcccgaggagctgggactacaagtctaatttggctaattttttgtattcttagtaaaggtgggattttgccttgttggccaggctggtctctaattcttggctttaggtaatccaccctggtcagcctcccaaagtgctgggattacagatgtgagccacccagcccagcctcataatcattcttataacaaatgtttgcaggtcaaaggtcagaccaaagatatgtggttgttttggacagaatgatcacttggtgccccttcagtctctgttttttagtatcttatgtaatgatacacacaaaaacaagtaagacatgcaggttatgaatcataataaattaacattgtgaacctaccacccaatctgataattagaacattactagacattgaactattctgtgttcctcccctgcagagaaagctgctatcctatatttatcatttgcttaacttaaaaaaaaaattttatcatatcacatatgtatatatggtttaatttttccttttttgtgtttcacactacatttagtcttggagaccagcttcttttcctcagtggcatgtttttgagattcatccgtgtagtacagtgctgtagttatcattcatattcactactttatgatatcccattgaatgaatagtcacaatttatgtatttattttcctgttaaggaatatttagtttgtctcagctttttacaatgctgttgttacaaacattacagtagaagtctccaggtgggcaggagcagtagcctttccagagtacatacctactagtgggcttgctgtgttataaacttaagatctttatcatttgttgtttaactttattgaaaggagaggcccagtttctataacagaacaacaaaggaggaggactgctaagggctaagcttagtgtctttcttatgtcccaaacctttcagctttgatccaaaatgtggataatgaaagcctataggacgttgacttgagccatgttcccttgaggtcttacccctgtgctcactctatattcacatactctgtctaagagtaattctggctaatacagttgtctccatctgtttgcatttatgttggtattttagcgactcttatagttgagtaccttggtaactaggtaataagtttacccttaatgctggtcttgggtgagtatgtggtttggtaatttgagataaatggaactaacttataactattttctgagtgacgattgttacagagcatgaattaaaataatggtagagcaacatttttaggtgaaacttacaatagtgtattaaatctatgtagataacaattttggttttagtttaaaatctgcactatcctttatttttattttagtattattactattttttagagacagagtcttgctctgtcactcctccaggctggaggagtacagtggcaatcatatcccaccacagccttgaactcctgggctcaagtgatcctcctgcctccgcctcccaagtagctggaactacaggtgcatgccaccccacctggctattaatttaattttattttttgtagagccagggtctcactatgttgcctaggctggtcttgaactcttggcctcaagcaattctatgctttttttttttttttaacttcagcctcctgagtagctgggaccaaagttgtgcgccaccccatacgtggctaattttttattttctgtagagatgggatctcacaccacattgccaaggctggtctcaaattcctgggctcaaagtgatactcccaaagtgctaggattataggcgtggaccatcgtgcctggccctactgtttgtttttgttgttgtttttgttgttgttgttgttttgttttttaaagacaggattgcactctcttgcccaggttggactgcagtggtatggtcatggctcactgcagccttgacctcccagctgaagcaatcctcctacctcagcttcccaagtagctgggactacaggtgtgtgccaccactcctggctacagggttttactatgttgcccaggctggtctcaaactaagctcaagcattgtacccgcctcagactcccaaagtgccgcgactacaggcgtgagtcactgcgtccagccccctactattctttttattttttagctttattttttatatatttttaagaaccatgagaacagacccacactactctttatgatttctttataatatgttcaaatatctgtgtatatatattcagaaattaaattgctgccttttatctttgtagtcatgagtgattatttaaatctctttgttggctgggcacagtggcttacacctgtagtcccaacactttgagaagctgaggcaggagcaccactagagtccagtatttcaagatgagcctgggcaacataacgagaccctgtctctacaaaaaaatttaaaaattagtcaggcgtgttgacatgtacctgtagtccaagctactcaggaggctggggtgggcagattgctttaacccagaagttccaggctgcagtgagctatgatttcaccactgcacttcagggtgggcaacagatcaaggccctgtctcaaaaaatatatttttttaaaaaaaagtctttgttgattttgtttttataaagccatttttctttaaatgatctactagattaaaaattaaggaatgcttaaaaactgaaagattttgcataactctgagatgaacaccaagacatttataagcttccagaatgatatgtcattttcttgtcattatagagtgatattcccacagcccagaggaaacggtttactagagtagaaatggcccgtgttctcatggagcgaaaccagtataaagagagattgatggagcttcaggaagctgttcgatggacagagatgattcggtttgtatgacaagcgctccattattttcctactattattttgtaggtttgaatattccttcatgtggaacttaagtcctgccctgtaagatccaagcccctttctctgtttactaggagagactttttaaagtaacactcagaattagcaacagaatgtgatcaaaggaggtgctttttgggccagtaagggatcttggaggatgttactacgacctctaaaaggcaattattattacttaggaatgatggtcatttttcaaatatagaaatcaatactacttacccagtaatgtcaggaaaagatcacaatttcatatgcaacacaggaaaataaattattttgactcagtgtctttctgtaaaatactcttgcttgatttctttctctcttttctaactgttcatgccaagtacacccttccattggtatctttcagtcagatggctcttaaatctcacccaatgctgccatctaatggttgtagtctcagtaatagtgtttctttaatttagaaagaactgaaaagtttgtaaatgagctgccccctaatttacccatatttttgagtttggattgtcatatcagatttaccaataatagtatgcattgacatgttgtttttaagtttatgaacacattctctaattgccaacttttacttctttaggattacatcatttatttcacagtttatgtaccctttaccaatgttatattagaatcaagtgttttaacatatcattttacaatttgctgtgatagtaattgcttataactgcccataaggaagatcagtattctaatctatatttattagacaaggaaactaacccactagaaagtgtatgttcttaactgcagtatttagtggatatcgaataaataataagtaaatattcaaaaaactgaaagtggaccttatttatttatttatttatttatttatttattcattcatttattgagatggagtcttgtgatggagtcttgctctgtgcccaggctggagtgcagaagtgtgatctcggctcactgcaacctccaccccctgggttcaagcagttctgcctcatcctccctggtagctgggtttccaggtgtgcgctaccatgcccagctaatttttgtattttttagtagagacagggtttcaccatgttggtcaggctggtctcgaacttttgacctcaagtgatccgcccgcctcggcctcccaaagtgctgggattacaggtgtgagccactgtgcccaactggacttcactttccattgctgtttttaactctagcagccaagtggtagtcaacaaattaaaggaaatagtagcttacttttaactacttcactgaagtaaagaatgtttttaatttagttcataacaaaaaagtagtgaaaagagagctctgattatgatggcagaatccctaccacctcataaatcaatttggaatatcttattttctgaaattttgttgaatcacctgtcaatccagtttatcctcttccctgctgtggtcatctttccagtgatggaaaagttttagtcttgtgaaaaatgacccctcaggatgccaaagtttcaagctattttgtgagagctccgagtatagatgatagagacttttatgtaaagatgggaatttacaaggcaatattttaataaaagggaaagttagagggtatcttttcaataaaaaattttaaatatcattcaggcatgttggctgtctagcacatattacagtcctctgtcggtagactaagctctttgagggagggatgatattttatttttcttagtagaattaaagtcaatctttagcagattgactgacacatggtaggtcaaagtaactacagtatttattgaacttaattgttgactcccctctgtgtatcccatgaacttcttgggtctcttgttcttcagaaagaaaggtagaatacctcactgataaatgtttcttttcttttctttttgaatgtagggcatcacgagaaaatccagccatgcaggaaaaaaaaaggtcaagcatttggcagttgtaagtattgaaaaacaaagatgttagacagcacatgagacaagaaaattacagtcaaaatttatttccaagaatgattttatgtccattttctttccttcattttttttttttaaactaggggtaatggttaagtagctaaactgaactttttttttttttttaatatatagtgtgccaactcggtaaggctcttctcaaggacaaaaaatatgatatcgtaagctgcatcatgttgactgtgcatttgttgcaatcctctgccaaatttaaataatggggaattatttagagacttgaaaatgacctggatccccattaaataagtttctgattggctggttttgtgattgtaagaaactttacaaagtgaagatgagaaatttagtgcttgtagggtttgagtaatattgtgtatgtattgagcttgagttatgtttgtgctagaagtactatgtgtttactgtgattaaaacttacccttttttggtgaatctgctatttaatggaagtgtcaattaaaaaagaaatagacccgaaagtagttgtttaaattgagcttaatcagaaaatgtataaaatgtgtgttaacatggtaatatgtgttccagtacttgattataataagctgtttttagaactggcatactaagcttccattcacatcacacagccataaccttgcggtttaacaatcgctcttaccttgcaccaagtaggagctagcaaaaaaaccaaaatatatttattcagtaggagaagtttcctctatttaagagcttcttgctttcattatacaaattgctagttaaagaacaggcacccgccattctaagcaatagtttctcttcactgaaagtctgagtttggctacgagttactgctaaggctacagcgtatgactacaaaaactgtttttgccaatttctaactcattgccttgtaaaagtactctgaaattttcttcaacattaaagtttgtggaaaatcaaggattgtttctcatagtacatgtgacacacagacatactgtcttcttttagtttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagagtaagtcttttccaaattaatcattatattctaaattaagttagtggttcagaatattcttggcctcttatcagctctaaggattcaggtaaatctataaaaaaatcatttctgggccaggcacggtggctcacacctgtaatcccagcactttgggaggccgaggtgggcggatcacaaggtcaggagttcgagaccagtctggccaatatggtgaaaccccatctctactaaaaatacaaaaattagctgggcgtggtggtgtgtggctgtaatcacagctacttgggaggctgaggcagaagaatcgcttgaacccaggaggcggggttgcagtgagccgagatcatgccattgctctagcctgggtgacagagtgagattccatctttaaaaaaaaaaaaaaaaaaaaaaaaaaaaatcatttctgtaacttggctgtctttaagtaaattacttgtagtcaaaagtttttatgaaaattgcttttcagtttttataaaagagaaggatttttttttaaatgcctcatttttgctggtatgacaacattgataaatacctattaatagaaatgtgaatggcctttagaggtaaatgagcctttatcctaaatgtttgaacatttctgttggtgtcagaggacttggttttccatcctgactttactactcattaggtacaaacacttgggcaaattaacctttcagagcccccagtttctctgtctgtaaaattaatctgataacctatctcaaaggtgattagacccaattatacagttatctgtaaagtatctgacatataggtagatatgttaactgtggtatatatacatagcaactcatcttatgaaaatttaaatggccaaaataatggcaaattattttcaaaatcattttaataatattttaccttataactccaaagtttaccaaatcagtttgcatttttattttctgaaacaagttaatgggatctaaaatctaacctatatcaatcttcctaagcagatattgatttactcaagttttaaatcacttctagcacgttttctggcattaggatattctcagtaaatatttgttgaatgaacaacaacaacaaaaaagccaaacatacttaagaattttcccctttcatatggccagcatctgaaacctgatataaatttggtggctgatgattcaatttaatgtaacaaagctgcttggtaacctgttaaagcttaggcactgaattcactgcacaaacttaaaaagaccagctttagtataacactttgtttgtttgttttttgagatggagttttgctcttgtcccccaggctggagtgcagtggcaccatcttggctcactgcaacctccaccgggttcaaatgattctcctgcctcagcctcccaagtagctgggattataggtccgcactaccgtgcctggctaatttttgtatttttagcagagacggggttttaccatgttggccaggctgctctcgaactcctgacctcaggctatctgccctcctcggcctcccaaagtgttgggattacaggcatgagccaccgtgcccggcctattataacactttttaaggagctgttatagttgaaataaactaatttgaaatcatgtaaatttttgttgtttttgctgttttagtgacagaggagagataaaactggggataaacgtaattaaacgtattcatgtaattaggaaaatcttttttccttttagaactgaagctagtttagcctcacgcagagaacaaaagagagagcagtatcgtcaggtaaaagcacatgttcagaaggaagacggtagagtgcaggcttttggctggagtctgcctcagaagtacaaacaggtaatatgcacatgtggtaagagcatccagcaggaaagaagagggcaagttgagtgtgcgtgggcatgaaggattcactgtacgcatcccagccctgctcatctcagccgcatggactgggcacacatttaagcatggagggtggtggttttcaggctgttttctagagctgtagaactcaaatgaaatgctctgagtctgtgagggggggaggagtcaataaagggtggctaagtgcatggagtttgaggtacccgctctgctgtaaccagagcaattctggtttaatatttgaagatttcattttttaaaaaaccagcatcattgttgaaaaaattattggcatggaacttttcaaactgttcatttaaaattaagttcaggtcttcaggaattttatctgtctactccataattcctaccccaaaagactcacatgttcatgtacaaacacatatgcatgtgcacgtgtgcacatatgtgtgaattagagcctctttttgagctcccattatatcctgtttattgaattgctcaacttgatttttctgtttttcaaataagaatggcaaaattggctgatgcctgtcattggctcatggtgcctgttattgactcatgcctataatcctaacactttgggaggccaaggtggaggatggcttgagctcagggagtttgagaccagcctaggcaacatagcatgacctcatctctacaaaaaatttaaaaaattagctgggtgtggtggcctgtgcctgtagtcccagctaccttggaggctgaggtgggaggggaccgcttaagcctgacagattgaggctgcagtgagccatgatcaagccactgcactctagcctgggcagtagagcgaccctgtctcaaaaaaacaaaaaaacaaaaaacctgaacttgatttcaaggagtaaataacagcagtgcttgctcatgtctcagtggatctgtaataagttcacttttgatgaggcttactaatgtgcctttttcactcctccttccaccattattaggtaaccaatggtcaaggtgaaaataagatgaaaaatttacctgtgcctgtctatctcagacctctggatgaaaaagatacatcaatgaaggtaagttcattgtgaattaaaaggagatgttttctaaactctgggtagttttttttctaaaaccaaaaaagtataagtattacttctatggtgaggttattgttcattttataatattaggttataagacctgtatttacaaccattagttattttaagaaaacatgaaaatgctaaacatttctagacttaatattgttttctttttcacctgagaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggtaagtgtgtgtactaacatttgacctggtttatgagactatgagtttaactctttcatccaaaatttgcctctgggtccagcttctaattgggattactatgccctggcttactgtccctcagcacccttttaaaatcaattttaaaatattgaggtataatttacatgcaataaagtgtgcactcgaaatgggtataggtcagagttttgacacatgtgtacacgtatgtaatcactacagtgatcaagctaatggaacattttatcattgttctgctttacctgttagttttgtgttgctgtttagagacagagtctcactctatcacataggctggagtgcagtggcatgatcatggctcactgcagtgttaacctcctggactcaagtgatctgtccacttcagccacccaagtagctgggactacacacccacaccaccacacctggctaattttattttttgtagagacgagggtttcactgtgttgaccaggctagtctcacacttctggcctcaagcagtcctcccacctcagcctcccaaagtgctgggattacagacgtgagccactgtgccagcctaactgctagtttttcatctactaattaatattgataggtggttgtattagtctatattcacactgctgataaacacatacccgagactgggaaggaaaaaagaggtttaattgggcttacataggtaacctctggggaggcctcagaatcatgacaggagatgaaaggcacttcttacatggtggcagcaagagaaaatgaggaagaagcaaaagtgtaaacccctaataaacccatcagatctcgtgagacttattcactatcacgagaatagcatgggaaagactggcccccatgattaaattacctccccctgggtccctctcacaacatgtgggaattcggggagatacaattcaagttgagttttgggtagggacgcagccaaaccacatcagtggttgtatttttacccttccaaataatctggaaataaatttgaaatagtattgccttttactgtaacagcaccaccttatgaatatttgtacatacatattgttttaaacatttttcctcctttgcctatacaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtaagagtgagtcatgcgtttctctgccctcccctccatccacctacctgctgggcactgatgtagcagctgaagatgcagttctgcaccttgctgtcatgaagcttatgttctagttagggaagattaaaaaacaaactggaaaccattgaataaagaagatattttcaggtagtgaaaaatactgtgaagaaaataaaacaatgggaatatgagaaaataactgggagccagaggactgtttggattaattaataaggaaaggtcttctaaagttttggattaaacattatgtgatgttaaaacattagtttaaaaattaaagaagtgtatgtgatatatccatatgttggaatattattcagccataaaaaggaatgaagttcttttttatattttattgtggaatacttaatatgagttctactttttttttttttttttttttgagacagagtcttactctgtcacccaggctggagtgcaatggcatgatctcggctcactgcaacctccaccttccaggttcaagtgattctcctgcctcagcctcccgagtagctggaattacaggcacctgccaccacgcccggctaattgtttgcatttttactagagacggggttttaccatgttggtcaggctagtctttttttttttttttttttgagatggagtcttactctgtcactcacactggagtgcagtggcaccgtctcggcttactgcaacctctacctcctgggttcaagtgattcttttgccttagcctcccaagtagctgggactacaggcacgagccactacacccggctaatttttgtatttttggtagaaatggggtgtcaccatattggccaggttggtctcgaactcctagacctcgtgatctgcccgcctcggtctcccaaagtgctgagattacaggtgtgacccaccaccccgggcagtcagattagtcttgaactcctgacctcaggtgatccacccgcttcgtcctcccgaagtactgggattacaggcatgagccactgaacccagcctgagatctaccctcttaacacatttttgtttttgtttttttgagacagggcctcactctgttgcccaggctggattgcagtggtgcagtcacaactcattgtactcattgcagccatgaccttccgggctcaagtgatcctcccagctcagcctcccaagtagctgggaccacaggcgcacactaccacacctggctaagttgtttgtactttttgtaggcagggtttcaccatgttgcccaggctggtctggaactcctgggctcaagtgatctgcctgccttggcctcccgaagtattgggatgcccagccctcttaacaaatttttaagagtacaatacattatcctctaggtagaagttctgacacatgttataacacagatgaaccttggaaacactatgccaaaggaaataagtcggacacaaaaggacaaatattatatgattccgcttatatgagatatctagaataggcacattcataaaaacatagagtttctgtgtgaggtgatggaaaagctttagaaataggccggccatggaggttcacactcataatcccagcactttcagaggccaaggtgggacgatcacttgagcccagaagtttgagaccagtctgggcaatatagtgagacctcattccacaaaaaatcaaaaaatgaggcgggaggataacttgagtcggggaggtcaagactgcagtgagctacgattgcaccactacacacccacctgggcaatgggagtaagaccctgtgttttaaaaaaaaaaaaaaaaaaaaaaaaaaaaagacctggcatggtggcttacacctgtaatccagacactttgggaggctgaggtgggcggatcacctgaggtcaggagttcgagaccagcctggccaacatggtaaaaccccgtttctactaaaaatacaaaaattagccaggtgcagtggcaggcgcttgtaatcgcagctacttgggaggctgaggcaggagaattgcttgaacctgggaggcagaggttgcagtgagccgagactgtaccattgcacaccagcctgggcaacaagagtgaaactctgtcgccaaaaaaaaaaaataatggtgatggctacacaatgttataaatattaatgccaatattgtaaatattagtgccactgaattgtacacttttaaatggttaaagtggcaaattttgtttatatatatattatttttactgcaataaaagtttttagtgtgatataaataaaacaattttctaaattaaaaaatgagatttatttttatattgtaaatatttttatattataaatgcttagtttttaatgttttactaatatcttaatcaacctatatacttggggcatttaatttttaacagtaatggatagaagcttatacttcaagtagtagcagtagtcttgatgatttaaaagaatttttttttggctgatgttgtcagatataatagattgtttttaacctgtggctgctgaggagctcactaagaacagaagctggctaggcgtggtggctcgcacctgtaatcctaggacttgtctgaggttggtggattccttgaggccaggagttcaagaccagcctgaccaacataccgaaaccctgtctctaccaaaaatacaaaaattagccaggcgtggtggctcacaccggtagtcccagctactcaggaggctgaggcaggagaatcacttaagccaaggaggcggaggttgcagtgagctgaatcatgccactgtactccagcctgggcgacagagtaagactctgtctcaaaaaaaaaaaaaaaaaagtttattttctgacatttttatgtttatttgcacttgtgttaatagaagtattttcttaattttttaagttaccttcccatattgtgaagatttgtttatgtaaatttaatgctacctgtattcaactacctgtacatctcacctgcataactctcatttcaaacctgtaattgttttagtaaaaaaaatgttatttatagaagtttactttgctgttacaagaagatttatttttcaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccaggtatatccattctctttacctgccatctgtatagagtctaaggctacactcagatgcctcattatggacttaatttagatcttaagtaacaaggttgaaagaacttgaaagaagatactgtaggccgggcgtggtggctcacgcctgtaatcccagcactctgggaggccaaggcgggtggatcacgaggtcaggagatcaagaccatcctggctaacacagtgaaaccctgtctgtactaaaaagtacaaaaaattaaccgggcgtggtggcgggtgcctgtagtcccagctactcgggaggctgaggcaggagaatggcgtgaacctgggaggtggagcttgcagtgagccaagatcacgccgccgcactccagcctgggcaacagagcaagactctgtctcaaaaaaaaaaaaaatgctgtaatgactgttaaatggaatgaagaattcttaatttcatggtacagtgtgaaggagtgggtagatggaatggaattctataacaggggtttgtgtggggaaataattggaggagaaaagcccagacttggaatagtgttttatttactttgtagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgaggtataataatgggtcatcaacttaggcaactgggtgaagtgcacaaataaaaggaaccaaaataatctcaaacagtcaaaagatttccactaattagtgtcactgtggtggattaaaagatacctattcttgtgataatttcatgtattcccgctccatcattctcgctggatattcccccccatttcttctgtacaccttccaatttaaaaaaaaaatcttatctataaaagtataatcatgcatcagtcaacaatggggatatgttctgagaaatgtgtcattaggtgatttcatcattgtgtgaacatcatagagtgcatttacacaaatctagatggtatggcttatcacacacctaggccatatggtatagcccattgctcctaggctagaaacctgtacagcatgttactgtactgaatactgtagataattggaacataacggtaagtatttgtgtatgtaaacatgcacaaggtactgtagaaatatagtagtataatcttgtggaaccaccaccatatattctgtccatcattttccaaaatggttttaccaggtgtgtgactatatattagtcaaaatctttctgttcattttctcctctgatctgtttttttttctttttttttgtacttactgtcttccattctataagtaattctttgtcattttaatcccacccctactctaattttcactccagttatcagcaaaattggccattgtttaaatctgccattgtacaagtttcccacatgggtgtggatgacctttttgaatttagttttcatgcaaatattttattaaaaaacaactcagatagttccagtggctcatgcctataatcccagcactttgggagtctgagcaggaggattgcttgagtccaggagttcaagaccaacctgagcaacatagtgagaccctcatctctacaaaaaacttaatgattcgctgggcgtggtagcgtgcacctatggtcccagctactcaggaggctgaggtgggaggattgcttgagccctgggagctggaggctacagtgggccatgatatcaccactgcactgccgcctgggaaacagaacaagactctgtctcagaaaacaaacaaaccaaagaaaactgtttgttttaggctcctccgttaaagggttggttaatctaggcccatttagtgaattattttattttctttcctgccttttctagatcccctctagatgagagtctctttaaactagatcctttttaaagtttaatattcttagtgtataaagtaagaaagattaattaataacccatttatgcctagtggtccattattggaatgctaagcttgtgggagttattcatatcctactgctcaaggtcatcgctaaggtctgattttttacaaaaaaaatttgcaacctccggcataaatgggttaatatttaattcttttttttttttggagatggaatctcaccctgtcacccaggctggagtgcagcagtgcaatctcagctcactgcaacctccgccttccaggttcaagcgattctcctgcctcagcctcccaggtagctgggattgaaggcatgtgctgccacacccagctaatttttgtatttttagtagagatggggttttatcatgttggctaggctggtcttgaactcctggcctcaagaaatccacccacctcaccctcccaaagtgctgggattataggcgtgagccaccgcacctggcctgaattattaatttaagaataagtcatgtttgaatttgatagcctggttatatatcttttactaaatatgccctgacaattcaaaggaaaggttttgtgatagaatattaaacatatttcagtttattaatttattttaggtcattctttatatttctccctactatttgtatgtgtgtatccctcccttctctctcacttgagaagaaactatgacaaaacccaaaataagagacagccatagtaattgtctgaatattaactgctgtatttcattaccatgtcttattatcttttctgctccttgggcttcctagtttgttaatgttatttctggtacaattgttgaaatatgtgatgtaagcttttgactttggcttttctggaattttggt

SEQ ID NO: 15603 - DNA, 7517 bp, Human
aaagaaaattgagagcagggacaccattctcttccagctggagctctctcagtgccccgtttccctggagcagccacctgtctgtgcctgtggctccggtattaccaacaccccacacttctccccccatcccctggctgccttaaccccaccttcctgatttcaggccacatccccggctcctcccttccaagctgaaggccccataaacttgatgagaaagccagcctgccttggcccagctaggagtggcacagacacaaccccacccccgcattctgcaaaccctgaacaagtgcctggccttggggcaggcgtcccccaagctctggagagtttcccgtgaatttatttccatcaaaataaaaaaacaacctaagcagtgattttaaaaaccagtggtacccccaccccacctcccccatttccagtggttggaaagcctgagcaacagaaaaaccagaagccagccttggagaagcctaaataccatcaaggaatggtctaggccaagtatgaccctcctatcctagaggcaaggggcagagaggtttgggaaaagggcaggccctggaaaccaggccccaacacgagggtactgggtaagggaagagaggctagttaccccgtatcctaggtcccctttaatcaacggataccagatctcatccatcctcctccctgcaccaagcttcccccatatcagctgctctggctctggcacggctggggtttggttcagtgtgggttctggtttctccttccacccctcatcacagacaatatcctgtgccaggcagcttggagctcaccctgaggccagagctgtgaccctgcctgctcaccctcccctttccacaggaatccggacatcgtggctggcaagtgggcacacagaaatctggcgggctggggcgggactgcccacagaacttagggtctggcagccagagccgtccagggctggtccctcgacctgccccaccccctcccgcacccctcctcacagtcctggggccaccgcccgaatgtggcatctgccaagtacacctcggcgccactcagccgccaccctgagacccctcaggggcgggtcctgaccactagggttggggatgagggatggagatatttcggggcgatgaaggaggggggatggtgcgactgtgcttgtggcctgtggtttccaggtgtgtttgccattcctgtgggccactctcccccacttcccacttctctgcttagccttcagcggtggaaaaaggggatgagggcgccggcgacagaaacgcaagcggggttggaagagaggggtgggggcgcgcccgagggtggggaaggagctcgggtctacccagggccagcttcggcgcgtcgagtccgaagtgggagaccgacgccggggcggctctcacgctcggcaggcgccgcacaagcgcccctttaaagcgcaggcagctggcccaccgcagggagacgcatccagctgtccggccccgcttcctcccgcctcgcatccagggcacccggccgagcgtgtgtggatggcgcggcgtggaggctcaaacctgagcaaacaaataagttgagggaacgcctccctctctccgatgtaaactcggggctccagacataactattcccccttcccagaaaagccccgggaaaggcggtaggcagaggagcaccataggagagcggggggctacagccggggctcagggctcggggctcgggggccacggtcccaccccctcatgcacggtagccggctgggggaacggccccgcccccttccccgtggagggcgggggcgcatctctgggcgcgagcgagttaagcccagtggcctcgatgctccacgtaggagctggctcggctgccggctgcggtcagggccaccgtataaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtgctgcgcgcaggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcaggcgccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaaggtgagctcctggctgtgggctctgccctggttccttcttcccttcctggaggccccaggagccagggccacagctggcaccatcccccgtccccaggttccctgtccctctggctatctccaaggtgagcagctctgccacctcccttcctcgccttgtcacatccctaccctaatccctgtctgctgccagtctcgaccactgccctcctaggattcttacatataaaaggagtgggactgccctggccccacaaaaggccccctagggccatctccagtgcttccaaacccccaactgtgagcagcagccacctcttcctgttgggccttccacccctcctctgctgtttttcccgtctccagtaaacctaccaccccataaaggaaggtttgtttattgaggagccttccagaggagctgggcagatcaggcccacaaagagaccctgttcctggtgggggctgtgcatgtgtgctaagggggagtgggggactggggagtgaggggaagcaaatgcctgaggaagacattctccatgccccatagaggccctggtggatggccctgcccaatccacacagacacaattcactgcattctcaagtccattgcagctcagtaggcgtgggaccaagggctcccccaggatgcaagcatcgtgcccatgggctccgtgaaggggcaaaggcaagaccactattgtcaatccttggcccaagaccccaggtgtctctccacagagaagactggcgtgactcactgtctccagactgctaactgccctttgccctcctccgtcactagacccatctcctgtctgcatcctcactcattcctttctcccctggggtgcccagtgtctggccaggtggggctaccttggatcagagcagaatcccttctctgggactggaaaaatcaccctggtacaggggcttcagccaggaggtttgggtggggaaccaacaaggtagaggagagtctggttactggagaccttcatacctcaatgtgggccacaggaaagggtgcgggtgtggagatgtgggcagaatctcacttgggcagcagccaacctttgtctgggtggaaggagcctgctcaagcctgcccttcttcagccctgcctctccccagctgaagttggagtcccctgtggcccaccagtgccagagtggtctttcagtgggcagcagagcagcgaattaggggctggtttggggcaggggaggccagacaggaattgtggcgcctgggcaaaggtgtgggcaccaatagaacatttcctctggagccgtccaacctggccaaaggctccaccaaggtggcttcacaaatagcgtctggctggcagtgggggagcagtgaggacagagctgagggaagtcctgggaccctgggactgtggggagcctgggcccactgcccactccaccaagcacagaccaagttcaccgtgtaccagtttggattgctggggccaaactctggcagccccacagtcccagtgtttgtgcagggattgtggtgccaggggaagaggagctgggtgtggtcctgtggctactgtttacccactgctgtgacccagggcaaaggactgcgctttttccgtttccccatttgcatattgaaaataacaccacctggctgggcgtggtggctcacgcctgtaatcccagcactttgggaggctgaggcgggtagatcacgaggtcaggagatcgagaccatcctggctaacatggtgaaactgcgtctctactaaaaaaatacaaaaaaattagccgggcatggtggcgggcacttgtagtcccagctactcaggaggctgaggccggagaatggcgtgaacccgggaggcggagcttgcagtgagctgagatcgtgccactgtgctccagcctgggcaacacagtgagactccatctcaaaaaaaaaaaaaggaaaaaaaaaaaaaaaagaaaataacaccatctgtctcaaagggggttgtgtagattggattatctgagatcacttggtcatactgctttgaaaactgggaaactcctcaaagtgctatggctcaggttcagggaaggatcctgcccctctggcactcgggtgcttactcattcactcatgaccaccttgctcccaccttgctcccaccttgctccccagttctcagatggtgccttcctgggtgtaaccacgctgaaacacgtccatttggagaacaaccgcttgaaccagctaccctccaacttccccttcgacagcctggagaccctcgcccttaccaataacccctggaagtgtacctgccagctccggggccttcggcggtaagaacacttccatgtcactcccagagcccaccctcatgtgatagaggcacattagccctgcactaagacatgttggacatgcatcctagatctgctacctaataagcatgggaccctgggagcctcagtttccccatttgtaaaatgaagatgacagcttcagactatcctgtggccaagtcaatcctggccccatagttcactgcccttccccccagcactcccaccttcttccccagccccagcaagtttctgtctctccaggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggtgggggccaggtaaacaggtcccctatgtccctctttggtgattccagcaagtgagctggtatcttccaggataccccctggccctggagggtcaggcagaccctccatttttacagagagaggaggggacgactgggtcccctgttgaagggaggaaaaggtcctgcccaggacttccaccattttcttcaagcatcatctgtgttgttggagtactgacatcgatctttgcctctttgcaggttctgacccagccagtcctggtgactggcctctgccttccaccggagagactactgaccttctcacctccacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccaagtcaatcagaaccacaacaggttggtcatcaggatggccaccctcccaggatcatccttcctctgttcctctttccctgccacgtggaaacaatcatcagatccttgccccaccccttgcttccagaaagggttttaaagcccatgccccaactctgccagcccccacctgccaggacgttctagcaggacatcggtgctttgctgtccatcttcccatgctgcaatttcttcctgagatttctataaatataaatgtatgtatgtattatatttactcccctgccacctatctccttcacccaccaggtgctgatgaggtcagactatcttttctcacatctgctttctggaaggagggctggctgagagggtctcctttgaacatctggcctggactcatccccatgtctgtccatctgctgtcatcccaggcctggcctgcccacagcccgggccgcagtcaccactcaccaccaggtccttcatatttatcttgttgatgatggctcggatcaactctggaggtgcaggggacccagcaatgacacctgaatcagagagagggctgacacagctccccaattctccaggcccagtggagtcctttcacctacagctcattcaggggaggaacattcccttttctcctctgaccccgagcctttcctacacctggcagctggccctgggctggtgtccagggacactggggatctccctccctcccacccacatttttacagcgtccttcttgccccctatataaaagactgggagcatagctaactcacccgggccattcctgtgggggaagcagccccctccccaagcctggctgcccttggccccaccccacctccacacatggtcgagatgtcataactggagaagtctggctggttcagaatgtccacgaacatcgtgggggtaccatacaggaaggtgcctctgtataggaggaggtctcgaaattaggcttggaagtggaagggaactccctgttctcacccaccccgccatgaaactgcagcaaagggaataggcaggagaagctcctgaggcaggaactggtcctctcctgggggtcctccactgtccccatcctcagtctcctggctggagggaggaggcagcttggaaaggtgtcagggcccaggagtgaggaagaagagggttttatcagcccacaagtagcctgtccaccagtgcccacctctctctgctgatggcctccagtgccttcttgccattgaagatgggagaggccaggatgagggtggcaccgtacatcagacacatcattgtgcctgccacggaacccaggcaatggtacagggggttgggcaggatcatccgcaactgctctggtgtctggtgatggagacaggaggctgggtctgtcttggagccagacgccagttcctctctagctggcaaggggagcccagccagccccccacccctgcctg

SEQ ID NO: 15604 - DNA, 44608 bp, Human
ggatggtcttgaattcctagcctcaagatatctgctcaccttggcttcactactgggattacaagtttgagccactgcacccggcctcaacaaaaacaaaaattttaattacctcaccctatgcatctcttcatttgtatcctttgtaatatcctttatattaataataaaccagtaaatgtaaataaataaataaatactgtttgtctcttcccagcagattgtaagcctgattagggcagggatcatatctgttttattcacatcataagcactgtgtaacctctggtttcttttctctttgagatggagtttcactctgtggcccaggctggagtacagtggcgccatctcagctcactgcaacctctgcctcaagcaattcaagtgatcctcctgcctcagcctccccagtattttgtatttttagtagagatggggtttcggcatgttggccaggctggtcttgaactcctgacgtcaggtgatctgcctgccttggcctcccaaagtgctgagattacaggcattagccaccgcggcctggccaataggcactatgtaactattagtttaatgaatgaagaaatgaatgcttgtgggcatcattcattctgcaacaaacttctaaaaattaattttactttgaaacaatttcatactttcagaggagttacaagaataatacaaagaagttcacccagatatctcattcagggttagccaattgtccacaaaatatactttagagagcaagaggattaattccagggtctcttgagcaacaaatatttattgagcgcctgctactattggattacataacagtctcttaactggtctcttagctataggcattgcacccccacccctagtcccatacagcagctccttttactaatttatttttgaggaggatctcgctctgtcgcccaagctggagtgcagtgccgcgatctcagctcactgcaacctccgcctcccaactcaagcggttctcctgcctcagcctccagagtagctgggaccacaagcacgcactaccgcgccaggctaattttggtactttttgtagctacagatagaatagagatctttgtctattttgttcacgaagtactgcaagcgccttgagctgtacctggcacatctttgttgctcagcaaagagtggttggataaacgaacgctgaaggtatgctagtaccaggtactgttctcggtgctggagttacagcaaaaaactccctgccctcgtgggattctcactggaagcatgcttaagcttaagccatttttcaatcttgaccccaccattttgttccctgtgagatttggggtgaactgcagtttcctagcctcactttcctatcaatcgttacgaagattaaaaggaaaaatatcatttgtatcgcatttagcatcagaaatgctttaataatattcgtttcccttcctttcaggctggaagactggggcctgacatctctgccacaggcttaggcgaggttttcacagggacttggaaaggtgcaaacggttactacggccaggcttacccaattgttaagtgaagatattctggagagtgcttaaaagggttggaaaaacaaaccagtgagtggctaggaccacctactccgctgttttgcctcggaaaagcctcgccggctgccgggaggtgaaagtctggaggaacgggaggaaaagagaggggtggctgtccacaacagaaaactacacatcccagcacccccgcggcagacgactacgggtcccagcaggtttcgcggggtggaccgaagcgggctctcttggggcctgcagtcggggttcagccagagggggcgccgggcgtaccgacgtagcggggagaaacgggtcgcgctttaacggcgctgcgcaggcgccactcacgggccggacgtgacgcagggaaagttccggcttcggcctccgccgctgccgccgccgctgctacagccgccgccgccgctgttgccgcggcttgttattcttaaaatggcgccgctagacctggacaagtatgtggaaatagcgcggctgtgcaagtacctgccagagaacgacctgaaggtgagccctatttgcgggctcgccccttccggctgtggggcgcccgccggccggcccttcctttctccaggacccccgccgggtatccagtccagtcgcggtggagggcctcccccattgccagtcgacccggtcctacccggcgtcacgccgagggtctcgcgagccgagtcgtcgaatgctgtcccggttgcctcagtggggatcccgagggatgtcgcggcctctgtcccagggtcgccccttctggccttcgggctgccccaggacccgcagctgtaacagctttatttagaaggctcggctccccaccccatccctgggtctcccgcagtcggagccgagcccccgcggcagtgccctcgggatggggtcgcctccaccggaggtgacaggagcgcggagtggccggcgtctgacaggagatgccaccggctaccggaacgcggcctcagtgtgtttaggtctctgaggaaggggaaggcggtgggcccgagtggtttggtactggcgggagcgaacgtcaggtcgtccctcttcattgccactcctccaaattgctttttaggatcgtcggttttgctaattcagaggtgaatcccgtttctgagtatgttgttgagcttactgaagtggataaagtagttggttctcaataaatacaaatactttctccttaaccccttcttaactcagtatttcattttcttcgttttctaaaggaggtgagttccttgttactcctgagtccaagtaagagtaaatgtatgtatgggtaaaggaatgactttggtatactgcttttcttttttaaaactttttaattattattattattattattattattgtttttaactgagatagagtctcactctgtcacccaggctggagtgcagcggtgcgatcttggctcactgcaacctccacttcccgggttcaagcgattctcctgcctcagcctcccgactaggtggaattacaggcgcccgtcacgacgcccggctgttttgtatttttagtagagacggggtttcgccatgttggccaggctggtcttgaactcctgacctcaagtgatccgcccgcttcggcctaccaaagtgctggtattacaggcgtgagccaccgcgccggcctaggtatactgcttctttgaaaagtgtttctatgcatttgctgaaatcagagcttaggtttctagcagtgcttatcagctcgtgctagtatttaaccgactcagtgtattctttttttttgagacggagtctcgctctgtcgcccaggccggagtgcggtggcaccatctcggctcactgcaacctccgcctcccgggttcacgccattctcctgcctcagtctcccgagtagctgggactacaggtgcccgccaccacgcctggctaattttttgtatttttagtagagacggggtttcaccgtgttagccaggatggtctcgatctcctgaactcgtgatccgcccgcctcggcctcccaaagtgctgggattacaggcgtaagccaccgtgcccagccccgactcagtgtattcttaaggaaatatattactgtgggttttgttttatttcttctttgtacagtaagttgatacttaacatcagtcaacaagtatgcataatatttgaggccacacgtgctgttgtgaatgtgactgaattgtacttacctgttaattttatgtggcatatgataggggagtcattcttgtgcattttcccgtttttaatagaataatttcaaataaggacagccttcgttagtagtaatgtagcatttgtgctcatctgagtccttcagacattccttttgtggcttctttctgctatgtggtttttttaagggaataagaatacaactagcattgggacccaattcatggaaaactaaccagacctcttagtagcattattaatcccataggtgaggttgactattgcatgtcagtgaattgacatggaattttttcttcttatttatcatgcataaagcttttttgaactttgtgtttatgatgaataaaatgttgctttttatgaaaatgtgtctagggcacagtggcgtaatctcagtacttggggaggctgaggtgggcagatcatttgagatcaggagtttgagaccagactgaccgacttggtgaaaccccctctctactaaaaacacagaaattagccgagcatggtggtaggtgcctgtaatcccagtttacttacttgggaggctgaggcagggagaatggcttgaacccgggagaattgcttgcagtgagccgggatcacaccactgtactccagcctgggagacagagcaagactctgtctcaaaaaaaaagaaaaggaaattgggcactgaaatgatttgaaagataatctggccaggtgcagtggctcacgcctgtaatcccagcactttgggtggctgaggcaggtggatcacttgaggtcaggagctcgagaccagcctggccaacatggtgaaaccccgtctgtactaaaaatacaaaaataaactggaggtggtggcaggtgcttggaatcccagctacttgggaggctgaggcaggagaatcgcttgaaccagggaggcggaggttgcagtgagccaagattgcgccactgcagtccagcctgggtgacagagggagactccgtctcaccaaaaaaaaaaaaaaaaaaaaaaagaaagaaaaatctgttggacttctttgtacctcttagtttgataaacattagatttccttcttaccttaaggaagtacaatttttagaccattttatttcttgttgaaacatagctgcattgtacttgacttgtatttgtttctttttttttcttaaaaaaatttttaatcttttttttggtgggggagcggggacatggtctcactctcacccatgctgtagtgtggtggcacaatcatggctcattgcagcctcgacctcctgggctcaggcagtcctcccaccttagcctcctgagaagctgggaccacaggcacatgcccccatgaccagctaatttttatttatttttttggtagagacagggtcttgctatgttacccaggccagtcttgaactcctgggctcaagcgatcctcccaccttggcttcccaaaatgctgggataacaggcatgagccactatacttggcctgtatccatttcttaataaacttaaaaatatatgttttgggcaaccaagacaaaagtattctgaatttttctttataggtagagacttttttttctgtcttggaaatgcttttatcagattaatttgttgtgttgctcatctctggtgtatttaaagaaatttaatttttttctgtttcttggcatgaagtgcaacctaaaattaggccaagaaagtatgccaggagtactttttctgaggctgtaaaggcaaaataaaacattctattaagaaaagtaatcattgaggccacttaatgagcaagatggaaaagatttgttctgtagaaaagaagacagaaatttacttgtgttttaaattgattagaagataaaatactaaatgcatacgatgttccagatttaatcacaatttctgtttcgctaagttggaaatggtcacatcactagtactggatcaaatctacataactgtttttgtttgtttgttcgctcttgttgctcagggtggagtgcaatggcgtgagcttggctcactgcaacctctgcctcccgggttcaagcgattctcctgcctcagccttcctgagtagctgtgattacaggcatgtgccaccacgcccagttaattttgtatttttagtagagaccaggtttccccatgttgttcaggctggtctcgaactcctcacctcagatgatgcacccacctcggcctcccaaagtgctgggattataggtgtgagcctggcctgttagtttgtttttttgagacggagtcttgctctgttgcccaggctagagtgcaggtgcacgttctcagctcactgcaacctccgcctcccggattcaagcgattctcctgcctcagcctcctgagtagctgggattacaggcacccaccaccactcctggctaatttttgtatttttagtagagatggggtttcaccatgttggccaggctggtctcaaactcctgacctcaggtgatccacccttctcagcctcccaaagtgctgggattacaggcgtgagccaccatgcctggcatacataacagttttgaaggaataagaatgacatatgtgggccgggaggctgaggcaggagaattgcttgagcctgggagatggaggttgcagtgagccgagatcatgccactgcactccagcctggccaacagagcgagaccctgtctcaaaaaaaaaaaaaaatgacatatgtgaaagtaaatggaccacagtgtaacctttcttataaagagctcatgtgattttatccacaagaaagatttcagagagattaataaaagatacagattccatacctggctaaatggaagaattaatgataaaggcaggtttactgaatacttatatttaagtattaatatttttggggagcaggggttctataacttggaggttgtctaatctcttggacagttcttaagggtgacatgtttacctgaggttttttttttttttttttttttgagactgaatctaactctattgcccaggctggagtacagtggtaccatctcagctcactgcagtctccacctcctgggttcaagcagttctgcctcagctgggattacaggtgcgcactaccacacccagctaatttttgtatatatatattttttggtagagatggggtttcaccatgttggccaggctggtctcgaacttctggcctcaggtgatccgcccacctcggcctcccaaagtgttgggattacagatgtgagccactgtgtttggccattccttatttgtgttttccacaattttagaacactgccctgtatgtgataatcagtaaaggtttattgactcaaactgtttactgctttatgacaaatacttgtttcttcttcttctttttttttttttctttgaggtagggtctcagtctgctgcccagggtggagtgcagtggtgcagttgtagcttgctgcaacctcaaactcctgggctcaattgatccttctgcctcagcctcaaaagtagctgggagtacaggtgtgcaatagtgtgcccagctgattaattattatttttatttttgagatggagtctcactctgtcaccaggctggagtgtaatggcgcgatctcggctcactgcaacctctgcctcctgggttcaaacaattctcctgcctcagcctcccaagtagctgggactacagatgcatgccaccatgcctggctagttttttggtatttttggtaaagatggggtttcactgtgtttgccaggatggtctcaatctcctgacctcgtgatccacccgccttggcctcccaaagtgcagggattataggcgttagccaccgcgcctggcaaaaaaaaaatttttttaagggatagcgtcttgctatgctgtccaggctggtcccaaatgcttcaggtgattctcctgccttggcctcccaaaatgctgagattataggtgtgagccactgtgcccagccaacaaacacttatttacatggttccttgtgttgagtactgttccctgtgggtgccaggggcagaattggatacttgtgtctgcctttgaggggctttcaatatagtaagggaggtaaggaggtaaacaaagactgtaatagaggctgaccagggtgttggcaaacagaagaagcagtatgtaactttagagtcagagatgatttcataaaggagcagttacgaggggcagagttcaggtagacaaaatgagaaggaaagaacatgcaaacagaataaacaccatgtgcaatagtataatgtaatttgcaagaacatggctggttcggggaacttgaagtggtttggtatggctggaggtggtactggaaagaaagatgccaaatcatagaagagtaggctgttaaacttagattgttattttttaggtggtgcatgaacactatgaaatgtttttatattttagggaaaaatcatactgtgattcgtgatactgtttaaaatgtagctaactaaaaataaaagtagattcaaagaaaattattacagggatacactgttgtatgtggtaggaatatgacaaaataatgaaaatggtatttggtgtttgggaaacactgccataaatggaggaatacgcttgaggagtttttaagaaggagaatgacagtaggcttttgaaatgtttattctggcagcattgtggaccatggattggaatgcaggaaaaatgtcatagaagcagtaggcccggtgatatgagagtctgagataaggcaatgataagtgattgttgtgttggaaaggaaatgaagaaggtatagtggcacctgttaacagatttggtctaggttatgatgaagagagtttagcataattttttagtttctggcaaggattacttagtactataactagattaaggaatacgggaagtttggtttgggccatattgagtttgagatgctgccaagctaagacattgagatagaggtgtccagaattactcttggatacttatgttacttagataacaactacttgttgattgccaaatgtgctctaaacactgttctaatagtattaaacgcaggagaaagatctagaccagtcgttctcaactgggggcaattttgccccccaaagaatttttggcagtgtctggagacatttttggttgtcacagctgggtcaggggaggggtgggaagttactatgggtatctagtaggcgtagatgtcggagattttgctaaacatccacaagacagcaagcagtcccctgcaatgaataattagtagtgccatggttgagaaactctgatctggcctgaggatacagatactaccttctggatcataagcgtgtgaatatcatggtcattccagatttctaacttctcattcccagtgatctgtattatagtagagactttatataaagactgtgtgaaatataatgttagctagatatttatttagttagttacttagctagctagttgagatgaggttttgctatgttgcccaagctagtcttgagctctgggcctccagccatcttcttgccttggcctcccaaaatgctcattttacaggtgtgagccaccacacctggcagtgagatctttttttttaaagctaagagtgttttataaataccagtatgtaaaagtagataaaggaagtagtatgttttagataacaagatcaactaaacaagtaattttaaaagtttagaacccagtgtttgtgagggcaagagggaactgggagacagaacagagaatagaatggaactgtgaacaaatgtcttgaggaaaaggtagagaagagacatagaggtctgctaagaatgatggctatgaaccccttcctgttcaaggattagaaagtagttgggcaccaaacatatgaaaaagagcactggtcattaaagaaatgcaaatcaaaaccgcaatgagataccatctcacgccagttagaatggcaatcattaaaaagttaggaaacaacaggtgctggagacgatttggagaaataggaacacttttacactgttggtgggagtgcaaattagttcaactgttgtggaagacagtgtagcgattcctcaaggatctagaactagaaatgccatttggcccagcaatcccattactgggtatatacccaaaggattataaatcattctactataaagatgcatgcacttgcatgtttactgcagcactattcacaatagcaaagacttggaactagctcaaatgcccatcgatgatagactggttaaagaaaatgtggcacatatacaccatggaatactttgcagggacatggatgaagctggaaaccatcattctcagcaaactaacacaggaacagaaaacgaaacaccgcatgttctcactcgtaagcgggagttgaacaatgagaacatatgggcagaggggaggggaacatcacatgctggggcctgtcagggggtccggggtaaagggagggatatcattaggagaaataccgattgtagatgatgggttgatgggtgcaggaaaccaccatggcacgtggatacctaagtaacaaacctgcacgttctgcacatgtgtcccagaacttaagtataataaaaaataaataaatagaaaacagaacacaaaaaaagaaagaaaaaatatttgggcacgatgaggagaaaggggtatagtttaccctaaatttgggataaagctgtaaagggtttgggaggagaggagcatgtgtctttactatgatgacaaggcagggctctttgaggccgctgtgagtgtagttgattgagtcacgtagcgtttatagtgagattgcatagacttcttatttttgtgtgcgcgtgatagcgatttgtaagctactgccaaactagagatgagaggcaatagctttggcttagagacatagctctctaaatcctcagttggggtcagcagaggtggcagtcgtaggacgcagctgtaattttactctagttagtgtgcctgggccctggttgaaggctgctgctaggtagtttacacgtgttctccagacactcaatctttcagattgacagagtttcacagcgatgttcttcagtttatagtccactgttattttcaggctagcacatagtgtatggggtgataaccagggatgacttcaagtttaggaggccttatggactaggagaaccagttacatgtcagcgaaaattctggcacattgaaatatgggaaccggccagacacagtggctcacgcctgtaaccccagcactttgggaggctaaggtgggtgtatcacctgaggtcaggagtttgagaccagcctggccaacatggcgaaaccctgtctctactaaaaatacaaaaattaaccaggcatggtggcgtgtgccgtaatcccagctactggggggctgaggcaggagaatcgcttgaacctgggaggcggagggtgtagtgagccaagatcacgccattgcactgcagcctgggtgacaagagcgaaactccatctcaaaaaaagaaaaaattacaggccaaacttagaatcattcatcagttcctggcatatttgttctttaatgcaaataggttgcaaactttggatgctaattattataaaaataaatatgtatcataggtctaatggattattaatagaagtaggatgctgtgcaacactgatattttgaaattgactggaaagacagccgtctatccacaaggactaactggattgagtggttgtggtcaaggttgtgattattattatttatgaggtaatacatagggctgtggggtgttggtatggggatgaggggagtgactgctaatgtgtatatggtttctttttggggtgatgaaagtgtcctaaaattgattatggtgatggttgccaccactgtgaatataatgaaaaccattgactcttacccttcaaagggatgcattttatgtaggtgaattatgttgcaatagttgttttaaaaaattatattcgggctgggtgtgatgctcacacttgtaatcctagcactttgggaggctgaggcgggtggatcacctgaggtcaggagctcgagaccagcctggccaacgtggtgaaaccccatctctactaaaaatataaaaattagctgggtgtggtggcaggtgcctgtaatcccagatacttgggaggctgaggcaggagaatcgcttgaatctgggaggtggaggttgcagtgagccaatatcacgccattgcactccagcctgaacgacaaagcaagactttgtttccaaaaaaaaaaaaaaaaagagagagagaaaaggaaagctggatgaagagagatagccaagcccatgtctagggaaaagcattcttgactgagtgaacagaaagtacaaagcctcagaggagggagcatgcctaggtagccacccagacctggtgaggctggtgtgtggggcagcctccatggagaggagttagaacaaaactctgtctaataaataaaaataaaaaattatattcatagttccccaccctccaaaccaaacctaaacaaatcaaaacaatctgctcttgaaagaaatagttgataagccagacttcattaaaattaaaagcttttgctttgtgaaagaccctatcaagagaatgagatgatgatccatgtactgggagaaaatatttgtgaaagacgtgtctgataaagtattgttatccaaaatatgcagataattcttttttttttgagatggagtttcgctcttgttgcttaggctggagtgcagtggcgcgatctcagctcaccgcaacctctgcctcccgcattcaagcaattctcctgcctctgcctttcgagtagctgggattataggcatgcgccaccacacccggctaattttgtattttttagtagagatggggtttctctgcgttggtcatgctggtctcgaactcctgacctcaggtgatctgacctcctcggcctcccaaagtgctgggattacagacgtgagccaccatgcctggcctgcagataactcttaaaactcaataagaaaatgaacaatctgattaaaaaatggacaaaagttgctgtcagatcatgccagtttttcagaatggttgtgctaaattacactttcaccaccagtagaaactgtctagaagaagctggctgcaggagggctaagggatttattgggcctcagtgaagcttggtgatacgtgggtggctttgcagaaatgtttcctttgttggtgcattattacaaagattcaaatggggatttgctgcatttgtggtagctgtaggagctgaatattacttggagtcccagaataaagataaacatcactgaagataatacctggaagtatcatagtggtttcttaactaagatttcctcactgtagcctacttgcctggtttgtcccttaaagaatattagtaagatataataaagtaaatacagatatgccaaaaaaatggacaaaagacacctcatcaaagaagatacagtgatgacaaataagcgtatgaaaagatgctctaccttccgtgtcattagggaaatgcaaagtgaaacaaccatgagataaccactatatacctattagaatggccaaaatccagaacaccaacagtaccaaatgctgatgaagatgtggagcaacaggaactctcattcattgctggtgggaatgcaaaatggtacagccactttggaagacggtttggcagtttcttataaaactaaacaaactcttcatataatccagcagtcctgctccttgatatttacccaaatgagttgtaaacttatgtccatacaaaaacctgtacatagatttttatagccactttattcataattgccaaaacttggaaggaaccaagatgtccttcactaggtggatggataaacaaactgtaatacacccagacaatgaaatattatgcagtgctaagaagaaatgagctatcaagccataaaaagacatggaagaaccttaaatacatattactaaatgaaagaaaccaacctgaaaaggctacatatatatgattccaactatatgacattttgggaaaggcaaaactatagagacagtaaaaagatcagtggttttcagaggttggagggaggtgaatttgaataggtgaaactattctgtatgatactataatggtaggtacatgtcattatacaattgtcaaaacttatagaatgtgcagtaggagtgaccctaatttaaacaaactatggcctttggatgataatgatatgtcagtgtatgctcatcatctgtaacaaacgtaccactcaagtgtgagatgttgatgcggggaggctgtggggaggggcagggggtatatgggaactctgcacttttttctttttttctttttctttttttccctttatatggagaacgaggtctctctatattgctgagggcggtcttgaactcctgggctcaagcgatcctcctgtctttgcctccctaagtggtgggattacaggcgcgagccactgtgcccagcaggggaactctgtactttaagattttttttgtttgttttgagacagagtcttgctgtcaccccaggctggagtgcagtggcgccatctctgctcactgcaagttcggcctcccgggttcacgccattctcctgcctcagcctttcaagtagctgagactacaggcgcccgccaccacgcccggctaattttttgtatttttagtagagatggggtttcattgtgttagccaggatggtctcactctcctgacctcgtgatccgcctgcctcgaccccccaaagtgctgggattacaggcgtgagccaccgcgcccggccgggaattctctgtacttttctgctcaattttgctgtgaagctaaaactgctctaaaaaatagtctatttacaggggtaaaaaaacacaataaaaaaatctactttccctggagttgtaactgtctcagtaatgattatttccagccttctaattgtttaagccagaaatcccgcgtcatccttgattctttactttctcttaacaccctgtatccagctggtcataaatctagcagatgctacattcagataacatctggaatctattttccctattttctacttctactaccctgtccaagccagttaacttttacctagattattatagaagacacttaactgatctccctgcttactcctttgtcccaattccaaccccagcccagccacccctccaccaccatcaatccattttctcttttcttgttattttgagaaagggtctcgctctgtgacccaggctggagtgcagtggcacagtctcacctcactgcagctttgacctcccgggctcaagcgatccttgcacctcagccttccaagtatctgggacttcaggcacatgccaccacgcccagctagtttttgtattttttgtagagactgggttttgccattgttgcccaggcaggtctcgaactcctgagctcaagtgatacgctcacctcggcctcccaaagtgctgggatgataggtgtgagccaccacgcctggccagtttgttttcaaaacagctgacttaatatcatgtcagtcttctgctctagaacttctaatggcttcccgttacactcagtagaagcccaggtccttattttcaccaccagtgacctaaataattctgtgatgctctcctgtttttcttctcattcagtttactctaaacacaccagccttgatgatgtttcttagacacaagcatgcttcacatcaggacttttggtctttatttctctgcctgtagtattgtgtccccatagccttacctcctttagagttttgctcaaaattcactttatcagtaaggcttccatactctccctgtttaaaataacagcacctactctccaccccagcaccccatccctcttctagtgtgtctgtttgctctatacttccttgatattactatgtgacaaattactgttatatattttacttatttattgtctgtctcattctattagaatgtaagccccttgagagcagagcttttagtctgttttggttgttgctatttactttgtatctagaacaatacctggtaacataccaggcactccataaatatttgttgcattgaacaactaaatattcaatataatgtagtggaaagtggtaggaaacttggattctagatctgttgctaagattaagtaacatcttttattatctaagtcaagtgagaaatttggtgtaggtaatttctttttttttttttttttttgagacggagtctcgctgtgtcgaccaggctggagtgcagtggtgcgatctctgctcactgcaagctccgcctcccgggttcatgccattctcctgcctcagcctccctagtagctgggactacaggcgcctgccaccatgccccgctaatttttttgtatttttttttagtagagacggggtttcactgtgttagccaggatggtctcgatctcctgacctcgtgatccacccgcctcggcctcccaaagtgctgggattacaggcgtgagccaccgcgcccggccggcgtaggtaatttctaatgcaaaccagaattttataattctgatggaaccttcgagaacatctttcagtataaagtttaaggctcaaagttcagaaacattgtttcactcaccagcatctattttttgcttttgtttttgtttttttttgaaacagagtctcactctgtcacccaggctggagtgcaatggcgtgatcttggctcactgcaaactctgctcctgggttcaagcaattctcctgcctcagcctcccaagtacaggattaccagcgccctgccaccacgcccagctaagtatttgtatttttagtagagatgaggtttcaccatgttggccaggctgatcttgaactcctgacctcaggtgatccacctgcctcggcctcccaaagtgctgggattacagatgtgagccacacacctggcctgtttttcttttttttagataggttctcactctgtcgcccagactggagtgcagtggcgcgatctcggcacactgcaacctctgcctccaaggctcaagcgattctcctgtctcaacctcccaagtagctgagattacaggtacgtgcctctactgaccagcttatttttgtattttttagtatagacagggttttgctatgttggctaggctggtctcgaactcctgacctcaaatgatccacctgcctgagcctcctaaagtgctggaattataggtgtgagccaccacggctggcctgtttttgttattttttttaatgagtgatggatgtactatatggcaggaccatggattgatttgttgaagcatataggtgtggaaaattcaacacaaacaggagctagctacccagggactcaaggccagaaggattccaggccaaaaagaagatcttgcctttgaggtgctattttaagatcaggaacttaccctaggaatgaaggcaaatcattttattttgaagttttctgattttttgtataatgtttaggaaattaacaactctatttcccctcattgtcttttgggagcccttttttcccccctcccactcccattgagttctgttcttgctactgtgtagctattgttgtagctgtaactgttaaagtgtttctcatatattaatgagattatagcatttagattccttaattaatgtttaagtgatttcattatgcttgttagtttaatttctcctttcttggcagacctatcgtaaaatccaataagcctttggcaatagtacaaactggtctcaggtaggaaggaaggttccacctgagacctccagttccctgtatatagcagggatgtatacttccttttccagaacgttggtgtgagaatcatatgctttctatgacattttttggtttgattactttcagtggacaaatatttttgaagtgcaaacatttagagttcctttaacaaaaagaatggcttggctgggtgcggtggctcacgcctgtaatcccagcactttgggaggccgaggcgggtggatcatgaggtcaggagagcgagaccatcctggccaacatggtgaaaccttgtctctactaaaaatccaaaaatgagctgggtatgatgactcatgcctgtaatcccagctactcgggaggctgaggcaggagaatggcttgaacctgggaggcagagattgcagtgagctgagattgcgccactgcactccagcctggcaacagagcgagattctgtctcaaaaaaataaaattaaaaaaggctcatcttttttgttgttgttgttgtttgtttgttttgagaaagagtctcaccctgtttcccaagctggagtgcagtggcgcgacctcggttttcggcaacctctgtctcctgggttcaagcgattctcttgcctcatcctcccgagtagctgggattacagctgtgcaccccacgcctggctactttttttttttttttttttttttttgagagggagtctctctgctgcccaggctggagtgcaatgggtgcaatctcggctcactgcaacctttgcctcccagattcaagtgattctcctgcctcagcctcagctgaggattacaggcacctgccaccacgcccagctaatttttgtatttttaatagagacggggtttcactacgttggccaggctggtcctgaactcctgaccttgtgatccacccacctcagcctcccaaagttctgggattacaggcgtgattcaccatgcccagcctaatttttatatttagtagagatagggggttttgccatgttggtcaggctggtcttgaactcctgacctcaaatgatccacccactttggcctcccaaaatgctgggattacaggcgagagccgccgtgcccagctggctcctcagttttagatttgaattttataattaattatagttagcctttttatttcaaaataacccagttttccccagtggtaacattttgtagaactatagtgtaatgccacaaccaatacaacatcagccaacattgacactgatacaactcatgatctttaggtacaacccaagatcatcacctcatgatgttcagatttcttcagttttacttgtgtttgtgtgtgtgtgtgtgtgtttgtgtgtgtgtgtgtgtgtgtgtgtgtgtgtttgtgtgtattcagttctttgcagttttattgggtaagggctcatgtatccaactctatagtcaaaatacagaacaggtccatcatcacaagaattcctcatgttgcccttttatagccacacccacttccttcctgcaactgctggacccctgacaacaactaatccgttctccatttctttaattttgtcatttcaagaatgtgtaaacacggccgagtgcagtggctcaatgcctgtaatcccaccactttgggaggccgaagcgggcagatcacctgaggttgggagtttgagaccagcctgaccaacatggtgaaactactaagaatacaaaaattagctgggcatgatggtgtgtgcctgtaatcccaggtacttgtgagactgaggcaagggaatcacttgaactgggaggcagtttgcagtgaactgaaattgtgctactggactccagcctgggcaacagaccaagactctgtctcaaaaaaaaagggaaaaaaagaaggttatataaatggaattatacagtatataaccttttgggacagttttctgttgtttcatttttttcactcaacataaatgccttgagatgaatccaggttgttgtgtggcagtattcgtttctttttattgctgagtagtattacatggtgtggatgtaccaaaatgtgtttaaccattcactcattgaaggatatctgatttgtttttagttttgggctatgatgcattaggcttctgcgagtatttatatacagattttgaacatgtttttattgccaagactacagttgctgggtcaaatggtaagtgtgtggtttgcaatttattttttaaattaccagataaaaatcttttactggctgggcacggtggctgacgcctgtaatcccagcactttgggaggctgaggtgggtggatcacctgaggtcaggagttcaagaccagcctggccaacatggtaaaaccctgtgtctactaaaaatacaaaaattagccgggtgtggtggcacatgcctgtaaccccagctacttgggaggctgaggcaggaaaattgcttgaatctgggagatggaggtagaagtgagccgagatcgtgtcactgcatttcagcctgggagacagagtgagactccgtttaaaaaaaaaaaaaacaaaaaaacccaaaaaccttttactgttaaaattatttcttcatatatatatatatatatatatatatatatatatatatgtgtgtgtgtgtgtgtgtatatgtgtgtgtgtgtttggtgaaaaacatcattttacagttcttgtaaagctgtctgtctcctagaaccttagtgtctctgtaggtagtttgcattgcattaagaattctgtgtgacagctgacagaaatccaacccccgaattatcacagggtactttcctatcaaaaagtatacttgggttttgtaagtattagacctggtatttttcttttttggtattttatctttagttttaatgttgtagtaaatgtttaccttttattttctctttttatagcggctatgtgactacgtttgtgacctcctcttagaagagtcaaatgttcagccagtatcaacaccagtaacagtgtgtggagatatccatggacaggtaaaatttcatgagcagatttttaagttttgtactgtccatgatccatgtgtgttttcacatgtgctgcaaaattaaaacaacaacaacatcaacaaacacaactggtggtaagctaggttgcctcagtctctgtgacacaaatgattcctggtttacatttttggtgaataaaagcagtggtcaaattagtgatggaatttgttgataattacatttgtgaagtgaataatgcagcattagttttctgtggaatggtggggttgggggtaggtagaagatataaagtacaaacacatactgctcataataactatgattaacaggagatgttttggtgttaggcacttttttcattcagttcatttctgttctcctgtcatatattgttgaaaatttatcatttctttagtgggaatgagaatagcaaaggtacagaaaaataaaattgttggtccatgatgtcacagcaaatcactgatgaatgagctagaaaatatttagctcaatttttcatctgctgggtgtttgtaagaatttcaaagcagtgccgggcgtggtggctcacacctgtagtcccagcactttgggtggctgaggcgggtggatcgtgaggtcaggagtttgagaccagcctgaccaacatggtgaaaccccgtctctactgaaaatacaaaaaaattagctgggcatggtggtgcgtgcctgtaatcccagctactcaggaggctgaggcaggagaatctcttgaacccgggaggtgaaggttgcagtgagccgagaccgcaccactgcactccagcctgggcaacagagcaagactctgtctaaaaaaaaaaaaaagaatttcaaagcagtaacaggaggggcatacctcatatttagattctgttgtcagtgtttagtctcatgtatatttgtagaattttttcactgggaaatgaaagctgaacagattactcatagagtgctatatgcatacagtgtagttggggccataagacttaataatacattgcaaacaatgtagtctttaaaggatgccaacaggacttactgtcacctgtgcaatttccctgctttaaatatgactgtgtaaatgagcagaaatgtgtgtaaattgactctgattaggggctgctccatgagtaaagtcttgttttggctacttacttacaggctgattttcttttggtttttcaaggtgttttctggattttttagattataaaaaaatctgacacttgcatgtcatcacctcctagatggaggtcccattatgtcatctttgattgttaaaattacagttctttagagtagactttaggaattgatttcctaaaatttccatgtaacttctctctcaaacatttgtattttgctaacataaaggatattaatataagcagtgtcttaagacattcctgaaaactggaataaaccaagtcatgttttcccccagtgtagtgtagaagtttctatgtaacttctctctcaaagtaaacatttgtattttgctaacataaaggatattaatataagcagtgtcttaacacattcctgaaaactggaataaaccaagtcatgttttcccccagtgtagtgtttcccccagttgtagactttttaagatgtgaagtacagccatgatcaaaggtcagaaagttagagaccaacctcgaactactaaaattggaagcataaaattgaacttttgtattatatataccttcagtcaaatgtgcagttcttgctaacatatatcttgtgttttgaggttaacaaagtactttttcacatattctgtgtcagttttttcccaaagtcctgtgagataggattattttgtagacaatgaaagggagactgaaagattgaagagaaatagcccaaactcacacacagctactacagggcagattgagatttgaaactaatttgggtttcttttgtacatgttattttaagaccaccaccaaaccgtgaacaattgtttatgttgtatgtgttccttaaaaaacaattgttccaggtgcagtggctcacgcctgtaatcccagcactttgggaggctgaggcaggcagatcagaaggtcaggagttcaagaccagcctagccaacatggtgaaaccctgtctctacgaaaaatacaaaaattagccaggtgtggtggtgcgtgcctgtaatcccagctacttgggaggctgaggcaggagaatcgctagaacccgggaggcagaggttgcagtgaaccgagatcatgcattgcaccccagcctgggcaatagagtgagactctgtctcgaaaaaataaaaaataaaaaataagccgggtgtggtggctcatgcctgtaatcccagcactttgggaggctgaggtgggtggatcacgagggcaagagatcgagaccatcctggcaaatatggtgaaaccccgtctctactaaaaatacaaaaattagccaggtgtggtgacaggcgcctgtaatcccagctccttaggaggctgaggcaggagaattgcttgaacctgggagacggaggttgtggtgagccgagatcgcgccattgcactccagcctgggcaacaagagcgaaactccgtctcaaaaaaatgaaaaacagaagattgctaatcagaaacatgggatttgagcctctaaatagctattgactgattaaatacaatgtaaaatgtatcctttgggacttatcttcctctggggcctgttctggaattgcaggattgggttatgagtatgaataaacatgttagcaagcatgttgtgctgagaagtattgaagctgtgtaatatagtgaggagttatagatttcagtgtcagatacaacttggtttaaatcctggcttggctatatattagttgtttaagaagccatttcagctagctcacaaattcgttaagtgtggcctgtggacccttgggtctctaaggtggtacagaggcaatggagggtaaaactgctcgtgccttagcatgaaccaagggaatgacactagaatatactgattatcattgagttcttcaccaacatgcctgcacagtaaaataaaatgccagtttcacttaactctcaatcctttagaatatccattatttgaaaagtctggctgggcatgatggctcatgcctataatcccagcactttgggaggctgaggtgggaggatcgcttgaagccatgggttcaagaccagcctgggcaaccaaatgatacccccccccccccccatctcaaactcctgacctcaggtgatccacctgccttggcctcccagagtgctgggattacaggcgtgagccactgcgtccggcctgagactccccatctctaaaaaaaaaaaattttttttttttgagacagagtttctctcttgttatccaggctggagtgcaatggcacgatcctggctcactgcaacctctgcctcccaggttcaagcgattctcctgcctcagcctcctgagtagctgagattacaggcatgtgccaccacgcctgactaactttttgtatttttagttgagatggggtttttccatgttgctgaggctggtcttgaacccctgacctcatgtgatcctcctgtctcctgtctcggcctcccaaagtgctgggattacaggcgtgagtcaccatgcccggccttttttttatttcttttttttttttttttttttggacagggtctcgctctgtcacccaagctggagtgcagtggtgtgatctcagttcattgcagcctctgcctcccgggttcaagtgattcttgtgcctcagcatcccgagtagctgggactacaggcacgcaccaccacgcctggctgatttttgtatttttagtagggatgggattttgccctgttggccaggctggtctcgaactcctggcctcttgtgatccacctgcctcagcctcccagagtgctgggactacaggtgtgagccgctgcacctggcccccatctctaaaaatattaaaaagaaaaaaattagccaggcttggtggtgtgagtctgtaagtcctagctcctcaagaggctaaggtggaagcattgcttgagcccaggagtttgaggctatagtcagctattattgtgccactgcactccagcctgggcagcagagtgagaccccatctaaaaagaaaaagaaaaaagtctgtgtgatgaaatgggaagtatgcataaagcatatctactgcatgctgaagaaagatagtttactcaaggaaaagtagttgtgggttgggcacggtggctcacacctgtaatcccagcaccagatcacctgaggtcgggagttcaagatcagcctggccaacatggcaaaaccccatctttactaaaaaatataaaaaattgccaggtgtggtggtgggtgcctgtaatcccagctactcagggactaaggcagggaaaattacttgaacctgggaggcggatgttgcagtaagctgagatctcaccattgcactccagcctgggtgacagagtgagactctgctaaaaaaaaaaaaaaaaagaaaaagaaaaatacttgtgaaattctttgagtcatgagttaaaataactgcttttttatggaacactatttttacttgagaatgactgacaaactgtgattatttagacttgggtatttggcaactatatttgcaaaagtgaaggaagtgggccagtcacttcaaggagaacaattgacagtatttgttgccgatgacaaaatttgaatttactaatgaaaaattggaattttggaaaatctgagtccaccactatggggctaacagtttccgacacttaaaagactttcctgagatgaaatgagcagtgatattaacaaatatggttttttgatgatataaaatgcaatgtcattttcatttttcaaattactagtttaccatttactcaaagtgtaagataacaaatgtaacagggtatgaaagatgactattataggccaggcctggtgactcacacctgcaatcccagcactttgggaggccgtggcaagcggatcgcttgagcccaggagtttgagaccagcctgagcaacatggtgaaaccctgtctctactaaaaatacaaaaattagccaggtgtggaggtacgtgcctgtaatctcggctacttaggtggctgaggcatgagaattgcttgaacctgggaggtggaggttgcactgagctgagaatgtgccactgtactccagcctggacaacagggagagatcctgtctccaaaaaaaaaaaaaaaaaagcaaaagattactgttatggtttcagatttcatattgcgattaacttttaagtgtcataaactgccacttgtcaaattttggtacagtatttaaagagtatgcacagttacctgaaaatgttattaaaatactccttccttttgtaactgcatatctttgtgaagctggattttcttcatctgctttacttagtatattcccaacagactgagtgcagaggcaagttctaagactagccatgttctatttagccagacattgaagagatttgtgaaaatgtaaaacaatgtgaattctcctctcactaaacaatttttttgttttggaaaagttaatttttcattaaaatgtgtttgtgatactttttgatgggtatgttattgatttgtttttttgagatggaatttcactcttgtcacccagactgcagtgcaatggtgtgatctcagctcactgcaacctctgcctcccgggttcaagcgattcttctgcctcagcctcccaagtagctgggattacaggtgtgagtcaccgtgcctggcctatgttattaatttttaaaaattcatttaaatatttaaaacttctgagttttaatctctaatatggtaaatattgatttgtaaaacttacataaaagattttcaggacctctggtttttaagatcacaaatgaatcctgaaaccaaaaagtttgagaactactgggcagactggatgtttccttgcctctgataaaaaaaaaaattccacttcctagccgggcgcggtggctcacgcctgtaatcccagcactgtgggaggccgaggcgggcggatcacgaggtcaagagatcaagaccatcctggccaatgtggtgaaaccccgtctctactaaaaatacaaaaattagctgggcatggtggcacatgactgtagtcccagctactcgggaggctgaggcaggagaatgacgtgaacctgggaggtggaggttgcagtgagccgagatcatgccactgcactccagtctgggtgacagagcgagactccgtctcaaaaaaaaatccacttcccaggctgggtaaagtggtacatatatgtagttccagctactcaggaggctgaggtgggaggattgcttgatcccaaaagtttgagaccaacctgggcaatatagtgagcctccatctcaaaaataatgataattaaagaaaaaaatctacttcttaagattgtttttggtttaaaatgggagcagagtatctgaaatatgaaaaacagagtagctgggtgcagtggctcacgcctgtaatcctagcactttgggaggctgaggcgggcagattacctgaggtgaggggtttaagaccaacctggccaatgtggcgaaaccctttctgtacaaaaaagtacaaaaattaggcaggtgtagtggcacgtgcctgtagtcccagctacttgggaggctgaggcaggaggattgcttgaacccaggagccagaggcagcagtgagctgagattgcaccactggactccaggctgggtaacagactgagactccgtctcaaaaaaaaaaaaaaaaaaaaaaaaaaagagagtgagggagagacatagagtagatggtagatattatttgacgatgaggtaggtgtctagtaatgtaggatgaaaatagggccgtgtgctgtggctcatgcctgtaatcctagcatttgggaaaccgaagcgggtggatcacctgaggtcaggagttcaggatctgcctggccaacatggtgaaaccccgtctttaataaaaatacaaaaatcagcgggggtgcggtggcagataagctactcgggaggctgaggcaggaaaatcacttgaacccaggaggtggaggttgcagtgagctgagatcgtgccattgcactccagcctggacaacaagaacgaaactccgtctcaaaaaaaaaaaaaaaagaattgcccaagttctcgggaaatgggaacctatgtatcactgacgcagaatatttaatcgtctacctgtgtgtctggtaaatacaaactttaaaagcttttgtttaagaacagatatctggccaggcgtagtggctcacgcctgtaatcccagcactttgagaggccgaggcgggcggatcacaaggtcaggagttcaggaccagcctgaccaacatggtgaaaccccgtctctgttaaaaatacataaattagctggggctgttggcacgcgcctgtaatcccagctactcgggaggctgaggcaggagaatcacttgaacctgggaggcggaggatgcagtgagccgagatcgcaccattgcattgcagcctgggcaacagagtgagactgtctcaaaaaaacaaaacaaaacaaaaaaacatatctgtaaacatcaatagaaaagtttaaggatactcactcttctaccatatttttattaaaaaactgacttacaaaactttttaatgttcacttcctgactttgtgtatataactactcaattttttacataatagaattgtgtagttataggtatagttttgtattccattcttttccctaatgatttttgcattttgctacatggttttcgtcataatttttattcatggcctcataaggtccttgagttgctagatcttaatttaagatattcacttatgttagtcatgaaggctgtttcttttgatgttttaaatgttgtcataacacttttttttttttgagacagagtcttgctgtgtcatccaggctggaatgcagtggcaccatcctggctcactgtaacctccgtctcccaggttcaagtgattctcctgcctcagcctcctgaggtagctgggactacaggtgcccgccgccacgcctggctaatttttgtatttttagtagagactgggtttcgccatgttggccaggctggtctcgaactcctgacctcaggtgatccacccgcctcggcctcccaaagtgctgggattacaggcgtgagcctctgtgcttggcccactttttttttttttttttgagacggagtcttgctctgtcacccaggctagagtgcagtggcgtgatcttggcttactgcatcctccacctctcaggttcaggtgattctcctgcctcagcctcccgagtagcagggattgattacaggtgcccaccatgatgcccagctaatttttgtatttttagtagagacagggtttcaccatgttggccagtctggtcttgatctcctgacctcatgatccacctgcctcagcctcccacaatgctgggattacaagtgtgagccactgtgcccggaccataacacttttttttttttttttttttttttttgagacagaatcttgctctgttgcccaggctggagtgcagtggcatgatcttggctcactgcaacctctacctcctgggctcaagcaattcttgtgcctcagcctcccaggtagctgggattacaggtgcaggccaccacccctggataatttttgtatttttagtagagatggggtttcaccacattggctaagctggtcttgaactcctgacctcaagtgatctgcctgcctgggactcccaaagtgctgggattacaggcgtgagctcccaaagttccaggattacaggtgtgagcagcttggcctgttagctaattttcagatacattttatattaagcttcctaaagttgtttttttttttttgtctgactttttagacttatggaacattgttataaaaggtgttactttatttctttcagtagttaacatctcactttcagttttcttcactttgactaacattcctattaagtgttaaaagtttaaatgataattttatttcaagtgtaaaagatgaatgtgttagaagttgttagttgtaattggtccaatgtattgtagtcaattcccttaatccaaaatcgtttttcttccagaaaaactgtaatgctttctttggaaattagggctagggtaataatctagtggactgaaatttgacaaatgcacaatttgccagttaccaaatttcagtaaatagaaatatgatgaaatatccttgggtgtcatggatcacacttgtaatcccagcactttgggagactgaggtgggaggattgcctgaagccagtagtttgagaccagcttgggcaaaaaagcgagaccctgtctctataaaaatttgctgggcatggtggtgtgtaactgtggtcctagctactgaggagggcaaggtaggagggttacttgagcccaggaatttgtggctgcagtgagttatgattgcaccactgcattccggcctgggtaacagagccaaaccctgtcttaaaacaaaaaacaaaaaatatgatgaaatatataatttttttttaactgatcattgaggagacactccatggctgtggagcctgagggtatataactctaactgtagaatgtgggaagatctctgtataacactggagtgtcatgtaagttcagtttggaagaaaaagaggtatccacttgtttctgtaatcttttgtctcattaaaatagatacagaatttgggtgggctgttagattagcttactgagaaattagacaattgataaaggatgtcagaattctcaagagatagatggggagatgtatgaaagaaaatgagaaagggaatcctatgataataatctaggagtgactttatggtaactgagctttatttagtgctttttttagtcttgagaactgtgtgcttggcagtttggcttacactttatttcttaaaaatgtaaatatttggagtcctcttagctgcttctttacacatttcactctcagttttgttgctttgcttcttaacaggaatttgtaatcagcatgtattgcatttcttttatagttttatgacctttgtgaactgttcagaactggaggtcaggttcctgacacaaactacatatttatggtatgtaaacaccagtgatatcaagtgcttgtttaaaatggaaaggatctgacttattaaatgtaaattgcataataattctttaccatgtgacagtccctatttcagtatattaaaagatgtgtattagtccgttttcacgccgctgataaagacatacctgagactgggcaatttacaaaagaggtttaatggacttaacagtttcacatggctggagaggcctcacaatcatgcagaaggcaaggaggaccaagtcacatcttatgtggatggcggcaggcaaagagagagagactgtgcagggatctcttgtttttaaaaccatcagatctcatgagacttattgtcatgagaacagcacaggaaagacttgcccccatgattcaattactttccatcgagtccctcccacaacatgtgggaattcaagatgagatttgggtggggacacagccaaaccatatcaaggtgattgtatacttttctacatttaactatgtcctctaattaattgccttagtaagccactgtagatagggttgggttgtagctgtcagtaatggttgggcataaaaaataacccagaacccctggtttaaggcaaaaatcttcaattgactattatttattcagacttttcgagcattcatttttatctctcgttaatctatggatggattaatatacacacatacacatttgctatagatgtttgcttttcttttggaatgtaatgttactgttgaactttttctggatccttctctcattttctttccttctgaaagtttctgggtcactttcttattttttttttttgagacggagtctctctctgttgccaggctggagtgcagtggtgcgattggcttactgcaacctctgcctcttgggttcaagtgattctcttgcctcagcctcccgagtagctggtattacaggcgtgcgccaccacgcccagctaatttttgtatttttagtagagacaggatttcactatgttggccaggatggtctggatctcttgaactcgtgatccgcccacctcggcccctgccttggcctcccaaagtgctgggattacaggggtgagccaccacgccggccactttcctattctttcagctgttttcctattggtgtaatattggcccaagtcagacattaatgggaagtgtaaatagtatattatcatatatggttgttaaatgcaaaactgagcctagaacgctgttataattatggtatttgcttttacaaaaaatttttttcttcaagtaggcaactcttccaatacagttaaaatgattcttaaaataaaaaattattttacctgggcatggtggtacatgcctgtagtcccagctacttgggaggctgaggtgggatgattgtttaagctcaggagttctagaccaacctgggcaacatagtgagaccccatctctaaaaaaaaaaaaaaattgaatttttaaaaattaaattacttggccgggcgcagtggctcacgcctgtaatcccagcactttgggaggccgaggcaggtggatcacctgaggtcaggagtttgagaccagcctgaccaacatggagaaaccccgtctctactaaaaaaaaaaaaaaaatacaaaattagccgggcttggtggtgcatgcctgtaatcccagctactcaggaagctgaggtgggagaatcacttgaatccaggaaggggaggttgcagtgagccaagatcacgccattgcactccagcctgggcaacaagagtgaaactccatctaaaaaaaaaaaaaaaaaaaacttaaaaaatactggttagcagatgaccaaatcaactaatgtaggtaatagaggattgaaaaaatggtggttttgccaggtgtggtggctcacatctataatcccagcactttgggaggccaacgtgggtggatcacaaggtcaggagtttgagaccagcctgaccaacctggtgaaacccccgtctctacaaaaaatacaaaaatcagccgggtgtggtggcggcttgtacctgtaatcccagctactcaggagtctgaggcaagagaatcgcttgaacccgggaggcggaggttgcagtgaaccgagattgtgccactgcactccagcctgggtgacagagtgatactgtctcaaaaaaagaaaaaaaagaaaaaaaaatggtggttttttttttcagggaaagtttttgagagaatggcacagcagattcttgtagatttccctggaatcaaaaatcttgtttgtataaacatttaatagaaaaaatttgtttacgtgtattttatttttttgttaaaatcaaatttccaaataattcagtatgtaactctttattgtagttataaactatatgtttgtacagtttgatataatttgaaaagaatattgtggctattgtattgtttgtaactgtaaacttttacttcacagggtgattttgtagacagaggttactatagtttggagaccttcacttaccttcttgcattaaaggctaaatggcctgatcgtattacacttttgcgaggaaatcatgagagtagacagataacacaggtctatggattttatggtaagaattcctatttctctgattctgaatattattttactttcctctttggaaaacaaagctacacaagtcatacacatgctttatgtatattattttccccacatcctcactccttcactcctcccaaacaattgaaaatcttatgctcgagagaagaccactgttaactttttggtgtgcatctttctagatctgtgcctcaaagtgtagctggaatcacctgggttctcattaaaaatgtagattgccggccgggtggggtggctcacacctgtaatctcagcactttgggaggctgaggcaggcggatcacaagatcaggagatcgagaccatcctgaccaatatggtgaaaccccttctcttctaaaaatacaaaaatgagctgagcgtggtggtgtgtgcatgtaatcccagttactcgggaggctgaggcaggagaattgcttgaaccaaggagtcagagtttgtggtgagccgagatcatgccacagcactccagcctggcgacatagggagactccgtctcaaaaaaaaaaaaaaccaaaaaaaaaaggagaatgctgggcctcaccacagatttattaatcaaaatattttggagtgggaatctagaatctgctgaaggtgaatgttctgcacaaatttgagagtccattctcatccattttgtatgtgtgtgtgtgtgtttatgtgtgtttatatatgtacaaacacgtgcacactaaaatggggacatacctgattttttcactttattaatgttattttcatggctgcttcatataccatatggatgtagcataattgatgtatcagtttttcctctatcgttggactttagagttgtttttaagctgctgttatacatccttttacatatatctctgtatgctcactccagagaatgctaggacctcagggatcagaagcagaacttagtcataaacagcaaaataggccaggcgcagtggctcacccctgtaatcccagcactttgggaggccgaggcgggcggatcacctgaggtcaggagttcgagaccagcctggccaactaaaccctgtctctactaaaaatacaaaaattagccgggcactggtagggggaggggggagggatagcgttaggagacatacctaatgtaaatgacgagttaatgggtgcagcacaccaacatgacacatgtatacatatgtaaaagaccgacacgttgtgcacatgtaccctagaacttaaagtttaataataaaaaaaatttagccgggcatggtggtgggggcctgtaatcccagctactcaggagactgaggcagggagaattgattgaacccaggaggtggaggttgcagtgagccaagatcgctccattccactccagcctgggcaactgagccagactctgtctcaagaaaggaaaaaaagcaaactagctaattctttaaaacttttatttggttgaaagagagagagagagagagagagagagagagagcgagcttattaggaagccccttcagggaaatagaactgtcaagattatgaatttggattttccttgagcacaattaagacagatattgagagatttggaaacattaattgcagaaccctttagatttaaattttatattttgaattatcttctttcattataaagataggctgggccaggtgtggtggctcatgcctgtaatcccagtactttgggaggctgaggcaggcagatcacaaggtcaggagatcgagaccatcttggccaacatggtgaaaccccgtctctacttaaaatacaaaaattagctgggcatggtggcacttgcctgtagtcccagctattcgggaggctgaggcaggagaatcccttgaacccgggaggtggaggttgcagtgagccgagattgcaccattgcactccagcctggatgacagtgaggctgtctcaaaacgaaacaaagcaaagataatctgaactctcttactcttcagtttgtctgccattatcaattagagaaattttgagaatttattgtttttatataatttttttaatacgtgtaaagttaggtaatatttatctcctttctacaggtgactttttattttcattcacaaaataaacaccaattgaaatacaacttttggattcttttgcaaaataatcaatattttggataacatactatgatattagctcagtgaaaacagtactaaaactaatgttataaaaacacacacacctactatatatatgtaactaatgctacatgtataatatataaaatacatattgttatatatggctaatatatgacttttttttttttttttttttgagacggagtctcgctctgtcacccaggctggagtgcagtggtgcgatcttcgctcactgcaagctctgcctactgggttcacgccattctcctgcctccgcctcccaagtagctgggactacaggcgcccgccaccatgcccggctaatttttttgtattttttagtagagacagggtttcaccgtgttagccaggatggtctcaatctcctgaccttgtgatccgcccgcctcggcctcccaaagtgctgggattacaggcatgaggcactgcgtccagccatatgacatatgttttgaataagataattttagttattataggacttatattgattttcaaggaataaaatatccctatatgactttacactgggacttcagttcacactgataaacacatactgggcagttactattgagccaagttcaagatccctgcctgcaacctgagctcattgttagggctctcttatggcaagtttacataacaatcttgcttcacgtagatatataattgagaaaatcttggggattggtcataacctgcagacttctttcctatatcattttcagcttcacttaaggcaatagtgatatgtcaggtttttttttttctaaaattatggaagaagccaaagtacagagcttccatggtgttaacaaaagaagtgtgtaccctattaactatgtagacagtcagggtacagtggctcacatctgtattctcagcactgtgggaggctgaggtaggaggattgcttgagctcaggagttcaagaccagcctggacaacatagggagatccccatctctaccagaaataaaattagccaggtgtggtggcacttgcctgtagttccagctgttcagaaggctgaggtggtgggatcgcttgaacccaagtggttgaggttgcagtgagctgtgatcgcgccactgctgattgtgccactgtattccaacttgggcaatagagtgagaccttgtctcaaaaacaaaaaactacgtaggcagcagaaagagtgttcaactgagaatttgtaagaacctgattggcaatctgtcctcagttttgatccactgaagctcaagtgtttagtcgcacgatttgcagaaaatctcagaagagacaacttagccctgagaagagttaggaattgctcatgctcctataactaaggatcctctaatttgtttgatctgtttatcctgctagaattgtctccttaaataaatttatctgcttaccagaattgcctaatattaacataactgttaaaacatttgcttcaggttgtgtgaaattagtatttaactcttctaatgatagcattttggctaataatttcagctgcttcttaggtccattccaggaatgaagagcagtactacatccttaggaaatacagtcatgtgccacataatgacatttcagtcgatgatggactgtatatatgacagtggtcccatagataaaacggagctgaaaaattcctattgcacaaatacttaccattgtgttactatttccttatgatatttagtacagttacatgctgcacaaatttatagcctatgagcaataggctatatcatattgcctaggtgtgtagtaggctagaccatctaggtttatgtaaggacatccgatgatgttcacacaacgatgaaatcacctaacaatgcattttttagaatgtatccccatggttaagggacatacaactgtatgtagttagtcactagcgttcttttggctctatgtggaggtcctagcaggactaaatatgtgtcatatcttgctatcctagtttaagctgaatttctgttgtactgaaggctgctctagtattggatatattgtttatttttattagcagattcattaattaaaacccttctgtttctttcacagatgagtgccaaaccaaatatggaaatgctaatgcctggagatactgtaccaaagtttttgacatgctcacagtagcagctgtaagtttctatttttaaagtctcatgtacgttcctgccaataacacattgcatatttttatctagttgtcatctcaattatattgatatctttagtattcactgatgagtttagatatgcctgaggttatatgttcaactctttgttatccttttttgctagttaatagatgagcagattttgtgtgtccatggtggtttatctcctgatatcaaaacactggatcaaattcgaaccatcgaacggaatcaggaaattcctcataaaggagcattttgtgatctggtttggtcagatcctgaagatgtggatacctgggctatcagtccccgaggagcaggttggctttttggagcaaaggtcacaaatgaggtaaagccaacatttttggaaatgtaatttgtggattgctaatgggctgcatagagaactatggtggccctagataacaaacttgtagtctagcttactcaaaatatggtggctgtggatattaaatttctagtttagttattaacgtatgtctttctttaatggttaaataagatgacacagtgaaagcacctactccagcatccatttggtaataatgtataaagtaaatgttctttccttttttttttgtttttgagatggagtcttgctctgtcgcctaggctggagtgcagtggcgtgatcttggctcactgcaacaacctctgcctcccaggttcaagccattctcctgcctcagcctcctgagtagctgggaccacaggtgtgcgccaccatgcctggctaatttttgtattcttagtagagatgggatttcaccgtgttggctaggctggtcttgaactcctgacctcaggtgatccacccgcctcagcctcccaaagtgctgggattataggtgtgagccaccgcacccggccagcccctttcctttcaagtactgtagttaagtaacaaaatggcaagaccaagataggcaatacttttttttttttttctcaaagacctcaaatcacacagatacagacactttattagtttcctctacaagagacaataacatgaatctttttttttttgagacaagagtttcgctcatgttgcccaggctggagtacaatggtgcaatctcggctcactgcaacctctgcctcctggattcaagcgattctcctgtctcagcctcccgagtagctgggattacaggtgtacaccaccacgcctggctaattttgtatttttagtagagacggggtttcaccatgttggtgaggctggtcttgaactcctgacctcaggtcatctgcccaccttggtctcccaaggtgctgggattacaggcgtgagccaccgcgcccagcctacgtcaaatcttttttttctttttaacagaaatctctgttcatttgaaaagccaaatagatccaaagaaagaagatgaaaattaaatacttaaattaatcaaaaggcactatgataccacctaaaacctactgccacagtggtagtaggctaaggaagatcaagctacagcaaatcatgtaatgtgaatgttagcgattacatagcaggaagcacatttgctttccagaagactacggtacagtgttcatttgggcccaagaggatctttggccaggaaaggatcaagatggatgaaggtaaagccaaatcaaaggagtaggtacaaaagagaatccaagctacatagtcaagcagatgatgatggatcaggcttcttcctcccaagaaacatttgctgcgctgtgctgcctcccccctcaaccaccccccaccccctaccccatggctgctcaagcccaactgcctactcctgccttacagggtgctcagccaccgggactaggtttggggttgcccagggctcttgccataatttagcatagaccttggggagaactgctcacacatgggttggctttgctgctggttgttctcaacaaagaaaaccctgaagcattcacatgcagagtagtctgagcttctccagtcacagtcaaacacccccacacaacatcctcaaaagtctgaaatcttgtaacagctgagctatagttaaagctgcaaggctcacagaatcatcaaggaagccagaatgagacaatgcagataggaagtcccagcagttaatctcaatccttctttcttcatttcggataagctcagatatacctgatgtgggatatagaaagctacactggagcaagctgggtcttctgctgaattcgtcatcaaataccaagggaaaacaaggggtggggtggattttattcttaaaaagcctcagaagttactgtattataaagggacatgactgaataggtaagaaacggattcttcattgtgaattttcctgatggcttctgcaaggctcatagagatgttgatcacctgtattttggaatggtgcttcatcttgtcctcctggggtatgttattggtgactactactgctttaaagcatgcgttgttgatgtgagaaatagctggaccagagaagattctgtgagtcaagatagcataaactttggtgactccagctgagagaagtttgtcagctgcatggcagattgtgccacaagtgtcaaccatgtcatccgcaaggatggccaccagatccttcacatctcccacaagcaccatgcggtcgacttcattggccttctttgtgaatcaaggcaaagtccacattcagcctgtctgcaatggaggtcactctcttagctccaccagcatcagatgaaacaatagtgcagttcttctgctcagagatattctcccttatccacttcaggacacctggctctgcatacagatagtccactgggttatcaaaaaagccctgaatttgagaagcatgtaggtccatggtgataatatgatctgcgcctgccacagatagcatgtttgcaacaagcttggctgagattgtcacctgactctttattatcctgctgggcataagggaagcatgggatgactgcagtaagctggctcgctgaagcagtcttgcaggtattagtcatgatcaaaggcaccattaaattgtcattgattttgccacaaccactctgaatgatgtagacatcctttccacgtacacttttgccaatttccacacaggtctcctagttgctgaatttctcaatcactgccttgccgagctccaggcccaggcgatcggcagttttctgagataagccctggtgggagctgccgctgaagattttgatattcaggatcctggccaactaccctaagcactcttcactaagtgatcactgctgctgcagagactgcaaccaaagtcggcccagagactcaatactaatctctttgcgatgctactccgccatcttcaagataggcagtactttgaactttcaactgttttcagttaaaacacacacacacactttgaactttcaactgttttcaattaaaacacacacacacacacacacacaccccttatattgggaagtgctccagcatcataatgaagtcaaaaaactagattctgatcctgcatcagtgtatcttaatttagataagttatttatctagtctgagcttttgtttccttaagttgcaaaagaataatctctttcagaattattgcaacatctacatatactaaaccttcagtaaatggtagatactgatagcaatatctttattattaaatcagaaaacacaaaattttgtttcatagtacctattgaatgctttttcttccagaaatttctaactgtttatgtagctgtacagtttccatagttgtgcacttgactcaggccaaaattgctgtttgcctaaacttattaaattgttggagataattatagagtgcgttctataatcttgatgcctttagtagtaataggatttggtattttatttaaatgattatgtaggccgattgttttttaagtgctaagtacttacagtgcctttctaaattgcagtttgttcatatcaacaacttaaaactcatctgcagagcacatcaactagtgcacgaaggctataaatttatgtttgatgagaagctggtgacagtatggtctgctcctaattactgctatcgttgtggaaatattgcttcgatcatggtcttcaaagatgtaaatacaagagaaccaaagttattccgggcagttccagattcagaacgtgttattcctcccagaacgacaacgccatatttcctttgaggccttcgcccatcctgctgacccatttttctgccctcttcttaccccaattttcttgtattaccctctacaatatactttttattgagcactttgctgctgaaatgctgcctcttgcctttttttttttaaattttaaattatctaaatttattgtttgttgtggtgtctatagcaaagtttttctatcaattttcccccatcccatccccaccctggactcatttgagaagacttgagaaatgtcttaatactcacactgctgcatgtagctcttgcttatttactggtctgggaaacaggatgtgtttcctttttttaaaagccaattgacagattacacctaaatactcctccttttgtatcattcagccttttgttttagtttggtaagttttaagaaatttcagcagcaaagttgttattcagtgggcacgatggactccaaatgcctcaagttatgtatacctgtcccagatgtaaacttcattgtcctttgttggatgatattttaaatggatataaaataaattggtctaaagggctgccctccttgttgtgtttttaaattttagttaaaaactgctacagcttatgactttgtactttaagataattgtattgatcttttttcagattccttgtattttttaataaagtaatcttaaataaaactcagataggttaagtgttagaaattttaaacagcttacattgttagcgtaaagttatcttttcttttttcctaatcagagttcttgaccctttggttattgagtttaaaacttcaattgaaattcaatagtatttatttttgaaaaaaatcactaaactgtgcctaaagaacataactgccatattaatgttttggtttatatcctctatagtaatagaaaaacatttaatacttgtaatgctgatgtgttaatttgataccagttgagtagaatgtgatcaatccagtttacaatctatcatgagtattattaactaaaatctatgtgcttttcaataggaatcattcttctcttgctgtaacacttgaccttaacttttagaaagtgttcatttttaaactgcaactggaaaggttgaaaagttaggactcttgtatttgtgaactgtaatctgaagcagattatttaaagtgtagaaaaagaaacaagttcttcttttttgcaaaggtctgtgataccatatttcagctttgtgtaagtaatttgaatatccaaagggttgtgatgatcagttctgaatatgcaactgtccacttaataaggacaagtattccagtatctcttatgactgtagtcataaatgatgttggaatgtacattttgtgaaatagttggtatccctttactatgattaatttttgttattccaggaaatacttgtgaagccagccaattaataaagcactttagcatctgttcaggtagttttgaaaacccacttttccccttcaggataagaacttccaggttacctaaaaatgcaataaaaatctttatagtctaagcttcttggcatataatttttcatcagggttttcttttattaattgagcacaatactgttttgatttaatttttttccctcaaaccacccagctccttacatagtttttaattatatagctatatgaaagaggtggctaagacatttgctgcacacacttgaactaatgttgggtcagtagcttcgtgttactgccctgatcccagtgtaattcaggtggaaaggtatttttatctcacagggatatgtagctatgtattttactaattgtgaaacactggaaattaatgatgcagacaacttggtgtggtctttgaacagctctctgcagtatttttttttttcctgttaccataaattgtatttaagtgcttgctttccacttaagttgtactaatagaaccggtaactcccagccctccctgtttgacactccttagcttagattgatgtagttgtttttgttatccctataatgtgacttttatttttaagtcattgtgtactgcatttgtttgtcactagttgggcacgtgccaataatattctctccattccttatctgccatctctgttttgcctgatttctcttcaactgaataatggctttttgcatggaaaaaatagtttttactattagacgtgtaaagggaagagagagctaatgtattggactttgtgagcctacaaggaatattttggatccctccaataaataagggctatgtactatatgtactatatagagttatcatgtggtggaagatacttgcaagtcatagatttatgggcaggaggatttgttactccctatatctaggctgaatgtaaaatcccttatgttgtatcaatgggggtaaaaactatttttatttgcctatgatatacttggtttctaataaagtgccctaggctctagtgagaactgtctactttgaattgccatttactccctttcctcctttggccgatatgctcttggctagctttttataagttaatgtgtttccccaaaaagtttcact

SEQ ID NO: 15605 - DNA, 55806 bp, Human
  misc_feature (1)...(55806): n = A,T,C or G
ccacatgtccatagggaaaagattaatgtgtttaactacaaggggaaaactagaaacccggaggaaacttgaaggtagattaaaaaaacacatttcaggagaggcaccagtgtctatgtaaatacaaaaatcaacaaacacacaaaactgtgggcaaaaattcagttgaaaatggagaaacttgagaagtcctcaaacaagaataaaaaattaaacaattcaaagtgcagcataagagattgctcagtaagctctcattgcatgccaaatgcacaaaaaacttgctatgtgaactacaagcatgtacaggtcgtgagatttttaacatttaacacagtgaattaaaagagaggaaaattaaagatttaaattaaaaatgcaaacttaaccaatacatggcagttctagaacaatattaggcagtcccttttagttatagaagaaacagcaaatacgtttgcctatttttaattatcagcagtgtgttggtacgcattttatgagttatctttttgctctcctaaatgaatatattgtcttagtatattatagttttcaaaccttatttgcctctgaatagacaacagataaaattttaaattatggtgagttagttttattatccagttgaaattattctgaagtataattttaaatgaaagtgacagctttaaagtgttttggggaagaaattaaagttttgcatttgtgttaaggcaaccaagagctctgtcatgccatggatgtaattcagggcatctaggaatgaaatctgttcttaaaagaattgacggtagctttaggttagcatataaaatcagagttggtgatcagttgagtacttggcagcttatagatgttatgtcatgtaagttacactagacacaaagtgtgtaccactgtggataaacaacaacaggcacagactcaaaagagaatccaaatacaaacaagcaaggtgccaacttccttttcccctcttccccaagaagccttgtaactagtgtagggaacctgctttgaagcagatttacagaggttaattgggctgggatgttttagattatgttacacattaatgaaaatgctgattttgagctgtcatgactccaatgctttttataccatgataattattttaaaactttgtcttctgtgttgttgaaaacattttggcagaaagcctgtgtgacctgattaaacctatgaattgtcagctatgatctatagtactcagaagaggttgctgactgggcatcacttaggaagttcttgatttaaaagcaaaattagattgagactactgtgcccagcactgtattgccatgtcaatggcacatttttaatactgtatttagtatcctcgttttatagtttgctggcaattgcttaacaatattcatttaataatatatatatatttaagtatagccagttacctcataatgtgtgtattcctcttctgaaatcacacgatggaaaagctcatctaatgttgtttatttttcaatttttgattacagcttgtgaattaactattttatgggaattttaattctgtttctccaactgtacagagagagacagaataaccacctttggatgagttgttttatatccctgtaattattttctttctttcttaaaacattcaattttttaccctcttcccattttatgcttaaattatctaaatctgggaagcttgaatgattaaaatattccaggaagccagggttacctttttctaaggatctagtctgtggtaaattgaggcggtgggggggtatttaaaattctagggtgcatgtaaacactatcttaaaaataattttcatacttattcaaacttaccgatcaaatgtgaacaatgaagttctcagcatgaattgtagtacactgatgttgtttgatcattttctcgaataaacaaaatactcacactatttgtcctctgtttctcgcttcttctctctctgtctctctctctctttccttgaaggtctcagcatcagaggagcccaggaggaggaccctcccgatccccagctaatgagactggacaatatgcttttggcagaaggggtttcaggtcctgagaaaggtgggggatcggcggcagcagctgcagccgcggcagcctctggaggttcttcagataactctattgaacactcagattacagagccaaattgacccagatcagacaaatctatcacacagaactggagaaatatgaacaggtcagcagccgccactctcatagtcctacacaaaccctctgttgctcttctattagaccatgctaaccaattctgagggctgtgaggggtaggtgttaacacaaattacaaaataaataaggtcagtgcaaaaatccaagtgaattgttggattcatgaaaggaagaccctttgagattttggaggaggagcgctacctattttatcccatctacttgttttagttttattcattccgcacattcacgtgcccttattaccacacctgcagtcattcttccctctcacctcaccacttggtgctcttcaaagctctgtataattaacatttatgcactagccttgttcataagctttaatcacttttgaagggaagcattgcacagtgagcttttccctcctatgctgtgagctccagaatcctcctgggaattaattcttatggattgtgccagactatagggaacttcaccaagtaagcaggttccggcctgtttctctgagtatgagacctcccaagataattatgggtaccccaggacagggaatgctaggcaaggcattatgtgctaaattccttattagaaagagaatatgggttaaaaatctggttctcagcaattatattaaccatactgaatctcagataactttaagttgcatctttatgtaacaccaagaaaaaattaatactgctagtttaactataaaatattactgattataaaatgctttcacatttcagagatgttaaaatgtggagaaaaacaagagagtcttagatttaatgtaataaagtaaaatattggtgggtctttttacatatattttagttgttagtttaatgctgaaaagctgccaagtttgaggaattctcatttgataagatttgtcatttggaaggtaattttaaaaacgtattatgaaacattttataatacatgtacacaaaaataatgagaatagtattagattgaaccctatgaaattgctaagttttgaggccaaaaacagttgaatatggtaatttcatagagttcaaccccaaataaggaatcagaatcagctagatactttttacccagataaacagttatcaacattttgccactcttattttgtgtacccagccccaatttggtaagagtattttaaagcaagtcttagacatcctataatttcacccatgagtatttcactatgtaggcaagtactttttaaagtccacacactttagtgtgaaatgggagtcctggtgagttttgtgtgtgtttgtgtgtattttaaagactcttttaaagaggagttttaagttcacagaccaatttgagaggaaagaagagagatatcacatatacctcctgtccccacacatgcatagtctctcccattatcagcatcccccaccagaggggttcatttgttaaaattgattaacctacattgacacatcattatcacccaaaatccatagtttacattagggttcactcttggtattgtgcactctatggatttggataaatttatgatggcatgtacccatcattatagggtcatgcagagtattttcactgccctaaagatcctctgtgctattcatccctctcttcttttattctttccttcccactgatccctggcaacccctgatcagttttaatactgattttttcccctctacattccctgtatagtttcaattatatatatcgttgttttttcacattgccttttctaatattctggatacaatggtattaagcaaatgctgaatcctatcccagaggtgagtgtgttttgaggaagagtagaaaaatttgtatagctttaagttaaaaagtagtgtaaattaatattataaggtgttttctatttttggaataggattttctgagatctaaaattgtatgtctagtctcatttgtaagaataacttctcgtggaaaatgtacaaataagaattttggaaaaattatcgtgtgtatgtatgtaaaaatcccactttctgatttgacatatgaataattgagagtaaacaaaataagtcatggttgaaaaggttgcccctgagcataaacagtagaaaatgactcttatttgtagtataatcctaattgtataactttatgctaaaataactataactacttactagataaacactaccagtcaccttgcatggaaagagatataatattagaggccaaatggcctgagttttttggctgaggaattaaggtgattccttactacctcttgccatgtgtctttacacctgcctccttactttctccatacactctggtggaagttgtgtgaagctggtgtcagtcaatgacaaggtcctgagtctcactgttttagaaatatcctacaaaattttccatgagattttatgtaactttagccccagcttataccagcatcaaatcaccagggtttttttttattgttttgttttgtttttggcttttaaaatatacatgtatatgcatgttcttcatacatttatctctttttgtttgtttgtttttttaaattgaagatcaaattgggaagcactgagtttaaaaatatattcatgaattatttgtggatataatcagtagcctaataacgatctaaatatatagttcctttttcattttaatactttcagatggaaaaatatagatatataaaatctgtacagtagggacaaatgaatagatggggtatgaagactagttggcagattcagcagaattttaatttacacattttctcctgtaggtttggaattgttttagaagtgatgtagcagcacttaattcttttaagttgtctttggggctggcttttatagctcttgtgactgtagttctccaaagttattaggatcggtgcattttgacccaaaacagtcaacttttcctttcagttctttagggtacaagggctttatctggatggtcctttcagagacatgctttggcgttacaagaaggactaggcagagctaagaagggataggatttctgaaatagatagtattgtaatttccattttatagaggagaaaatgagactcagagagggtaagtgatttgtccaatgtcgcacatctagttagtgtcagaatcagacgttgaaatcagtttctgaaaatgtcttcctttttcattgaattgtgctggtacccatgtagaactggaaaataattcaggtacgttctggttttctctgattttcccatgttggattgcatttgaaatgggaatagagcagatggaaaaacaactttttaacttttttttttttttaagacagaatctcactctgtcacgcaggctggagtgcagtggtgcaatctcggctcactgcgacctccgcttcccaggttcaagcaattctcctgggattacaggcgtctgccatcatgcccgtctaattttttttttttttttttttttgtatttttggtagagacggggtttcactatcttggccaggctggtcttgaactcctgacctcatgatccacctgccttggcctcccaaagggccgggattacaggtgtgagccaccgcgcctggccaaaaacaactattttacactttccagaaattatatttttcctcctaaaagtgaacatgggtactctgagtgacagaaagcttaatagtaaataggaagaacatatatgttaaggcaaaggcttcaacagaaaattgtgttgagtcttttagaaataaactacattagaatcttagagttattcactctactgtgtttcacaatgaagctgtaatgaaagtgtatctgaagactgtttagatttagattgccataaaactaacaaacatcaccactgcagtaaattaaagtaccttataagcacagccacatttacaaagctaagcagacagactagagctacagtttgagcaaaattaaatccaagctgcaaggctcagttttatgtgtatgttttagagatggtattgtctttaaaatcctgtcttttttccctccagaaaattgttcttttatcatatgtctctattacataggctcagatttaatgattcttgatgataaccatctaaaaattcacttataaacacttttgaaatattaggcatgggatgtatattagggtaaggttcttgaatattactgccacccaaaaggaaacaaaactattttattttcttcttgttgattctgacacccagcaggaatatgataattttccaaaacttgcggcaaactgtcttatagtacttcgtcttgggtacattgcctcgctttttagctaagagacaaatctagttgcttctctgtcttattgttgattagctacaacttttgaaaaatgcctttactgtaccttgcaaatactttcttatggttaaaggaccactgttagaataggtgagttcctagaacttaagccaaggttcctgggaagccttatttttaagaagtaaaggcctcctattgagctggtctttcttggttcctccaccaccctaccaaaaggaaatggacacattggcttttgcaaatgaaatttgacttcaacatttgttctcagttaaaaaggaaaagatatataatgctctgtgcagctctcccactttgcttgtgccagaagaaatgcgtgtacacaggcaattcactcataatttacagctgctataatagagatgacatattgaaagctatctactataattatattgaaatacattttttgctgaaggcaaaagtgttgtaagggtcccaacccttcccaagcatctgggaacctgctttctgagttcgcagatgtcatttgaactcaccccaaatcaggcaaagcactggaaccaaggaatacactgaatgtgctcaggaccaatcaggtagcgtttggctaccagaggacttacagattgcagggggaatggagaatgggtgaaaatttaaactactgtaaaagcatatccttgtgctttttgaggtctctacattatgtgcttaggtttgctggcaaaatagcttttgcttgtaaaggattttatttttatcagattaaaaaatgctgatgttttcacattagagattgtgcagcctgtaaactcctaattccattttgctatttcttcttaatggttaagcaggacagacaaaaggatactacctgatttcatgtttcaaagcaaggatttgtcattcattgttccaagggaagagttttatttcttgttggctttcatgcctggacttttccttgcctggaaggagggtttggtttgttccctttttttccttcgagttactagtttattggctctatgtaccaattgtatttatgaccacaagctcgattaataaaattatttgttttatttaatacatttgaatactctttttttttcaacttctttggaagcagtttttgtacttattcaggcaatgagaaggcagaactatattagataaagtgtggacttgcttgcagagtaatgacataaaaatagtatgaatttcataaaattaccattttcattgtcatcagtaataactgtcatttactgagtattaattatgctgcagactctgtgcaaagaacttaacatacattatataatataatccttataaaaccctcatgagataggtccctaaaccatgtaattaggtaagaagtgttgaggtacaacagctatttcatctttgtggttgttccttaggcatattggtctcattctagttggcttagaatctttaaatgcagacttttatcccaaaacaagaaaaatttgttgatttaataagcattcagtaaatacaaaatctaccgtattcgactagagttacttgtgaggctggcgagacatttggaaaatagttgcagtacaaatttgaggggcatctactttttaaaagatatttattctttcttgtcaaaagtgggctttagaatattatgatctgtttacagttagcttttcttgatggttacaaaagaccaattcagtttttagatctgatcactgatcattataaaacttcccccaaaatcagtgcttgcccactgtctactttgcagttttacttccacaatataaacttaaaggcaaaaacgaggttgaatcttgaatccacaatgaaaaaagccccaccacaaaataaagaaaacaccgaaaactttaattttctgtgtaaaccaaatatgtacagatattgaggagacagttttgccagccaaaaatatcattaaaaagttattgagaatccaaatattttaaatcctcaattattacttggtttggatttttaaggagaaaggaaaaaatgggaaagacaaagactcataataaaaattgattgaaaatgcttttaacagatgaaatcttccatgccttatgttaactgttattgcagtgtgtgttttaaacacataaacaaaaatgcatcctaggtagttttcaacagctggattaaaagaaaaaggcttctgccagtacttctaatcagaaaattcaaggcatacttttatttcccaaatattgcaattaaccacagtatatctgtatttatattatggacattaaccagaaagcttgtaactgacagtttcacttggaaaacacaaggcaaggaaaaatttctccaaatgtctattttaatatatcttatagacatgaagtaagatatgataaatgtttgaagtgagcattctatattataaatagcatcaatgttaatatgtggttgggtggcccttccaaacaactgcaatcatttgatcattcttactgtgtttatatgtttaaaaaatgtatgccttttaaggagctaggtgatgagacagtactgtgctctgctctgaacctggtacagatgatgctgaaatgaggctgtaatttactttcactgggataaaggaaaaaaatcactttgctttaagtgtatgcatctttcttaagggtgtacccagattttaattatctaaatgtaaatagttaacgaattttacttagagtaatgagctaaagtgcacactacataaatgagttgttctaattaatcatgtatgaactactggtttaaagaaaagctatgtgaattctgtgaatgttgggctattgccaaattgctcatcagcatttgcattcatagatggcttcacttaataagttgtgagacattcagcaaatgttttagcaaattatgagtttttagatgcagacacttttttgcttttaacccttttttcttatataagtctttggctgctctttagaatccatagacaaacactcattctggagaggttaaaacccagctagacaaaaactaagacagctaatatctcaggtgtcattcacatagaagtcttgaattatttgttaagatatatgccgtgtcatagatgtatgttaccataatgagtgagctaggtttgttggaattaacagtgttacgtggcattagaaacgcttccatactctggtacagcagttttcaaacttttcagtcttaggacttagactcttaacaattattggagacttcgtaaaagcgtttgggttggtggcttacgtctataaatatttattataatagaaattaaaactagaaaaatttaaagtatttactaattattttatttattttttgagacagggtcttgctgtgtcacccaggctggagtacagtggggcgaacatggctcactgaagcctcgacctcctgggctcaagtgattctcctacctcagcctcctgagtagctgggaccacaggtgtgcatcattgtgcccagctaatttttaataatttcctgtagagatggggtctcactgttgcccaggctggtcttgtactcctgggctcaaacattcctcctgcctcggcctcttgaagggctgggattacaggtgtgaaccactgcacccagcctattttgttttattttagagacaaattctcactctgtcgctcaggctagagtgtagtgatatgatcatagctgacttcagccttgatcttctgggctcaagtgatcctcctgccccaacccccctagtagctgggaccacaggtgtgtgctaccatgcccggcttaatttttaaatttgtttattatagagatgagatcttgctgtgttgcccaggctggtcttgaactcctgggctcaagcagtactcccacttcgcccccacaaagtactagaattataggcatgagccaccatggccagccctaattaatttaaaaataacaacaagctattatatgttaacctaaataactttttttaaaaacaaaaaaccttaaaatttagtgagaagaatggccttactttttcatttttgcaaactcactatgggcttgacagaagtcagcttgagtctcatatctgcttctacagtcaactgttgtcatatggttgaaatatatgaaaagcatttgacctcacacagatatgtcattgcaaaagagaagacgttaatagccttttcagataattgtgaatactattttttgatattacaccaaaacttgacaagttatagttttgtaaaggtatgttgcaatgagaagcctgaaaccgtgtcagttaactttttgtactctgtttatttaagatcactggtctggttttcactttgaatggctcttgtacctatgtgtgcttttgtaacatcatgcgttgataatttggaaagtacaggtttactgaattatgcatatcttccaaattttgacacatttcattatataatatcaaaatatcgtatttatggatatcaactctgaactcatcagaaagtctactgggaaactgttaagcttacaatggtggatgcaagtttttcaaaattctgattttcacttgaaaactcaaattttttaattggcataattctgtcagctgttttccttggcatggaaggcttacttgtttcatttctgagagaacatctgccaaatacccaactccatataatcataatttatcatatttgttttcaagtaaaaatgatgttccatgaagaaagtgacttctgctcattacttaaccataaaagtgctctttctcaagacagtcctccttcaatgtgcaaatacaagtgcttttttgtgtgcttcccatttgacacacgcaatattaaagacatactcaaaggttgatatgtaataagatgaataattgatattgcttcatcaaggacattcctaagtcaaatgggcttttattgtgtttgtgtgaatgtatggtggtgaaaaattttaaaatatatcaaagattacctagcatagcgtttcccgaagagtttttcctagcatattggtccacaagatgccgtagagctgtgctgttgaatatggcagccactagccacttgtatctaatgagcacttgaagtctgactagtctgaactgagatgtgctgtcaatgtaaaatacacactagatttcaaagagtacaaaaaaggaatgaaatacctcattaacagtttttttgtctttctttgtttctttctttcttaattttctttcttttctttctctcactctgtcacccaggctggatgcagtggcacaatctcagctcactgcagcctctgcctcctgggctcaagtgatcctcctacctcagcctcccaagtagctgggaccacaggcgtgccaccatgtccagctaattttttatatttttggtagagacggagtttcaccatgttgcccaggccaggatattttttatatattgggttaagtgaaatatattgttgattaatttcacctaattctttgtattttattttttaatatggctactgagaatttaaaaatttaatatgtggctcacaatgtatttctattggacaggattactctagagagaaattttgtggccaaatttatttgggaaaaagttggatatgctatttctccttgaagatttattacaaatattaggataggaatactgaagagtcttacccacaaaaagtttttaagattttggttaacccagcaattcccaaacatatcatattgttggactattagttaacattctatggaactagctgtagaactatagaatttgttaatcccagttttggaatagttctacttcaattatctttgttttactgatgagaaaactgaagggtagagttggtcacattacataacttggaaattatataaacatctccttagggaaagttcaagaaaaagatatatacgtatatttattggtagggtgaccacttgtttttaatttggcataaaatcatttaaattgataatataggccaggtatggtggctcacgcctgtaatcccagcactttgggaggccaaggtgggcggatcacttgaggtcaggagttcgagaccagcctggccaacatggtaaaaccttgtctctactaaaaatacaaaaattagctgggcgcagtggcatatgcctgtaatcccagctacttggaaggctgaggcacgggaatcactcaaactcagaaggcggaggttgcagtgaaccaagatcatgccactgcactccagactgggcagcagaatgaaactgtctcaaaataataggccaggtgctatttattacaggctcatgcctataatcccagcactttgggaggctgaggcaggtagatcacttgaggtcaggagttcgagaccagcctgaccaacatggtgaaaccccatctctactaaaaatacaaaaaaaattacccgggcatggtggcacacgcctgtaatcccagctacttgggaggctgaggcaggagaatcgcttgaacttgggaggcggagattgcagtgagccaagatcgtgccattgcaccacagcctgggtaacaagagctaaactccgtctcaaaaaaaatagtaataagataaaataaattgataatatagtggggaagatcttaaatttatttttttaaatcttggtttctgccttcaacttctggttttagtctacaacattgcttaatgttttactgtgtcatatcctgggacaatgattattaaccttttaaaattatagactgagattctgaaaagaaaacaaaagcttcacagattctctcatcagaattattaatatgcacacaacttgtgtaggatttcaggaggtcattgaccttctaaacctatccattgactgcagattaagaattcttctcttatgattcagggataatgaatttatggctattaaccaacataactctcactcttgaattgtagtattaaaaagcccaccaatctgtagatgtttattaggtatgtatattgcataattctacactgaagaatcccgtaagtataatatagtgtcaccactcacaaggaatttaatatttcctatggcttaaaacatatttttgaaaaaactttacatgataagactcattttaccttaccttagaaatatttatggaaagctctataaaattttagagtaagtgaaatacacagggttcaggaaaggttagtcctctaatgagcagtaagaaaaaccatcatgtgctatatgtgagcaatgtttgggatatctctagggaagtggacattattataacttccaaacatgtcttgcattgatcagtgatttttctgtcttctcactccatcagggacacccgtgcagtaagatgcagaatttcccatcctgcatttttaagaaaaatgccagaagagactctttttcttcaggagtataaactgatgctttatttaccaggcagtactggatttcagtgtaggcccagttatacagatttataaatcaaagagaatatagatgaagttggatgcagtggcacacacctgtaatcctagcagctcaggaggctgaggtgggaggatctctttaggccaagagtttgagacaagtctgggcaacatagcaagaccctgactctaaaaaagatttaaaaattagctgggggccaggcgcagtggctcatgcctgtaatcctagcacttcgggaggctgaggcaggtggattgtctgaactcaggagtttgagatcagcctgggcaacatggtgaaaccccatctctactaaaatacaaaagaaattagccgggcgtggcggtgtgtacctgtagtcccagctactcgggaggctgaggcaggagaattgcttaaactcaggaggcggaggctgcagtgagccgagatcacaccactgcactccaacactccatcctgggcgacagagcaagactctgtctctacaaaaaaaaataataataataaaaaatacataaaaaattagctgggtatggtggcacatgcctgtcgtcacagctacttgggaagctgagatgggaggattgcttgagcccaggggcttgaggctgcaatgaactatgatcataccactgcactctagcctgggtgacacagtgagactctgaatattaggggaaacaaatgtgtgtgtgtgtgtgtgtgtgtgtgtgtgtttttgtgtatgtactgaaagagacaatgtctgaggattttttttttttttttgagacagaatcttggaatctcgctttgttgcccaggctggagtgcagtggcgcgatctcggctcactgcaagctccatcgcctgggttcacgccattctcctgcctcagcctcccgagtagctgggactacaggcacccgccaccacggtgggctaattttttgtatttttagtagagatggggtttcactgtgttagccaggatggtctcgatctcctgccctcgtgatccacccgcctcagcctcccaatgtgctgggattacaggcgtgagccaccgcgcccggcctgaggattgttaactaaaaagtttgagacccagatctgatccttattttctgttggacatcccttgaagagttgagctgctttacagagatggcttatatccactaaaggcctgcactacagctaaattataataggtcattggaatgcttggcacgcaaggccctttatgtgctaattcaaacctgaatccttttgcttctttacatattatctgtattcctatttgccattctctgaacttgcaacatactgttatttctagtacctggaattcctcctgacttccatctttatccacctttcaaagatgctacctattgtttaaagctcaatccgtgaagcctacagatgaaaatattccttccttggaacttaatatcttcctgttagtctttgcactgaattagttttttatacattttttctcaccaaaggccaggcctgcatcttgctcatttctgtgttccttatagcactggcaagagtttgaactttgtagttgttcagtaagcatttgttgattaaatgtaaaactccagagaaaataggtggtacttagtattaacaattaacatatatttttacttgtatatgggaattgatagggagcatcctcgaatgggaaaacatcattttggaactggacaggggtgggtgggaagagtagttgaatgctgtctccttgcacgtctgaccatgcacggtttcagaattcttgctgccttaactactattactaccattttacaagtgtcttagttttcattttaccctacacactgtataatgctattggtgaatgcaaatgaggtgtaaattcagatgagtgaatgtcttcgtgtgatagtagatagtttccaaaggagtgatttttttttcccattacaggcatgtaatgaatttactacacatgtgatgaaccttctccgagaacagagtagaacacgtcccatttctccaaaagagattgaaagaatggtgggcatcatccatcgaaaatttagttccattcagatgcagctcaaacaaagcacttgtgaagcagttatgattttaagatcaaggttccttgatgccaggtatgtgaagccataaatctattgcatggctttcccccgtctgtcactccttgtgtattattttctgtaaaactgaccagttggtcttagattcttttggccatatgagtcttttgtacaatggacaggtaattcaactcatggttcctgtgctgtcaagctttcctgtctgggaatggtaatgtgggttagctgccagtttagtgactcaggaaatgaataggattagtgtctctgctaatgactttaggaatatgtagcctttccattctgatgctaaaaggtatttttaaggatagttttctgcatataactgttttaacaaggggtattttgtaagaatttcttaatgttacacgggttgtgcataatatgggaaaatacttggagatactgatactcctaagaaggaagtggcatttcagttaatagcagttaccacaaaactccagaatctgtatttccaaatcaagaaagaaagcctaccatttttcctgtaaggatgaaaatttccctttatctgaagctttccccaagtttcacaggagttaggtaatatattgtatatggtaataaattgtctacagtgacctactgagtgacagaacagaagaattgtcaacgtcatagtgtacgctgcccctgtagggatgcctctcggggcattgctaaagcttatgatgaatctgcagctttggaaagaagtttctattttgtttttctttcttctcccatggaatctgacagaggtgataattatcatccaaatctcacagtattaaaggaaataactaagatagcttctcaactggaaaacaaagtgtgtggagcattttcagtgtttttcattttagctctttattttcatctcagttcctgcccatccttttgtacatgggctagcacagtacctactagtctccctgtctccagtcctactgccctccagcccatcctccatatcccttgtctgtttctataacatcaccgtgctaccatgattgctttgcttgaaaaccacagtagctttccaatgctcgatacatgcatacttcacatatacactccttaacctgacatttaaggcctgttcctgtctgcattacttctttgttgttgtgaagattttattattcttttttctattttaaaaatgccaagctcactatggaaagtttggaaaatatatggaataaaaggatgaaggataaaagttaacctcatttttattacctaaagaaaaaatcactataaatgttttacaatattctctctctttttgtttgtttgggggctttttaaaagaaatatttctgtgatgggtcaatatgcataatttggtctgctttttaaaaaatttaccatgaatacatgaacattttcatgtagtataagctctaattattaatagcattttaacaattgaagttaccaaatggatataaaataaataatgtccttagcattcccttatgcattccctatgcactccacccaggctggagtgcagtaaatgatgctatcatggctcactgcagcctcgacatcccatgctcgagtgatcttcctgcttctgcctcccgagtagctgggaggcatttgccaccatgctcggataatttttgtattttttgtagagatggtgtttcaccatgttgcccagcctggtcttgaactcctgaactcaagctatcctgcctcccaaagtgctgggattataggcaggagccaccatgcccagccaactattaattttcatataatttcttcctttcttccttccttccacaaatatttattggtactgaggatatattggtaaacaagacagattaatatacttgccccaattgagcttatattctacttgaggaaacagacagtaaacaggtgaacaaatataccataacattctatttaataatgtaattaaatgtaatagggtgataagtggtatgcagaaaaataaagcaagtcaaggggagagaaaatggagagggtactattttagatagatttttatttaaactaacattttaatgaaaatcttcattgattgaacctttttggtctttaggattatttcctaaggatcaattcttagaaatggaattattagatctgagtttgaacattttcagtgttcttatttatatatcactaaattgttctttcctgtgtttcttccaaaatgaaatgcttcatggaattatgtttctactgcttagaattccttcttttcctaagtctaaccacttacttccctggctcccacaacaaactgtctctctaagctggttaccagtaatgagtcatcatctgtgagggtatctggaatggagcccggaatggaaccagtgcttgtacttgttggatctagtgagatcttgctcatcgttccggatctggtctaaatgctcgcttttcagaaaatccaccttaatcaccctgctggactagcccttccttcccttgaacacttatactatgtttacgcaactattcagactgaaagtcatgtaggctcctttttcttgtagtttttcatgaacatttcttctctcccttagtaagccacagtgtcattgaaagcaacagccaagacttacacatttgcattccccacaattctagcaaatgacttacatgttagaggctaccaaaaataatttattgactggccagatgaatgaataattccacttaatactttgtaacagctcaaatcagggttagagaggtagcatcagacgacaaaaaacattttaaaattatttgtctaatttgagcattttaataaaaagcattatgtaacaaagatagtaaaacatgtctgatagaaagaaatattttctaacataattgctatccttatttctgctgatactttcccattcttgtcaacatgcatgcttattttttaaataactgcattcataatgtatacacctaaatgatttatttttcttccatgaagagaaagtgtattaacagcctaaagtgagcagggccagaatgagagagtggcagagcttggagcagagtctcttctcccatagagattgctgttagtaatgttgtgatgctgatggaacacaggcctggactgatgtgccactgcacactggcctgaggcatagccatttagagtgtggtgaaccctgggggagtgaaactgaggggaaatgcttaatgggcattttctacaggatgctttctaaaaaataaataacgtataagaccaagttctctcctgtgccttcaagtgaatgcaaatactgagctttggttccatctattcttgtagtgcctcccagcaagccctctgcactgagaaggcaaggggctctgctctaggcaaacatgctcagtcagatatatgattcccttgctcactctgacttcccatgctcatgtttgcttcataattggacaagacgaagcatgcaccaatgcaaaacatttaagaataaatttgtgtaggtccgtctcctcttccagtagaagtgctgtagtttggacacagccagaatgtccggtgagctattccgtttgttctctgaggtgttttgaagtttgttaaaaaccacccctgggcaaaagtgatgtgagccaaacttctctttgcttttctagatatatttctttttgatcctcctttcatacgtcgctatttcccaaagaaatgcacttgtgtcatctattcccatctaccctgggccttgctcctgggcaccaggagcttgcttacatatagtggaattgagtggagtggctgaagcagggatacagggagggacaaggagggttggagcaggcaggtgcatatctaagggggcagctatcactcagctttaacctagagctgccttctgagaacatgggcccagtactgttggtatcccaatttttcataagaagtcagaaacctagatttttatgagcaggtaattactgtgtggtctcaataaataatgtctatgggccagataatgtccataaatttgacattttcagtatctagtctagacattacccatgcacctactcatcagagtgtacctcttcaatgtgctctcacctcgggaccttgtctttcttttcaagcaacacatgactcctgcaaaaatgctaactgttcttctttttggtgcatttgtcttcgttccgttccttccctgtcttcccttaccacctccccatccagttcatcatcaaatcctgttgattttaatccccaaatacatcttgaatctcatcttcatcctctagaaaacaatagtttaaccctcctaaaaattattgaaattaagacatttcaggactaaaacctgagttgttttgatcagacctagatttcttgctcccttgactctcccttaatgttgaaatgtagatcacatacttaacctgccatatgaatgacaccattttgactagaagaatctcatagagtgcatacctatacaacagcctactgactctgtgttttctgactgtgggatatcacaattgagaagaattaagattatttggaagaaagtattaagaaaattatctggggaaggtattttctaattactggagtacttaattgaaagtgaattctgacaaatgataattttcaggctggaattctttaaaatcttaataacaaaacccaaatataaatgacatttttgctacttgaaatatgttgttaataaatgcttgatcttttgaaagtctgttacccccttcccaacaaaaacaaaagataactttttgttctctcctctttgcttagtgaaggaaatcatacctcagtccaggaagttgcttaagcagaaaaacctagaaatccttcccaatgcattttttttttcctaaacttccttctctatctccctcactcactcctcccattcaatacatcatcaggtcctattgcttttacctttcaagtagatcttgagtcttgttttcattgctctcaccttgtgccaagttactatcatcttcattttgaccagtgcaatcatctcctaaaatgggctttgcagttcctttcatgcgctcctccacctattctcagcagtcagaatgatcttttaaaaacataaaacttaaaacctttaatagtttcctattgcactcagcataaaatccaaaacttcttgtagctccactgagcttctgtaatctgccccctgcccatccttccagactcatctcacacattccctgtcttttacggtgccccaacctgctctaaccctttagacaagatatttctgtttcagaactcttcctctgcccagtcctcttccctgtaagctctctgatagaccttgtttgttctcactggatcttcattgaatatctaaaatattaggtcttcaaagaatgaagcacaatagtctgcttcatagtctggtatttttctcagtgatcctacatcttaaaatgagttggataatgccttggaggatgtctagaacataacgtataatatcacagaaataaattagaccttaaggatgtttaaaaagagaaatctacttttttggtatcatcctaattaacccatccctcttaggttaatgctgattgtaactgcaattattttctttcactcttgtcatagacggaaaaggcgtaacttcagtaaacaggccacagaaatcttgaatgaatatttttactcacacctcagcaacccctaccccagtgaagaagccaaagaggagctggccaagaaatgcagcatcacagtgtcacaggtgagaaaggacccatgggtctgtcttgttccctgtggagacaggaacctcattccttcctcagggcattattatcaaatttcatatccaaatgttctatcatcaaaaaagatataaggaaaatgtagatatttccacagttttaggcaagattttaaaccttagataattttgaaaaactgtaagtggcgaagaatcaagaccaccaccacccccattccccagtgtaaatcttctctagagaggacataaacatgccatggggagagacgcagtttacacttaagtgactctccagtaaatggcatgtattcctggtttccctgatttagatgactgacctaagcttctaccagcaagaaaccaatttatttgttgccaaaaggaaatttaatataactctttggtgaaagctttgaggaattcaccaggccctttcttggtaacatactacaatgtttgaatcccaaggatttctttgcttccttattatccattaaacacaagaattaaattcatgctttcagggtttctgattttggggtttttaaaaaaatgtttatttataataatttctgaccctgaagttagttgtcatcttctaacaaaaatacatttagttttagtcagatagactggtatttggactgaggattggaaacaaataaattaacaaacaagtgtacctctttagaacataaatatatcgtattagcattacctctaaaatacaattttgtataaatgttcatattattgttaatagattgacatttgaagagcatttctttatagcatgcaaaagcagtagtttaccaaccagtttttgtagtgaaacttaaggaaaaactgacgcttgtcaaaaatttcagtgttcgctaggggtcacatgaaaccacttttaaaagtagtttctaaataaatacttgtactgtagataaagttcaagatactaaagatccctttcaagttccaatgagggtctcatatcagtgtatgaagtcattgttatttgagggaatagggcctgggtgtaagatgatttccagctcctcttttggcattattttctgtagaaactcaagagcaaactttgattcataactaaggtttcattcaaggtttattgtcatttctcttatgaaatggtatatcttgatttctttttacgcagttagaaatggaatataattgatttggattaccagcttacatagacatatattatataaaacattactaactgggttactcacttccatatgaaatatggaggaataatatgatatgccgggttagccacagaagacaaaattaaaagaagaatcgtttcaagtaggattttatgacgaatgccttttccctgaacattagtgaaaggattaggttcatgccgaacaccggatgatgatgccacgcctggttttcctgttctcacaaccactctctgacttagaatttgaatgtttgtggatgagtttaagcattttcttgctgccactcttttttaaaaaacaattctatagtatatgcaccattagagaataaaacagattaatatcatctatttcaaaaacaatagaatctggagttttcattagctgtagtacttcacactttgtgtgtagtgtagagtgtgctcaatacacacttgtggaataagtgataaaaaggtttccttctggctgttctgaactagggagttttaacttctaaaataggctaggaacccacttaccagtgtgttttttttaaaaaaaacagttaattattaaatttatttcacttgttttctatggaaaaatagctttattatgttttgaattttttttttagcaattgctgagaaaaaggtacagaggtagaaataatatagatatagctctgttaccctgtctaaaaagcaaactttctgaccttgtttcttccaggtcagcctttcaaacacagaatttcagaaataagttatgcttataaattaatggccttttgtttaagtttttaaaaagtgaaagcaaagaatttctgttctaggcctgacaggtcaactgcttttgctttttcttttttaaagacagggtctcgctctgtcacacaggctggagtgcagggatatgttatcacagctcactgtaactttgaactcctgggctcaagcaatcctcctgcctcagcctcctgagtagctaggactacaggcacgccaccacacccagctgatttttaaattttttgtacagacagggattcaccctgttgtccaagctggtctcgaactcctggcctcaagtgatcctccagcctcagcctcccaaagtgctgggattacaggcatgaaccactacacttggctaactactttcaaaagagaaaaaatattgtttaaaatgtaaatcatactgaaatacaattaaatttagaatctagaaattgttcatagagaaaaccaactttaaaaatattgaagccccctgaaaacaggcaactggaataacactatttttactagatttagaatatatgaaactctgatctattatttactgcaactgcttataataataatagggaaacttcagaagaagtgtaaggcaatatctttagtgctgtgagggcaggctagaattccttaaacaggacataaaatgtgtaaggaacaaaagagaagactgatagattcagtggtagaacttttgtttatcaaagtacttaataaagactgaaaacatcaacatgatacaactattcagtaaagatgggatcagatataattatcaatagatattaaatctagaggaaaatttagatgaagaacatggtcttaaagtgtctctccatagaccatttaaagttacaagagatttaaaaaaaaagtaatagtagagtggagaaatgggacaaaaacttgaccaagtgattggaatcaacatcaccaaggaggagcagacggacattgggtgtagtatttcatccaagaacataacctgagtctaatcacaagacaacaccagccaaatcccaaatgaggaatgttctattgaagacaaaagcggggaaggagcattgttctttaaaaacgtccaagaaaggccagggaaatgttctagattaaaagaagctaaagagataggacaagtaattgcaatactttaccctagactggattctgtactgtggggaaaaccataccataaaagatattattgggttaaatttactgaaataaattgtaattgataattgtactatggttatgtgagagaatctctttagacttaggaaatatacactgactgacttaggggtaaaggaccatgatgagtataacttagcctcagatgttcagaaaaaaaaaatgtgtgtttgcatgtatatgtgtgcnnnnnnnnnnnnnnnnnnnnccaaagtgctgggattacaggcgtgagccaccatacctggcctatattatcaatttaaatgattttatgccaaattaaaaacaagtggtcaccctaccaataaatatacgtatatatctttttcttgaactttccctaaggagatgtttatataatttccaagttatgtaatgtgaccaactctacccttcagttttctcatcagtaaaacaaagataattgaagtagaactattccaaaactgggattaacaaattctatagttctacagctagttccatagaatgttaactaatagtccaacaatatgatatgtttgggaattgctgggttaaccaaaatcttaaaaactttttgtgggtaagactcttcagtattcctatcctaatatttgtaataaatcttcaaggagaaatagcatatcacacacacagagcatgagtgcccacaaagataaaacaaatggggaaaaataataataggggaagggcatatacaaatattctttatgctatttttattgttgcagcttttttcacatttgaaattattttcaaataaaatattttctaaactgtagaaacagtccacgcactgcaagaagatatttacaagtgtataagcaacagaggattaaaatccaaaatatataaggaactcctataaattaataagaaaagacaaagaaccgatttcaaaaataggcaaaagagtcaaacaaggatttcatggaagaaaaaatagaaatggtcaattgtatgaaaagatccccattcttattaggaatcaggaaaatatgattaaaaattgcagtatttttatatttcaaacttatatttcctagattggcacattctgctaccaagaatgtgtagcagtaggagcccttataatattggtggtagggatgtaaattgatatagccactttggaaaacttctgacattattttataaatttgaacatgcatataccattcaacccacaatttctagaagacctcttgtctgtatttcaggaaacactggtaagaacattcatagtaacattgtttgaaatggcaaaaaatttgaaacaaaccatttgtccacggactggagaaatggataaatatgctgtgttataatcccacaatggagcactattcagcaatggaaaaagaatgatctacaagtatcaattcatgttgagtgaaaaatgcaaattggagaatacacgtaacataacatttttaggaagtttaaaaccaagcaagctaaacagcatattgtcaggggagacatatatgtggttaaacataaaggaaagaaaggcaatgataaaattaaaaaagggccgggtgtggtggctcacgcctgtaatcccagcactttgggaggccaggagtttgagaccagcctgaccaacatggagaaaccccgtctctactaaaaatacaaaaagtagccgagtgtgatggtgcatgcatgtaatcccacctattcgggaggctgaggcaggagaattgcttgaatccaggaggtggaagttgtggggtgagccaagatcgtgccattgcactccagcctgggcaacaagagcaaaactccgtctcaaaaaaaaaaaagaagaaaaagaatccaatgagatgggatcaagaaggaacaatcaaggagtttcagtattactaacagtctttcttaattttagtggcaggtttacagagattaatttaattattatgcattacaaacctgcatatataaggcaaggaagtctcatgtcagttattaaatctaagtaacagaatttaaaaagactgtttccattcgtttaataaacatttattgaataatgctgattatgtgccaaatactgtgctagggatgaaagagacatcagtgaacttaaccagacagacccatgtcctacctgatagaaatgtgtacacatactcaccaaaagatatgtataggaatatccttagtaacagtattcgtaatagccaaaactagaaacaatgcaaacgtccatcaagaggaaaataggtaaaccagtatggtatatttatgtatatttggaatgttatttaacaatgagaatgaatgaactataactatatgtaactacataatgctaagtaaaagaagtgcttgatttcatttataaaaaatggaaaaacttgatttcatttataaaaaatagaaaaacaagagaaattaaccttgggggttagaaatcagattaatagttatttttgggggaatggtgattggaaggaggaagaactatttcttgatctaagtgttagttccatgggtatgttcactttatgaaaattcattaaactctatacctatgatgtgtggcccttttttgtatatttttattttatttgactaaaaagtttactttcataacaaaaacaagcctgccttcatggaacttacatttttgtgggagtatacatataagtaaacaagacagtcagttacaaagtgatagttgctcttgacaaatgaaggagggaagtggttagaggatgcaatttttaatagggtggtaaagaaagcccctcctgaggaagtatcttttggttagtttgaaggagatgaaggacaagtcatgtggataatcagtgaggaacattctagcagagggaacagcaagtacggaggccctgaggtagaagtgccctgagcaagggagcaagtagtaggagatgaagttaaagatgctggggaccaaataaatggttcatgggccttctaggccatggtgatgacttgggctttcactgtgagatggggaactgaggagtgacatggatctgacttaagttttataggatcaccatggcagctgtactgacattagaccctgggaggcaagggaaagcagagctatcagttggggtacacttgagtgttcacttaattgagtatttgtgatagaaatgatgagatgtgactgggttctggataaattgtgaaggtacagggtttcctgataggttggatgtagaatgtgtgagaaagagatttgctaaaccagaatttgaaatttctgatttcttgacttgctttgattaagtaagcaaaagggagttcctcttttacctaacaccctgaaaattgacaaaagaagaaactatttcacatgtcatatgcattgagaatcatacttaaattgtcacatactcttaattagtagagcagatattaatttactttttggaatagagctaatttacattgattattcaagttactaagctgtaaaaaacttcatcgttctcctaattccaattttgaatttgagtaactggctgtattttctctgctaggtgtttttagaatgaaaaatgttaacttattcttcatttctactgtagttgaaatgtactgtaaagaaaggattgatttaaaaacaaaaatgagaaccagaaatggtatttattcactcaaccaacatattttagagctcttaaagaggcaaataagacctgcttttataatagtctaatataaataacatcacaatctaacccatacagatgaggaaactgaagttcagagaagttaagtgatttgacaagggtcacaagccttagtgagtaggggacttggggatttttacacagatattcttaataaaaggggagaaactgaagtcttactttttttcttgcaagaggcagtgtgattcattcatccccagggcccaggctgcagagtgctggtttgtgaggcacggaccttggataatatcactagggctgcatcattttcccgctaagctactttagagactctgggctagttagtagtctgaggtctctttactcattaaactacttattccaaagcagtgaatattcagtaagctaattaaaatttgtaagtaagatttccttattaaaaaaactattaaaataagaagaagcccgttaaaataataattagagcaggaaaaaagaagatgactatcaaattacagtactttttttcagctatacataaaggccttttcagttgctttggcagtagacagaaggcagaagtagattcctactgcaagtatgcagttggtaaaccagaaacaagttgaaggaaaaggcagctattttgttaaaacggttctttcacatgtcttaaaagaagactacagaccctctgttctaaaagctctgattgtgtatcccagtggaggtgggacatcattaaacagtgcgcagagaataaaagagcaggttgtaaaaaatgggagctttgaggatgctatagcatgaagtacagatgaggcatatctgcaagatttaaagaaaacagggaagcttccgatttttttgttgctgttgttctctacaaacaatcagcaccatgattggtgtggtgcttaaagcttgctccagtgatgtcaggtattatatttattttagaattgactattttgaggaaatctctaacactcagttgatacgatacccaaacaaggataaagagacaattttcaggctgggcacagtggctcacacctgtaatcccagtgctttgggaggctgaggcgggtggatcgcctgagctcaggagttcaagaccacctgggcaacctcgtctctactaaaatacaaaaaattagccgggcgtggtggcacacgcctgtagtcccagctactcgggaggctgagggatgagaatcacttgagcctagaggtggaggttgcagtgagccaagatcatgccattgcactccagcttgggctgcagagtgagactgtctcaaaaaaaaaaaaaaaaaaaaaaagaaaggagagagaatttgcagcttagatttagggtttttgagtttccctatacctggaagaagtcataatcagaactgtggttcctccatttttgtcccctttgccttcttttacctattccttctcttcttctttccaattgagtattcttatcagtttttctcatgctagtctcagcactgtgtctaacctttccgctgccttgcttccatgaggcgtttgaggctaataggccaatatataagccagggtcccagcagaaaacagatgtcacactcaaactggaataattggaggacactttataagtgaggtaaaatgacttgctcaaggtcactaagcaagtgactatttacaatagtgtgggcagagtgtagggaaaccacaaaggataatactagtgattggttctgttacccacttggcctgaagagatgagggaagggtcagtagatctcaagacagaggaggtgtgtggagaaggccagtgactgagacctgaaaaaaggcagccttatagtgcaggagtcaggggaacaaatactgtgacctcactcttctcccttcccatctgccgccagtgcctactattggccagaagcctgagggcacccagggcagcctcctggggcccatgacagggtagagagtggatagggaggagtgaacagaagatagacaatgtagtccaaagggtgaagatacctggtcagaacaggcgccttgctcaagcctcctggcttcccacttctgttgattctgtgatgtttgcatccagaaaccttctccagagatgctcttgggctttccttgtttcttctcttttgatttctctcccaattcttctgtcagctatgtggagaacacatttttctaaaataagtgtgggttttgagagtagaaactacagtttaaataagttaatttgatctagccaaaggtacttaccaggatttttggctattttcttaatttgctcaataggtacttagtgcctactatatgtcaggcactatgcctggaactgtggcaaagaaaggtcagtaagatagggttcttctccccaagaaatactgaatttgttgggggaaacagacagatgtgttactgacagaatataaaagttacctgaagaagcacacaggcacaaatggatgccatgtgtggaatatagtacaaagaggggtttactttctattgagaggatcaggaaagaccttctagagaagatgatgtgtagaacctggagaaggatgaataagactttgggagaaaggatattctaagcagaggaaactcagaagcaaaaaacagatatgttaggagaacagtttaataagtctggagcctgtgttattatgtggggggtgggggattttattataagacttaaggctacagactgtgaagactcagacaagcctgaactaaaaccccaactcctccccagtttattagctcagtgaccttgggcaagtcattttacctcactgtgcctccttttctcaagtgtgtagttgggataaaaatagcatgtactggctgggcatggtggctcacacctgtaatcccagcactttgggaagctgaggcgggcggattgcttgaggtcaggagttcaataccagtctggccaacatggtgaaaccctctctctactaaaaatacaaaaaattagctgggcatggtggcgcatgccggtggttctagctactcaggaggctgaggcaggagaattgcttgaatccaggaggcggagtttgcagtgagccgagattatgccagtgcactccagcctgggcagaagagtgaggctctgtctcaaaaagaaaaaaaaaaaaatagcatgtacttcctagggttgtgggagtttcagtaagataaagcacgtgtaaagcacctagcagagtgcctatcacagagtaagtgaagatataatagtaattattgttacgcagtttctcctgcttggaattgtttatccctgccccctgccaaacacatagagatgtcttattaatttctactccttcaaagctcacttcaaatgtcagctcttcaagaaggctttccttgatacctctagttcctatcctccattgtatattctcataacttcttttccccatgattgtaactgaacaatgatttgttaaatgctgttcccctgatagatggtaaactcgattttggccagaactgctatcttattcacccttatattctcaaggcctagcacagtgtgtccagcacatagacatttactgaagatgatgatattattaactgatacaggaaacacataaggaaaagctgttttgatggaggggacattaaagcttggcagcagttatgctaggttcacattgccttcagatctgttgggaaatgttcagtttggaaatataactcagaagaaaggtcaaggttaaagatacagcttggaggtcattcacttaagttcctagttgaggccctgggaatggatgaagttgcccagggaacctgcagataataagaaaataaggctgggggaaacgacatttccctgattccattgccaattctaaggtaatagttaagaggctgagaatttaagcagggctttagacccctttacttttcaggggtaaaaaggtatgaattggtgtctagacctgctaagggatgcttcctctttccctttgctttgggttaggacttaaactgcttagggctacatcttagcagtgagtgcatcagaaatagaccctaatggaagatctgctattctgccttagaataccttattccttgacattggattgctgctattcataggtgcttggagaaatcaaatacaaaatttttttttggagaaagatagcagcatcctaggcttcaagttgtttctataaacaaaacaaaacaaaaacaaacaaaaaactgggcacacaatcacagaaagaaacagatatacaagacaaaatgacaatgtttctggtacagaaaccagcagaaacaacagacaatagaaacagactcacaacagtataggaaataaaggaatctgatatggactataaaataactatgcttaatatctataatgggggaaagacaaactggacaattctgtcagggaattggaaaccataaaaaaagggtcaaataaaaatgttagaatcaaaattaagaacccagtggattgggttaaaagcagattagacattgctgaaaggaaaatcagtggactggaagaagagtcccaagaaaataatgatattgaagaatacagagacaataggatagaaaaattgggagacagagaataggagacatagaggatacagtaagaaagtctaatataaatgtgattgagccccagaagcaaatgtgagaatgggtcagaagcagtattttaaatgtaatggctgaaaactttccaaaacccatagcaaattccaagccctagactcatgaagaacaccagtccccaaacagaataaataaataggaatccacactaaacatggttgaaacaaaagcagctagagggaaaagtaagtctgcctccaataaaacaacaattcagtgaccactgatttcttaactgaaacaataaagacataatacaatggagtgatatctttaaagtgatgaatcaaattaaatgtccgcctagaattctgtacctgccaaaaatgtcctttgatagtggaggtgaaataaagacattttcagtcaaaaattgaaataatttttctcattttctctctaaaggaaatacaaaaaatgtgttttcagacagaaataaaaagattacagatacaggggaggagatacaggaaggagtagaaaagcaaagaaaaggataaatatgtatgtaaatctaagtgaataatactgtttaaaataaagataatgtcttattttgcttacagtatgtatagaattaaaatacacaacaataatgccttataagttatgagaggagagtaagtgttctaagactcttacgttttccgggaaagatggcaaaagtaccaattagtgaaaaagtaccaattaatgttagaattgaatagttgagaaagtataaatctctagggtagttacttaaagaaaagtaaagcatatatagctttcaaactaataaagagagacagagacatagaataattttttttaaaataagcagtctaaaagatggcaaggaaaaaagagaaaatgcatagtaagtgggacaaataggaagtaaataggaagtacttagtaagatgataggtttatacctaaatatgtcagtaatcacattaaagtaaatgaatttaatactctaagtaatagagtcaggatttacaaatgaaacttagttatgtgttctctaagagacatatgtaaaatataaggacatagaaagtataacagtatgaaaaaatttaaacaatagccaaaagaaagtttgtgttgatctaataatatcagattaagagcacttcaaggaagctcaaaaaacataaagcaaaacttacacaatttcaaagaaaaatagacaaattcaaaatcattataagagattttcacacttttctgtaactgaacaagcagacacatacatataagtcagtaaggacatagaacagtgcttcttaaactgtagcatacataaataagaatgatctggagagctgttagaatatagatttctgggccccattcccagaggttctgattcaaagtgtctgcagtggggctggcaatttacagctcccagattaatgctgatgctgatggttctggaactacactttggagtagcacagatatagaagattttaacaccacaattagcagacttgacctaatggacatacatagaaacactacatccaacaactgcagaatacacattctaattttaagcacttatagaacaatttgaaagttgactatattctgggacataaagtacttctcagtaaataaattttaaacagtttaaaacagagtatgttttctgactacagtggaatcaaactagaaatgacaaacagataactagaaagtaacagataaccaaataaaattccatatgtttagaaattaagcaatataacccttgggttaatgaagaaatcacaatagaaattagaaaataactgaatgacagtgaaacgataacataccaaaactcatgggatacagctaaagccatgtttagaaagaaatttatagctttatatataatatatacatgaatgtgtatgtggtgtgtgtatgtatgtatatactgtacatatctgtatatatgtgcaggtatatacgtgtgtgtgtgtgtgtgtatatatatatatatacatgcacacagtaggtccatttctaagaatttaatctacaaacacattatctatgtacaatgtttcttgctccagtctttataatagcaaaagactgataattcaattcaatctctgcctcctgggctcaagtgatcctcccaactcagcctcccaagtagctaggactacagacatgagccaccatgcctggctaatttttgtattttttgtagagatggggtttcaccacattgccctggctggtcttaaactcctaagctcaagcaatcttcctgcctctcaaagtgctggaattacaggcatgagccaccgcacccatccagtgctgtcctttcctatcatgtattttgataaactggtactttaacttcagatgactgtacgttctgtgtaggaaggcagagaagtcactcagactctgctccagcactatttagtaacagtgtgaccttgagcaaattatttaatgagtccattttttatctataaaatgagaataatgataatttgctcaggggattcaggggttaatgaaatcatgtatgaagagtgcctagtacagggcctggcatctcaggaatgttcattaaatgccagttgtcatccattcaacctacattttcttgccgggcatacagagtcttgtaaaggatccaaaagaaagagggagcaaaggttctgacatccagccaactagcgtggtaagtattcacaggctccctgaaggtatgagccagggaggggcatgagggtgtgtctgttcttagtctctgatggacctatactgtgtgtatatatatatagtattctttactccaaaaatgcatgagattcatttttgatgagaattaattatatatgttgaaagcttactatgctttttgaggataggtatacccactttaacaattaaatgaaagttttctggatttttgaaaagaaaagaagactgcagtgggtatgtggtaaggagtagtggttgaataaataagcgtttcccttaaacaagaggcgtgactataggatttcttttcataggacactgaatgcatgttgatgttcttatttacagggattagatttacgtgaaacttgtcaggacaaaaagtctggcccatcattatttggagtgctctgtgcattcattctgggatgcggctgtgttgcctgggagatggctccacctttcagtgtagctgatgggaggcatttccacagttgtggtgtcagtgtttcaaaatctgtcaaagaggctctccatagagcctaggaaggaaaactattgagttgtatacctaccacatttttttttctaatgagaaaaataattttaaagaaaaaaaaactcttaactgtaaatgttgtctgtggtaatttagaggcacccctcagcacgtgttttagggagctgaacagtgtcatccattttctatgtactgtggccgcaaggctgacgttttatacacttttgcagatgaacctctttgtgaatgtcatgagcagttatcagtctatcatgcagagtagaaagggcaaagctgaactgtaagggcgtcagcacattatggcaataaaatttttcacagcctcagataaaaaaatactgtacttgacaagtgaatctgttttaaattatttcaaatgctatggaaactgaatttctatttgttcggttctcccattaaaagtgggatgttttccaaaagttggttttcaagtcagttgttataaatttgcaacttcttttttttttttttttgagactgagtcttgctctgttgcccaggctggaggtgcagtggcctgattttggctcactgcaacctccacctcccaggttctcccacagttctcctgcctcagcctcctgagtagctgggactacaggtatgcaccaccatgcctggctaatttttgtatttttagtagagacggggtttcaccatgttggccaggctggtctcaaactcctgacctcaggtgatccacccacttctgcttcccaaagtgttgggattacaggtgtgagccactgcgcctggccaaatttgcaacttattttcttagaagagaaaaaaaattgtgtggattcttgggctagcccacattttaaccatgaaggagctgaaatattttgcattgaaaaggtagaatataggtttgtagacctcaccacttaatacaatgaaaaagaaatgaaattgagtaaagaataattttcgaaacttgttttaagtattaagagaaaacaagttttatcaggtaagacataatgaaacgggctttgtaaccttaggcaagttacataaactttctgacctcagtttttgcttcagtagaattgggtttttgtaacagttaaatgagataatacatgcaaagttcctagtacagagctgactcataatgagccctttgcaaatggctactgtttaaatacaggcacaagtggcattggaattcaagtttcctgcaaattctaggtccagtgcattgtcctgcttagttggggcagggatgagaagggatagaggtagtgccgtcaggtacttgtgcagaacaatagcccagcaggagtgtggcagacaggcgctcttggtcttctgtggtaggaattttattctggtcaggtatgcaggagttcacctccttttcccttcttgctgctgcctgttccctcttgccagtgtctcaccagcactgggagcagggatcagcttgcccagaacttgaagctcctgggaaaaggggtcctgaccttaggcactgtaggaagcaagcatggtgtgtatgccattggccttcagagggttttgttgttgctgatttgttttaagaaaaggggaaactaacatttactgagtgcctggtacatccctggcacagtcctatatatttaacatgccatctcatttaatgttcacaacagccccatgagaaggagatatcattatcccaccttgtagaccaggaaaggagaaccttagatggcatgacttgtgtaaggtaacataggcaggaaattgcagagccaagatttacacacaggtccgtttggctctcaaacccatttatccagctgtcctctgagttcttagaggaatgcacacagtgtgtgtatccagcgtgcccagcctttctgtccttatagaaactgtatcaaacccataccttctggagggagaagactggtgtgaaatttagaatttattaacaccattaactttaaaaaattgaacagtatctggcttccatccctcacttcaaattgaatcacataatggggatgaaaacattgattagggagaaactgtttgttagaggtaaaattgtttaccatgtaaatatgctgccatgttccattatacatgacttagcatttcaacatttcataatctgttacatttaattaggcacagtacataaagtatgcatcacaagtaaacatggggaaacacaatggaaaatttttctaagatttgtgcttcataaattttcagtttgttaatttcaataatgatgttttagtgtcagctgcttctttccaaacaagtgcagatcctctccctgacgcagtttatgcacagaagcaacaccaaggatgaactacaaagttctgcacttctgcctcttggaggcggcctttaagtaataatttttctcttttatttaatgttgttattaacacggtcaataaatgtagtgacaaagtttgaaacataagatacaattaaagctaattaataaattggctttcagtgactgtagagacattatagatggtttagctttttattttgaacatggagtttttcttaaatgcaaagctgcttgggaaatttcagtggcttgagatttataaagtgtttgattttaattattttaagaattctcaaacctatcaaccatgcccttcagataagagtacaggaatgggattggtcactcgtatagctctgggtcccagcacaaggcctggcacttaaactcataaagattgttaagtgactctccagtgctttttctgttgtttttaatttattcattaaaatgtatatttttctaatttaaaaaatcctaatgcttgctgatctgaaaacaatttggatgatacctgaaaacacaagaaacacaaaaacagaaattacttctaaaccccactgtacatgatagtcacatgttagtacatttttcctgtgcttgtgtatatacctacatctatgtatgtcagtgtttgagtatttttaccaaaataaaaaaaaaaagactcatggtgtatgaaaagaaaaaaatgccctttcttccttttttatagtctataatgaatattttccccttgatttgtcagtgaatatttcccctcaacatgatctttaataaatgatcatattccattatacaaagatgtgctataaatttaatctctctctctctctttctattaataagtaggactaaggggccaggcatggtggggcagtaggactgaggggccagcactttgggagataggtggatcacttcagctcaggagttcaagaataccctgggcaatatagcaaaaccctgtttctacaaaatacataaaaattagccggccgtagtgatgggcacctgtagtcgcagctactcaggaggctgaggtgggaggatctcttgagcctgggaggttgaggctgtggtgagccgtgattgtgccactgcacttcagcctgcgcaacagagcgagaccctgtctcaaaaaaaaaaaaagtaggactgtggtggatatctttgtacatttatctgtaaatattttctcaagataagttttagtaatctgggcaaagggtatgctaatgtttgctggcttactctccagaaaggttatgctaaataataagtaaactgtatctacctcccttaggtttatttctttaatctgaacttaaaagattctatagctgacagatttgttgtttgtgtagctacaaaaggtcactgtgacacatggaagttgttacccgaatgagtcctgtttttagcccaaaaaaagtctttacgcataacccagtatgaggggttcccatgctgtgctcacatagagaagttaaaatgtaaccagagttagcctgaacacttaaggcagcactctgcaaacttggggggacgcatactgtacagaggagctgaaggttttccaaagaggactcaggtatgcacggtttcatggttttcactggccagctttccttacgtatatgtgtacgccttcctaaatccacctgccccagaaagtggctgtgatggaagcattgtgttggttttcttttcccttcctgcccttttcttactttatgaaagaaagggatactcccacctggttcattgccccgaggtatgagaccctcttgggtgcccaacaagagacattatgaaatattggtgataaccaaacctcctttaatcagcactgtacaaccaccccactcccaattaagaaatgcatgtatgatgaaacctacatttgatggtcaaaataagtatatttttatttatcaaaataagtatttgtattgctttgattagttttaaactaactataatgatggtttagtccagaaggaaatattaaatatgtagagccttataattacaggaaataaaaacaattttaaattttcaatttccatatattccttttgtagagcataaaagtatattgcattaggctaatatgggagagaaatgaactagaaatacactttcaagaacaaaaagaagagcataaaattttagacttgaagagcaagtttatgtttttttgtttgtttgttttgagacagagtctcactctgttgacaggctggagtgcagtggcgcaatcttggctcactgcagtctctgcctcccgggttcaagcgattcccctgccccagcctcctgagtagctgggactacaggcgtgcaccaccacgcccggctaattttttgtattttagtagtagagacaaggtttcaccatattggccaggatggtctcaatctcctgacctcgtgatccgcccgcctcggcctcccaaagtgctgggattacaggggtgagccaccatgcctggcctatgtattttttaaatggataatgggtatcaaactgctgtgctatttatatttggttggatacattttaaagaatagtgttacagttttattttaagatgtcaacatttatgacatactggaataacactgtttacaactatgtagacttatgaaaaattgtagatgccaacttagaaaatgtacaaggaaggaaaaatgtgtgagagggtccatgattttttaaaattaatttagggggaattttgcacagcaaaaatgtgcagaccaatgaccctggacaggcacatggatgggagggcagcctcactggaaccctttctgaactccactgctatagatctcaggctccgtttcagctctgtcccctgcactcagcagcaacacctggggagaacctgcgagccccccttcaggctttcccttgcccagagcttctcccgcttcctcttcctcagccagaacccaccagcccttcaggtgccttgctcctgctcctccccaggtaccaatgccttccccatctcactgcccgctccttccccaacagaaatgttctctcagatgctacctttcctctcctttttctgtagaataggtttctcttccctctgtcactataaaaagggggtttagaggttaagaagggaaaagggaattaagttacagaagagatcaaaagtttctgggatctcggagtggtccagggagagggaggcaggcttgcatttttggcttatttgtggccacacaagctattggagttttctgcttctgaattgtggagtttcaataaaagcactatggaattgaattggattgaaacggaggtcccgttcaagtttgaccttgcctcagaagcctcctctgatttctcagacctgctgggatatctcttcctccaaatcctgttgcttttagagtctccgctctacggttcagcatgagatcatcaccatcttgcaagttttgctaattattttgagtggatagcattgcttttataaccagattgtaaagtccaggcaggcaggggccatgtgtttattttttcatttccccacagcacctggtacagtattgactatagcagatgctcggtaagcatttcgcagttggttatttaaaaaagaaaagctgacggggcgtcctggggctgaattctagatccatcccactttgcatcccactttgggcaacttgtctgtggcctggatctctcgtttcttccttgataaaacatgagtgatagtaatagctaatagttaccaggtaaatggtatgtgccaaagccattaatgcacccaacagttctgtgaggaagatactactatttatattgttattctcattttataggaaaggaaacactaaaataactaaaacaatctgtccaaagtcactcagcttagtaaatagcagagcgtgaatttgaaaccggattctgagtccaaagcacgtaaccattatgtgatacttcccacatctgactcaactccctccaagtcagagattctaaggagataatgagtaaaagctttttgaagaaggtaaaaaagctaggtaaaaggtgaatctagttattgtattatgtggaaagcatttttacttttaaaagcaattgtcaatctatagctgaattgcgtgggggaaatacacggttgtagtgtatgcgagagaccagatccctttcaggctgctccttggccttgcagaaaagttccagaaaatcagcggactgcataatgtgcactactcattcccctaatcaccagaggcttggtctggtggctgataacaatgaacatcagtagaagagggagagtacttgtgcttttattctcatttttaattgatcttaaaattcttccatggccctttgccttgggcacaatccagagtcatgaatccttgatatgcggctcaacagagaggcacaggacagcgtagtccctttcccttcaccagtttcctgcctgcctttctattctgggaccactgtacagaccattccagttcagagatggagcaagctctgctcgccttcatgcactgcgcatgcagcctggccccactgtgagctctgtgcaggaggggccccatgacctgcagcctttgaggcttcctactgggtgagcttagggcttcttttgcaactaattatatccatctgtttttaaaaggtgaaaaaaaaatcctgaatttaggtgtcgattgatacattaattaccccatctcagttgcagcagtgtggtcttaatagctgattgctgcaatacccaaatctgtaatatcagaatgtgatgtgcatattttaatttgagaaatagtttaacatttttagatattcatttagatgtggttatgcaggttaaacataacgaatgatcactgcttctttcattgcttccaattaaaccttgcttgttagtttaacctctaggtaatcccatcaaacaattgatgtcaaggaaacagtgcccacagtagcttcggatgagtggccattaattttaattgccttgatattaaagattaagaagtattgggactagcagaataaaaacgatctgatgtcaagcaaatccacttgctaaagcttccccaggctgctggtgatattaaaattttactgtgagaattaaataaacctttattagtgatgactgttgtttgattggtccaggggtatgcataaacagaggattcttacatatctagagatgagaccttcaatggtacagagattcctcaattatgaaactgttaataaagctgtaatctgattttccaggctaggtttcattaatgtattatagcttctctgattgtcaaggtaatattaactacaaagtactgaatccaacagagaattgtttggaagaagagaattctaagatgggcctttgttgctaaattcagagttggggaattttcattaattatgcttaagaaataccaaattccctctcaaccaagactatcctcctttgcactatagatatgttcaatatttaactctttctaaggcctgacagtcttagtcagaaacgctagagtgataattatgtattaaaagagctttttgcaagccaactctaggtctgtctcctgagctgagagcatgcattgggaaacatgaggtaaggtcaaagagaacatgctttaagaagcataatcagaacccatacctttatagtccttttccaatcttgatttagaacttttctgtttttagaatcacataattctggtatggattctaatggtcactgaggatttgtcctggtgcagaaattcctcccaaatatctgtctccatcctgctcaaggcctgggcaccacacctgcatcgtctctggcttgtccctctccactgacctccagagctagtcagtggccagattctgtctgttcctcctccataatatgtgccctctccactcctactgctctgcctggctcaggccctcatggcttcctcgcttatatactctcctaacttcctcctgttgccacatcctatgcagttataatgcacacctgctgtgagcatatggggctcaaggaagggagggccaagaaggctaatagtaggatggagaggtcccttggggctgagcctgaaggcctaatgttgtgatagtctagatgttggaagtaggaccaatatgtggaagggaaagggaaccagattgtagttcagaataaagagaactatatacccattaggactatccaacaatggaggcggggatattgtgaggtagtgagtaccacatctctggagatggagagatcaggaccacaaagaaaatatagaggaggtggcacaggcttagaggacacccgacttcctcttagacccattgaattggaagttgtggcagaacatttatatggaaatctctttaaaaatgagaactcactataaatctgggagtcatccacacagagaggatatttgaaattttgaatatggataaggttgctctaggtgcaagagagaagaaggccaagagctgagtcctggagaaaactcactgtcttcctctctctctctctgtctgtctctctcatgtatcagggaagagcagatgttggaggagaaggagtataatgtcacatacaccatgtaagagcctgctctaggcaagaggggtggtaattacaagtatcagatactgctgagaggtcagactagtcagagagacaaggccattggatttgggactggtgtcatgccagtataaccactcccatctaccacctagcccttgaaattgttcacattaaaatgagaaaatgtctgcaaggtgctctgcataatggtcattcaccaaatgatagttattagagctactgtatttgatatgaagaaaagaagggatacatacagtcttctagggggaaaaaatgatggtagaacagaaacagctaggaagcgctgatctgtagcacatttacttcctgatgggctttggcttgtttctgtctgacgaacctatgctcatggttgctgcatgggtcctcggcaagtatgcctgcatgtgtatatgtgcacatgtgtgcactccataatccccaggatggacagcatatgggcagcagcaaggccaatgttgtcttcctcacatggctcccttgccagggctctctgctccttccagaaggatgagtgccataggttgaagaatgggaattctatttccaaagcaattaaagacttggcagagatggtcaaaaagggtgcccacagtgtaaattgggttggaaggcttcaaactacatactactccttacgtctcttcagggcccctatgaatagctgttaagtataataccttcagggtagaacagtgaccccacccagcctgatatcacagcaatatgcccctttgacaggattattaagaaattattgaaaagtatttttaaactgttgctttaataaaagagaggtcagatccttttatatagtgtgtgggtatactttcttataaattgccatgtggcttttagcttctttatatagctcaattacaggtgcctgaatacattgtaactctgagccatgattctggggctgagctctgctctccttgacgtgtgatgaaatctgcctattgccaagatcctttgtagaaatctctcttccatttgcaccggctgacatcataagaagtttgcaaaagaaagaaatatattccacctgatgacattagagttgctcctctgtgtttacatttgacctggttggaattacttgagttttcaagttgtgaccttcccacatgttaactggcagagcttgagcagccatcttggcagacatgcagtattttctgaggcaaaagacaaagggttttttcatccattattaattgatgttactcttttcagcagaccaaacatgattctactatacagctgccaaaattgttctagacccaaaaaagaagaataagtcgttcatgttcaagtatttcttattatttacctaacttagcaaatatttccttcagcttttcagcctgattttgggggcctgactatttatatactaatcggtatatagcagttggatatcttttatgagcagcgctccctgccgttttggtattactgtggccaactctaagaaagcagcgttattccaaaagaatgtgagagttttgccaaaagagaaaataacccccaaaaccattatgcatgatccataggatgtgaggttgcaggctaggaattgtgtgtctcccaaggtattgccttggtgtccagcaggtattattggaatttgattacttcttcctctcttccccttcacctccatgtccctgcaatttgtaggtatccaattggtttggcaacaaacgaatcaggtacaagaagaacattggcaagtttcaggaagaagccaacctctatgctgcaaagacggccgtgacagctgcacacgcagtagcagcagctgtgcagaacaaccagaccaattcgcccaccacaccaaattccggtgcgtactgggggctcgctccccaactggcccaggcagccttatgccacaatgccctgtcccacaggccaggaaacaagagccatactgaggacagagtggacttaaaaaggaagatttatgttcaaatgcaggcttgttcttgagatgggtgaatgagtggaaggtcagagcctgtaaacccactcttcacagtgaatgccactcactagtagattatggaagttttacaattagtagtggctttcagttcagtaattaggcagagtgctatcgctcatgactattttagctatttctttccagataccactttagggtcagtagtggtctgtggagagtgaaatagcagaagtgggaaatgcagcagttgctgtgtgtgaggaagctggaatgctggagggaagtgcagcagtgctttctgcccagcgccgctgtcctttctctgcctttcagcagcactgtctgagcggggctgacggcatgctcagcaggtggctagctgtgagggttatggtgcttaatacatgcatgcaagattcttggatcctcgtccggtacattttggctgcattttatgtgacgtttgtgagggggttagaaatactttaaaatttcagggaacttgaataacaatgaaagatgtgcagctagtccaaacagatggacttcagtagcaattccaggggcttttctgagaaggtctcttagctatatctttagaagttcagaaagtaggggggtttttgtttgttttgtcttgtctcctcaccccccagttctttttaatggcacataaaaacagatgaaaggagagggaggtatatgcatagcgaagaaagagctcctggaaaagtctcttctctgggtggctgtccactgtgacagccatgttgacaagctcgtgtaatgactaaatcctggagatgagtggaaacaaggggaagggtccaggccagctgctgggtgttttggtttattttttctttttaatttattttgatttgtctctttgtttttgcttttgttttttaagtttgggcttccccactgatgggacttctcctagatgtggagtgactcacaggacccaactctctggagttactctccatcctcttagatctggaaatgctttatgttgtgcacagcctttcccttctgtactttttctcctctccctgcctctaggtctttgaggattatgtgtgtagctctctgttattcagctacttaactctttcctttccaggttcttctggttcttttaacctcccaaattctggggacatgttcatgaacatgcagagtctgaatggggattcttaccaagggtcccaagtcggagccaatgtgcaatcacaggtaggagaaatgccccagtggggcctttctagcagggtagggtttgggctcaaaactccttcctctgaccccatggaagtggtctacacatccatgcagaacctgtgctgggtgcttccaaccaggacccatctgccccaccatttaatttaatgagaagtcaagtgaacagtgacttgtgatgattcacacctgataaactttgtgaatgcattcggctctggcttgagctcatggagaggggttgggtgcatcttacttttgtcacaaaatagaacagaaaaattgagtgtgccagtgtgtatatggtttaagaacatgttgctgtttcatttcttaagtcagagtacaaaaacctgagttcttaaattataactctataatttctactcttttcttgtcctcttatttgagaacagaactattcatatagtttttatacatctagatgtgtgtgtatgagacatagagaaagtgagagaaagagagttgagataattccatatacacaattctaagtaggctttcacccacagccacatccatttggttgctgtagatggaaagttgcattgccatgaagatgttattgtttggctggcatgaaaaacaaagatttgtgagtttaaatatgcaaagaatggttgaaattctgccagtcacatttgattgataaatttgtctttcattgaagatgttaaacccttgtggcacacataattcaaattatttccttttgtaagtgatgacgttttaatagatttgggatgatgaattttgttttgtctcacttctaggtggataccctccgtcatgttatcaatcagacgggaggctacagtgatggccttggaggaaattcactgtacagtccacataatttaaatgtgagtactctggggagtcagctgtaggagaacagtgtcaggtaaacagtgactaataaagaaattaatagccatttgacctggcttctcatcttcttggcaggtagggaaggcagcgtctttgctgcacttttattttaagaacctaaatgcttgatgccgtctagatacccttagaagtcctcatagatgcccagaaatggctggtgtcctgtcatcagcagggacttaagcatcagcccattaagacgccatttcctaccatcagtgctgtgctccagggagacggtagaaaacaggtcatttatcttagaaccaggcagcgggaaaaattcccaaacagaactcaggtgaaggtggtaagtttggagaatcccaggcagaccagcaaaccaagctaaacaaataattgtgttattaaaagcatcttgctgtattgtcaatgtgggatgcacaacatatttgacaattttaattatggaggaaataattttaacttttgtaactacttcactacaactttacctttccctccactgacatggatggaaaatggcaaaacacacagctctggaaaagggggaagggggcaggggagcaggtcatcgtggtggtgctgcggggtgtggtggatggagtctggggttctagacttaggaaggaaattaactgcccagctcacggtagtagactcaggaagaaaatgggcaaaattcttcctttttagggccttggcttgctacgagagtaaatattaatgatttaaaaagtgattgaggatgttcaattgtaaagggaaaaaaggaccattaaatactcaaatctttacatttgaaatgtcaaatctttctttttgggcttataaataactcataataacccacaacaaaccatataaaaagccttttagttgcatttctcctttttcatttaagtgttttgaaatgcttcagagaatgtgcgatatccttatcaacatgataaaatatgaaactgtgattgcctgcagcattttacagacatgaattccatcttcactgatgaggcttgataaggcgctgttgtataatacagtgcataatctcaaaccaccagagtaaggattaatttattttgaaaaaaaagaatgcttgctgacaacctctcctccagctgccatgctgggtaaaaatattgtacatttgttgtttataaatttggataaaagaggaatgatgtttacttcagatggaatatctttagacttgtatctgtgtgagagtttttcttttcctaagtagattttcatacctgaggggggaaacagcttaccttttagagaagaggatttctgagagtccaccgaacacacatgggcatgtcattagccaacctggcaaaacagaggctttaaaacaataccaccatagcttttttttttttttaaatactgtttccttttgtttttcctaacctgaatttgatatgcctcaagcctggaaaatcctcttcccttagggtctggtcatctctgtggggttcttaggtcatagaggtagaaaaggtgctttgcatgccaactctgcagtgaattagaagacagggagttctccaggaactgtgatcacagaagaagaaacaatggctgccacatgctcatctaggagctgtatctaggctgggcagggaatctagacaagagttctcagcagcctggcagcccaggcctgaaagagggcattttggatggacttgcagaggaagttgcaaatagatgtgagggaggcaggaggcaccttatgacccaccctgacattggtgtaggaggtccgggtctgggggcagcatggcggcagagggtggttggtgctgcaggcacggggagcctgctcaccctcacctcctctccagaaaggcctgccccatcacttccactcagtgttccccaactcacgaggctggcacctccctcttcctgactgacataaaaatatgtagcgacaagctgtctgccacagcagaaatctgatcagacattgatttcagcaattgccactataggccaagacataaggcaaatttgtttctgagtacggttattgctgctgcaggtctgaggcaggaagggccagcagcatgtggaaggtgggagcaacatcccaaataggagcctcagccacagataattggaatacagattttaacagtgtgtgctgctctgcggctcatgcattttcattctggaagatcctatttggagggaaattctggccttcactttccaagggttacagtagctggctgtcaggcgtgtatggaaaaagggtgggcaactgcttctctatggaaatgatgattaagccggggtgaagtttagacttcatggagccctgggtttcgctgaggcattgcattgagcttctccactgctcccttctgaagagatttctttttgagtcactttagttttaccagcagatcaaaggccgagctcgatgccagcatgggcctcgctgaagcccttcttcggcgtgttgatttattgccaagactttacttgatgggatggatttgttttacatgcatttaatcccactttaacacatgctgccaactcctgccacagtgggtttagaaaatacattttgctaatgcatctctgctctcatgttgtcatccgggtgttttaaattggggagtagaattaatatgtagacgtgcacccgttgaactgtgtttctcctttcaggctaatggaggctggcaggacgcaacaactccatcttctgtgacttctcctacagaaggcccaggaagtgtgcactcggatacctctaactaatctctggccacacttttccctgagctacatgccttgataagtgcattcagagcaataggaggaaaaggaaagcgtttttgtagcccaccatctacagctttactgtaaaaccttgtcttattcgagaacttggtaaatctgttttttaaggaatcataatcatttgtatttatacttaaaaacacacaatgttaaaaaaaaataaagcactttatccaattaggccaagatttaacattgttgacagtcctgtagctattttatcataatttattatcaatattttacattaatggtttcacagttgccaattacttggccttaagggtaaaaagtacaatatacactaaacctcaaccgttaaagcagatgcaaaaattcacctcacctaaattgaacttcttgcatatttccattactgacttggattgtctttctttcatatcactaatggagttggaataaagagctgtttgcctatccctgttaatgatggttgtgtttaagaatcttcctcgtcacgtttgtgttcagatctcttatgttataattagatcagagactggtagcatcgtttctctctctgaaagcaccagtgcccagagtctgctcggtaataaaattatggatccagattgttctgagagacgaagatacttgctgctgatagaggtgaaaacgagattgatccgtctggggttttacggtgtgcactgggtgctgcacagacttgtcaaggtttgctacgtcctctgggcatctgcaaaaggccctgctctctggagtgttgtatatagtgtagcaaaagagtatttatacatcccaccaatcaaaacacagctttattacctcatgcgaactcatacaaaccaatagaatttcaacatgttctgtagcttagagtgctcacttactacctctgaacaatactcacgctgtagtttgtctctttcttatctttttgcatcttgtaattaactctttgtttcccttcataaaatgtaatgtacattgtaatcttttaaaagaaaaatcagggttgcacttgcaacttttaaaaaaccgagtgtggaaacattgggtcttaattcaacacaggatcggtaaaactgttgtaaatactgagaaacattttgaatgttcttcatcttattactaatccatgcaaaaaaaaaaaaaaaagcagcgactaattgtgatgcattcagatttcagtattcagtactgtatatttcaccctgtgtaatggggccccctctcctttctctctttttgtattgtatgcgattctgaaactgattgagtcatgaaaataatttgtggcggtgattctaatgtattaaaaacgtttcgtgttcctttctaactggattacaccctggattgaaaaagtcttcctcgtggtagttatatgtagtttcaaacatgaataaactttttgctttcatgattaaattttgatgcagtttcttacttcactatttgagccagccaagtgcagacagaggagaaagtgcacccagcaccaagcctgggagtgtaacagcctcctgtcagagaccactctgagatgacggtgaggctgggagggaaggaacagctgctgttgagtgtgcaggcaccgtgccacctactgaaccattgttaggagtcctcacttgatcctgatgtgctcagtaacaccgcaaggaaaactccccattttcatagattaggaaactgaagctcagaaaacttaagtgaatgccaaaaggtcacagacctaggacagcaaggggtcacaccttgaacccaggtctttctgccctcagctcacactctcctgacctagtgatgcctttggcacttgttagatggattttttttttttttttcttgagatgcagtctcactcactgcagcgtaaaactcctgggctcaagcggtcttcctgcctcagcttcctgagtggctaggactacaggtgtacaccaccatgcctggctaatttttcttttttgtagagacgtggcttgctatgttgcctaggctggtctgaaactcctggcctcaggcaatcctccgaccttggcctcctggagctctgggattacaggtgtgagccactggacctgattgaaaagatttttttttaagttcacttatttttcttttttagagatggattctgactgtgttgtccaggctggtcttgaacttctgggctcgagcaattctcctgccttggcttcccaaagtgttgggattaccggtgtgagccactgcgtctggcatacatttgcttcttcacctttaacttctttacagttaaagactaacaaaagtttggaaagaatggacctcagatgccgttgaaaaaacaatccctgcaatattcaacatacctttttaaactctaaatttgtaatcttctaagaccaattaaaaatcttttaactggatttaacatgttttcttcaaattgttagaaattccatatgtttacatatacatctgtcgctaatatctaaatctttataataaaagaggtcaatggcaggtaattggcctgtttactatatctcaaggaaactgacccacaggaaatcagattaatgttaattagttgcagcaaattgtctatgatagatataactgtttgactctttcagttggtaaagccaggcaaaacaaggtctagggccaccattcccattaatctccaggcagttacactgtgagggtaaactttataaaatagattgccctccaaagccgtcctccctcacttggtgctcagcctgcctgtaggaattgctcccatggctaaatagttatttgcatgattcaattagcttgtgggtcagcctttctcatctttgtaaataaaacaatatatgctatgtggttttgcaaaaatatactgtgggaacataatacatatgcacacccagattcatctttaacattccaaagcagacacttcctcagaaccgccttgagtctcaccttggaccagtgtgtggagagaagcacacgccagtgcttataggagattcacacgttgactagcaacccctgagggaattgtgggtgtctctgttatcctagggaggccgaaatgaaaatagcaatgctcttcctacgtgctgtgttaggaagcatgtgcacgttttctctcttcactc

SEQ ID NO: 15606 - DNA, 96739 bp, Human
  misc_feature (1)...(96739): n = A,T,C or G
gcatggtggctcacgcctgtaatcccagcattttgggaggccaaggcaggcagatcacgaggtcaggagatcgagaccatcctggcgaacacggtgaaaccccgtctctactaaaaatacaaaaaattagccgggcatggtggcgggcgcctatagtcccagctactcgggaggctgaggcaggagaatggcgtgagcccaggaggcagagcttgcggtgagctgagatgatcgggccactgtactccagcctgggcaacagagtgaggctccgtctcaaaaaaaaaaaaaattactacatgatactaagtaatgcggaaggtgactcaaagggggaaaggaacacagcagtgtaaaggaaggaggttgtagatggatctagaatttccccctcatttccatcaggtgaaagcctgagaaaactgcaatctttgtgcaggctgggtttgctttgtacacactggtcccctagtgttcatctccaataatgctgacaactctgaaaaccatctgtagacattctgcaggctccatctcaggaacaatggctattttttcgggtagttgaagcaaaattaagtccaatgataagcaaatataaccattatcaaaatcttccatttatgtttgttaaagcaacctaagtatgatctgagaaggactctgtattctatatttgagtccttgtggatgaactgtaacctagcttaataggcagacaagattgaaaacctaatttaggagtatgtgcctttaacaatagctgagtcttggccaatcccagtggccatacttcaaccattcatacactgctgagtgttcaaactgtgttcaaagaaggcaaaagccaacctgtaaccaatccagttgtttctctgccttacctccaatttctgtatgtcacttccctttttttgtctataaatatgttctgaccatgaggcatccctggagtctctgaatccgctgtgattctggaagctgccccattcgcaaatcattcattactcaattaaactgctttaaatttaattctgctgaagttttcttttaacaggtttagaaaaaataatggcaaaaatgaatgaaaatccaataaccctggaagcagaaaaggctgggggctccaataagtgtaaatagtcccatccctatattttctccatggcaattacaatccagcacattatatatatatttttttgcttctcgcattttggcttagggtaaagctttttaaaacaggcactgccaaccagtgttatcaagaaggtctggatgccgttttgtgggaacattttaaagaggaatgtccaaaaggaaaagggggatgggttgggagaagggtatcaggcgggtatctcaaaaccattcttagggctataggtttaatttatttggttgtggacgtcagagccgtcatggtaagaaggaagcaaagccttttgtaataattaaagccttcagaagcagcgtgccccattgcccactagtgcgccgtgaagtctggtgttcacctacagggtccctctcagcactgcccaggcctcccgagtgctccagcacagtagcttggagcttgttggtttggtgaccaagatacactccagggaatatgccatgcagtggagtctcttccccggcactgcatagcaaaaggaaagggccgctgggtgtctgtgggtcctgggcagtcacagaagccaccgcgctggcggggaggagggggaccgatgcggtccatgtcccgggcagccccaccttctctgcctgcgaagggcccttgtccggcgggaggagagaggcgcgccccacccgggctcctctacacctgccgccgcctgggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtgggttccgccagcttcgctcctgaacctacccgcgctcgggatccagaagctgcgccgggagagaggggctcaggcctgggcggaggggacggaggtcagaccgtgcggaaagtgacccgggcaccccagggcgcccaggcccccagggagcgcggaaagtgcggtcgcggcccggccctcgggagacgcgggattgggatcaggcacagcgcgaggaagtcgatcttggagctagaacattttcctttggccatttacacgaatccactggaaaatgccgcagtgtttatcaaagttactcaaagtagaaatgtccagacgtcttatgagcttagacaaatcttttactacaaaaagaaacagcagttgcattcaaacaacaacccttctgaaccactactaaaatttagcataattactcttgtggatacattttcattgtcaagtaatttacttagccaatgaacttggagagcaagaaagttttatgtagtaaaatgtaaatttgagttaagagttaagggtgtttctttttgtctgtttgtctgtttttggcaatgtggctccaaaaccttaagcccacctaaaaactatataaatgcaatccattcttttgttggaatgttcaaggactagaaagacaattggagaagtgagagtttgaatctttttttacgttggaaacagtgttgcaaaatattttttgagttttgcctgacttagcaaagattcagtcgaactcaagtagagttcaaagcattgcagcgtgtagtaaaaaaaaaaaaaaaaaaaaaaaaaagagttgaagatgttgtgccatatctgattcttggtattaaaaataaaaaaaggaaccatttaatccctaagagttcctggaagaaatggaattgattctaccatctgacttctttgtcttagtagggacaaattcattgccttcacacaggcagcattttaattaaatgcaactaaatacattgatgtcctccttctccccagtgaaagtccgagcagtgcatagatagaattatattttctcaaaaaggcttaaatacatgtaaattattaagtgttttaagtgagaaatctttgtcagttgaaattattttatcaaatcatttttgttctgaacggcacttttgttttaacgtatttagaaaactcttgcattaaaacagaaattgatttgtattatcccctgtatttgaagtgcactttaaagtgtatttgaatgagagattataatcaaattacttgatttgtgtcttatcctcttactcttctaccttggatttgaaaaggttggatttgaacactaggaaaaaagagatttttctactgagggattgtgggaagatttttttttaagcctctgtatttgaagtgaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagacgtattttggaattcaagctttttcagaatttggaattaaaatttagaatctaaatttcagaactgagaaagacattgctcagaatttagaaaggtaaacatacatgttgaccctgctggttacatgccattccaatatagtctggagagaatcctgtaattccatgcattaatatttctgtacttttacatttaagaacatgaatattctcactaagtggaataaataaagactataaagagctgtgtgtctgtttagagcaggtgttatcactacgagagcttctctaagacttaccaaaaaaaaaaaaagtgttgtttttcagagctttttagagctgcagctgagggactgagtctgtattagactccactgaactacggtttgcttttaaaaggaaagtgcatttatgttgttcaatacttcacactttccagtaattagaagggcagttcctctctctttagggagtcttaaatagcaagattttactgaattttcaatcataccgatcaaaatagaggtacttcaagtaagagtggatgtctcatctttgtaatataatttcaaacagcatagtttctgacagtctaccattttagagaaacagagcagaagttacttacaggaggggttactgtcaccctttacagctgcagtctgtccatggaagaaatattatttcctgttaactttgcaaccagctgggtttgtgtcagttatctaagcctaagtgatggctaatttttactttctcaactttccctgtatagatttttttccagctaccccctgacttttctactcttgctttgctggttttaacattttccactacttctggattggtttagctataactgggtggagaaaacaacaacaacaacaggaatttaggcctttggggaagaatttgttttgttttagaagtctacacattgagcattactttttcttctaaagcaactaaaatcagaaggcagagtcctaatgagagattatgatcaaattgcctcatttgtgtcttatcaccttcctcttctacttagatttgaacaggttggatttgaatactaggaaaaaagggttttctactgagggattgtgggaagatgttttaagaactagtctgattggattttaggaaagttcattcattttgatatgatgttatcagggacattttctatttgcttataattttatctgaccaatattagcttgtatcaatttgaggtttttttttcctttatgaatcaattgtgcaaggtttgccctacatctcttaaaaggtggttaaactggaatcttaaagacagttgaatttagccaagaccaaagatatgcaaagaaagaatattttgtttatgttacagtacatttaataaatccaaatggctcccttgattcttttctttctgggacaccacgtattgatttctggcagctggccaaaggcagatggtggtggagcaagcgaggacagttaagaatgttgatgattactggattactgaggagtactgtgagctttctggtcctctgctcagaggtgtctagctctgaaactgggatcctggctctgagctggagaggcgcttccagttactgctgtcctggagcgctggaagggagcataagtgtgaggagacagtgggcttttagcctgggatgcagatgagagatgtcttgacctgagtgaaaaccttgcaggcaagctgcaggtctaccgagcagggtgagggaggctctcgacctggatactgtgaactagggagagaaagtaaattcaacagaaggagggcccagggcagagatttaggaatatccacagtttaaatattgctttacttaagtatactctgcctgactataagtagcatttgaatgttcaacatatgacctttcatttctcccctccattggtttgtcttaactgataaatctttattttcccatggtcaacctggtagtttattaatattacatctatcagttcctgttgagttgacatgaaaatgttttggtgtgacctaagttaatttctctttttgtttaattttaatttgtaatgagttcctcttttcattctgcccatcctttggtactgctttgagttatgtcctctagaattctcactatttccttatgattggcatattttcaaagttttttggtgtactaattttaaacagtgtttgttgacactgagaattcaggactttggagttttagaccaccatcaccttctactccttctcacaccatcccaggataattattctctcatttgagattaagaagttatttggtttattttattatggttatataaatatagtttactgctaaagcaaggtatatcattccattttctatctcgtacccctttttgctcttcctggggtaaacccttgctttgtttttgtgttttcttagtttgcactgtgcctattatcatttccttcccaactttctgacataaagatgaaagccctattgacacaattttctacagtgtcagatataccaagtaatctcacggttccatttttctttctttttttctagaaccctccatcttcttcttgtctaacagttgctcttcagtcttgctatacatacagtaatacctgaagaatgtttggaggatatttggtgtgggatttttcttttttttttttctttttcttttttgtagagatgggctctcgctatattgcccaggctagtctcaaactcctgggcccaagcaatcctcttgcctcagcctcccaaagtgctgggattataggcatgatccactgtgcccagccctatggggaatatttgttgactaaatatgttttatgtaaattgcttatcatactctttgttgtaacatctgtggcattaatatgcctcttgttaacactcacctacattttacctgttgtaaatccactgtcataattattgaaaatatttctccagagctttttaattctatggttatttatttattgtagtatagaacttttatgatttcttccatcagggtgcattctgaatcatgcttagtgagagatggtttttaactccactttaacagttagcatctatgttttacatcagtgtcaatgtcacttttgtattatatacgacaccaacattttattatctgagtgatgagaatgtttatttttgtggaaatggagatctcatgagactttaagcagattgctggccttctcctcgatttccttgattgattcctgaagtggaactgcagtgctaagtggaattccctgggaagcttgctcaagtaagtaagcatgagaaatgctgaatgaaataaagtgcagcaagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccacagcctctttgggaaaccatgcatgacctcttgctgctccttaccaagctccttaggctttgcttggtagaggcagaatgttgtggttgttttcatcttaaatgctaacaatatatgaattatgtggtggatacactgcctcaaagtgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgcccccagtcccactgttggggagcagttggagctctaacctctcttctttcgtcctgtgcattcatgtgtgcatgtgtgcacgtcttcagaagatataatggtgggctgtgtatgtcttcttaatacctttatcactctggaactttctttttattaatatgttggggtgcggggaggtctccatattcagtgattattgtaatttttatgacagtccagaataggcatgtcgattttttttaatttttgatattataaacagtgctgcaatgaatgcactttttcttttcattctttccctctcctttgccatttgcactgtgttttcatgaaaccatcaggttaatctttatctcaaggaagcccttcatccctgtccatcctgttcttcagtccatccacttagttttcctatgattattttagcaagcaggtggttaatttccaaggaatgtagttacttctttgggatttttttaagtgatgtattagttttctgtgtattttattacttgtttgagtgcaccattacccccgtctcccggggtatcagttcatctgcttgcatgcttggtgcctctctctcctgctgtcagctttcctgatgtgctgggtatttccacgtgtgtgttggtttttttttttttttaggtaccctaggcattagtcttttaaggctgcattcttgcagcctgtcccacatgagataggaggagggcaagacctggatgtgcacagggcaggatgggcccataactggtctgtgtggtgtgtgggtggcaggaactccctgttctttgtgggtatggccatgccttccctattcaaacgaagccacacacctgtcttttcctgcgaggcgtcttctgctgctttcttggagctggggagcatctactcttcccttgtcctcccgctcctccctgttcctccctcaggtctctgtcgcttctaaggcactccacccttggtcttctcccaccttgcaccccccacactgctgcctgcctgcacagggggactgtgattgcccccttcagtgtgagcctgacctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttggttaacaacaccaatcagctgatggtcatggctacgtgaaggaactcacagtgagggctcaggaagagcctggctagagcaggctgcatcgcaggccttggcgttaggttccccaaatcactgctggtgatcttgtagctctgtcatgaagtctgtcctgcttattaggataccgagggtccaaattcatagattcttagaagcctgtttaaatatgcagagtatctaattcaacccgattagaaacgggctcagaaaggtgaagggatttgtccaaccactgagtgatgctgctgggattagaactctcaaaactaggtgtttctaatccagaaccagaatccctatccactactctaataaggcgtaaaagaggatctgctgtcctgcctaattggtgggcaggtttggagtcctgtcagcagctcaggaaagcctggagaggcagagggaggacacaggctcagtgtcagacatgccaattttactcatcaccaatggttacacaaaacttgttttgatctttgtggcttttgcattgagaagttaagcatatacaataggaattagacacaatcccaaaccaatgagagactcaagtgagaagagctgaagcttttatgcatgccttccttccatagagataaatttactatccagagtgaactagagcctcgtggaaagtgagtgccgagcccctagctgtgagtgtctctgtccttcccacatcagacctccatgtctgtggctgtccccctacggggcagaactgctgctctctgcttgtgttgctgtcgtgagggttgggagtggacaggtgtggacagatctcagacccgtttccctcctgttatggaaatgtttgtgaggcaggtgggacttcaatgatttggtcaaggaaaggcagcttggcagctggggagaagggctcaggctagaaaggcaagcgtttgtgagggatgatttccccaaagaagccagcagtgtgtaaggtattccccggagcttgtttcttctcagaagactctggaagctgtgtcagtgtctgttatggaggaatggagtatcagtccgatcaggctttcataacaaagcaccacatactgaacggcttgaacagcccaatgtgtcgcctcccaactctgagccaaagagactgaggtcaggatgtcccagggtggctccttccaagggttgggtgggacaatgtgcccccagcatctccttggcttgtgggtgaccatctccagctccacatggcatgctccctgtgtgcctgtctctgggtccagatctccttttcatgtaaggacaccagtcatgttggagtagggctcaccctaaggacttcaatggggcgtaatcactgctgtaaagaccctgtctttaaataaggtcacactcagaggggttagggagttaggacatcaacatttgaacttgggggacacaattcaacctgtaacaaatgtgtgagtgaagactggcacctccccacgatggcctttctgtgatgccatcaagagcaccagggagctctccagatatggagatggacagatgtctaaggcccctgaaatgagcctgctgtacagatgattccagaactctgtcagtgtgaagaccaaacacaattaagcacattaaaatacttacggtaaagtgtttctttcactttagatgtgcaaaaacttaaagagagagagacttatgagaagactcagggaagaaatgtaagataaaggtgttaagggagacaaactccacaaaattgtaaagtgaagctgctgtggggagtagagcccagacccagataatatgcaggcatgggtccaagggaggctttgcacaccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaaacatcaatagctttaatatgcagcgagttttttcaaatcaataagaaaaaagacacagatgggtgctgacagggccgtttggtaatatcttttaaaatttaaaacacaagtgctttcactcaacaacttcacttttaggaacctatcacacatataaattgacaaaagtggagaaatattcattgcaacattttattttataatagcaaaaaaaaatcactaagggaagtacagttgattcatatgttggaatcctatgcagtcttctaaaaaatgtggaatttatttcatacaccaaatataacaatgtccaagttctactagtgaaaaagcaagatgtaacatatcattgtatttgtttaaaaaactcatgctgggttgggtgcaatgactcatgcctgtaattccagcactttgggaagccaaggtgggtggattgcttgagctcaggagtttgaagccagcctgggcaatatggcaaaaccccacctctatgacaaataccaaaaaaaaaaaaaactagcctggactggtggtgtgcacctgtagtcccagctacatgggggcgctgaggtggggggatcacttgagtccaagaggtcaaggctgcagtgagctgagatcatgccactgcacaccagcctgggtgacagagcaagaccctgtctcaaaaataagtgaaaaaaaaaaaaaagcctaaaaatctcccacatgcacataataatttaagtgatattggattgtcgtttactacttatatgtgcatttctgcctatacatattctatccagtgtgtacacatgtgtatgtaaatatgtagcatgatctggaagtgtaagcaccaaattaagaacagcagtttttagggggaggggaatagaattggtttagagaaaaaggtgaaattaacatttttattctgcctacttcagtgtgcctgcagtatttacaatgatcaggagtgtgtacttttttcaatttagaaaaatgataataataaggtttgcttggggggaaagggtaagtaggatgagaccaggaagagaagtaacttagaaacacatcatgcatcatgactgctggcaccattctgtcctccaatgaagagcgaggctttgagaggttcagcagctcacccaaaggtgtacagccatggtctcaaacatgcttgcaccctgctgtcactcaggtcctgaagcccaggccacctccaaggacactggggtgctctggggtgcagcctgccttcagatgtttcttaaagccactcctactccaccccacccagtgcaggagccaagattgaggaccaccatttgacagctagttcataggatttcatagcacacaaacacatctttaaaggctgatgaggtttccaccaaattgggatttattggtatgctgggtataatggcagctgtgtgtgcctttgactgcaaagacactgggcaggccagagtggctcctccccatttgatatgtgtgtgtgtgtgtgtgtgtgtgtgtgtgtgtgtgtgtgagattgagagagagagggctcgtgtttttctgttgcgaacagtcctttccacgggaacttatattctcctaaggtttgccactctgcagaacttttggaggaaggctttagagtgagaatgtcagtgcattctcagcgtgcaactgtaagacttgcaggaggtgaatgcacatgaaataattctcagaggaagaatatgtgcactggtcagataggaaaactgacctgtaacattttctacacaagaggatttgaatggttttcgtctttaagatttttttttaacattatgcttagtccaccatgctttattctgtcagaccatttgtcatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgctacctccccaccccagccacctccatcagcactgtgccatactcgcccagaagagcccctggactcatcgcctgcccccatgtttacacttgttaataaaatctctagaattgtggcttagacctgtaaacatccagttccaagaagtggctctaaagccctctctgggggcagagtggttgtcagaagcagaccaggcctcggggtctagattccatccttcactggaactgctgggggctggtagtaccccatctgcaaaatgaggttaaaaatacctaacccttgggttgctatcaagctcagagatgctgtatgcaaagcaccaatcagactggctcacaaagaataggccctctgtcaaatgttcatggttgagtgcgggatgtcaaggataaatagctactggttaccagggaattgaagacagggttcttttacaagcaaaaagattttataagagggtcacagaaacagagtgactcttgcccaacagtatcataagcaaataagctgtgtctagatcctaatcatgtgtttagggctctgctgggtttaataagcaacacatagggggtgcgttgtcctccactctcacatccccagtcactagacaaggtcactcccccggggggcatcttactcagaagctctaaaagactttgttgcatgactttggcccttgctcttttaaaatgtccagttagagaccatggcatggagagttttgtatactctgctcccagcatggcaccctctttgcatattgtgggcactcttaaagttatttctcatattgtaatatatcagatatgacttggatatagtcaactagatatttagtgaaaaatgtatcacccccattatcaaaagaaaacccaaagccttcaagtttggcccaactagaaggaatttctggaagggggaagtaccaggaccacacagactctggtcctggcggtgtgtttataagatgcagctcatcatgttggtctctgtcatccctgctaaggctgttcattatggaaccactggccacatgtggccactgaccgctcaattacttaaaaccatttaaaataaatgttgaatttcatttaaaatttaaaattcagttctcagtcacacaggccaggtgtcagggaccagttgccacacgtgggtggaaggtgtgtgtcaggcagagtagaacaggtatttccattgctgtagcaaggtctgccagacaccaagctgctctcagcccatcccctgaggagcccagaagggatatgaacttccacccacctctcccctttcccagttctcagtgccactccttgcctaagtgcacggtaacactcgccactatttcatgtgttgatacctgcagctcccaattttcttaagaggatctgaccctgggaactgatgagggcaccaggagtgccctctcctttgacatgagaccttgagtcttgtccatggggccctggcctggcccttttcatccccaaggctgtaacattctcctgcacaacacaacacacgtgcacacacacacacacacacacacacacacaaaataatgttacttctcagtcacccgggaactgacatggttcccagttatttccttgcagcagccctccaagcggtaacacagccttggagaaagctactaagtcatgtatccttggggtaagcacacttggttcagaatagtttctgaaagaacaaaccaggtttttgctcaagagggttttgagggactggagaaaaccttagtgcttgttcctttctcttcggttaaaaaaaaaaaatccaacatagtttccttgaaacatttggaacctgaggttttgtccattttgaaaagaagatgtagagaggtaacgtgtttctcacgaaggcaaaacaaaaaaataagatgccaagcaagtggcccttgtaccttcaagaccaagaaataaggcgtttgtttctgggaatgccttccatttgctcattttgtaagtaatcaaggcaggctgagaggggagccttctgaggcaccccagtgagcagaggtggggtcctgccactggcccctcggctccaaccttgcctcactccaggcgctggggcagagatgtgtggttggcctgtctctggagttcctgtgctgcttaatttgagtagagataaaaggccacaagagaagtcgttttgaagggtttgtgaattataggacttcctttcatgattcagcctgactccaggaagtgcagtcacgtgctgccctcctaggggagcttcgccccaccaccagcactcaggctccacttactgcaaaaggcgcgatcaagattcttcttcctgaattattgtcttaacaaaattgatacgtctaaacattgagttaacactttcattcactaaaaatgttttcctgaatgatgcttttcatgtgacttctttatagtcccacgtgaaaaggggaatgtgctcggctctgtgcttgttcccctctgtttgggagcctgcgctgctgctcacttctgcagtcagctctgtttggatcagttttgaaccccagaaccttccacatagaggtgataattctagataattctagagcaactgcttctctatctggctgtatgctaagctctctagagagctttacaagggagagattctgagtgttagggctgggaaaagagcactctgtgtgatcctaacctgcagctgaaatgcagaaccactgttctcagctggagcttttcattgttttttgtttgtttgttttgttttgttttgttttgcttgtgaattgagcttactaatggaagcaggagcttgttctgtttagcgatcgtgagaaccacctaggcagcggagcctgcccttagaatctgcttcactgggctgtactgggctgggcattggcaattttaggacacatctagatgtgtcccaagcaatctgatattttgatgtttatcttacagagaagcatgtgtttagaaggcagatagctgtgcttctgttcttctgattttcgacagagacatcagaaccttccacagtcattttagtctaagtcctgaaatcgttcactgccagccctgagtctagctggactatatgcctctggttggacacgtctgccacctctgagaactgtgtggatgtaactcttctgtcttctggctcgttgtgtttccaaggagaagcttgaggcccagtaatacttaaaaattttttggacaaatttaatcttacataattatggggtacacagtgatattatatctgtacaaggtggaagggttgaatcaagccaattaacatacccatcatcataaatgcttatcattaatcctcctctctatctgcaactttgtagtctttgactgtcatctccttattccatcactccccagcccctggtaaccactattttgttctctgtttctatgagttcaatcattttagattccacatatgagtgagatcatgaggtatttgtttttctgtgcttgacttatttcactttacataactttctccagcttcttctatgttatcacaaacaataggatttccttctttttcatggctgaatagtattccattgtgtgtgtgccacattttccttagccgtttattccttggtggacttttaagttgattttgtatcttggctattgcgaatagtgctgcagtgaagcatgggagtacagatatcttttcaacataaatttgtaaactttcttaaaacattatgagttttttgttttgttttgttttgttttttgcaattttttgtttttggctcatcagctatcattagtgttagtatattttatgtgtggctcaagacaattcttcttcttccagtgtggcccaggaaagccaaaagattgcacatccctgctctagaggttcctggataagatgctcttttaacccctgtagacaagactttttttatttctggaaattttataactttaaacatgtgttttactcctttattttaattctctatttcagggacattaattttatatattttagatcacccctgtctttctcaatttttctgttgaattcctgaagtctttgttaattcctatttcatttttctcaagctccacagatcctgtcccccatgctgcctgcagtgttaatatccattcatttttccctgcttgatataatagccaacatttcttttctggccttttctcctgatctctgctggcttatcattgttttttgttttttgttttttggccccttcctcccttttgagctgttattttaaccaagtgattattctgttaagttctttgattccatatctgtgtgtgtggacatgccttcatctgccttttgggacatttttctcatgaaagtcctttgccatttgtttctcctgttgcttctcttctttaattatttcagcatcattgtacaaatccaaggtaggatcctcatctttgaaatagatcatggaagggccttggatgtgttccagtttaccagaatatttcctcccttctcaataatttgttgtgtgtgtgtgtgtgtgtgtggagagagagagagagagagagagagggtgaaagagagagaatgaattggtttaatacatatttctccccagtgaggctgccagccattcagtctcctctcttcaacactctaagaaatggttggctttccattgctgtgtatatccttccactctgcaggccttgtctgaagtctacagcagccagtccccactaagggtcttcatgatcccagggcaaacatagctgcattgggctccgcttgtggcatgttattgctcaggatcggggtgcccactggttccattttatttctttatctggttcttgttgcagggtcatttcagagaggagggggcagtatctctgccaacacccaagcaatctgatattttgatgtttatcttacagagtgacttagagtatgtggcattgaaaccaatggttaaaaatcaacaaataagcaggaaacaacttcagaatgaccaaaaaagttcctggggcactcttagcttccaccagcctctctgatggtcaaccaggccattttgttggctttgatccgttcagcacattgagttatggggcgcctcccacgtgtcaggagcagggtgaggtatgggggctgtcgcagcagctgagatgcttccctgcacttgacttgtttacggtcagatcgtaaggaagcatgggagcccagcatcaggctctgctcatgcataatctcatttattagtgacagcaaccatagggtttttctttgtgaaaaaaattataaaatacagaacagtgcagtaccacccaaattaataaatgttgttattttaccatttatgcctttatttttcctaaaagaacagtcccaataaagtggaagctataaccttttatggatgaggaagtggagagtaatctgctcaaggctggctagctggtgagcagcaggcctggctcaggcccctctggtgcccctgatttaggcttcatggccttctctaccctgcaggaattatgctggctcagctgtgcaggttggcgactgcaaatatcaacccctctaataggaaaccaggcagatttttctcatgctatcagctgatttttggtatatgtaaataaaacctatgtttttgagagtagcaggaaacattttgttagaaaaccaaatgaatacagggagatatggctatcaggagctgagactgatattataattttccaagtactagtatctgtgtattgatttttacagtaatttgtactttcccatccagcttgtttgtgaccactgaggcccttggtgaatatcttagaagtcactcaaaatggataaagaatgaatgtgagtcacccatagcagtcttatgtgagataatatatggttgatcctcagtattcatggcttctgaatttgtgaatttgcctactcacaatcacagtcatttatctgtaatccccaaatcaataaccatgatgctttcaagaccatttgaggtcatacacacagtgtattagttcattttcccactgctgataaagacatgcccaagactgggaagaaaaagaggtttaattggaattacagttccacatggctggggaggcctcagaatcatggcaggaggtgaaaggcacttcttacatggtggcagcaagagaaaatgaggaagaagcaaaagaggaaacccctgataaatccatgagatcttgtaagacttaatcactattacaagaatagcatggaaaagactggcccccatgattcaattaccccccttccttgggtccctcccataacatgtgggaattctgggaggtacaattcaagttgagatttgggtggggacacagccaaatcatatcacccacccctggccccttcaaatctcatgtcctcaaatttcaaaaccaatcatgccttcccaatagtcccccaaagtcttaactcatttcagcattaacccaaaagtccacagtccaagtttcatctgagacaaggcaagtcccttccatctctgagcctgtaaaatcaaaagcaagctagttacttcctagatacaatgggggtacaggtattgggtaaatacacccattccaactgggagaaattgtccaaaacaaagaggttacagggccaatgcaagctgaaatccagcagtgcagtcaatttttaagctccaagatgatctcctttgactccaggtcacacagccaggtcccattgatgcaagagatgggttcccatggtcttggacagcttcatccctgtggctttgcagtgtacagcctccctcatggctgctttcacaggttggcattgagtgtctgtggcttttccaggcacatggtgcaagctgtcagtggatctaccattctgaggtctgtaggatggtgaccctctactcacggctccactaggcagtgccccagtagggactctgtgtgggagctgtgaccccacatttcccttctgtgctgtcctagcagaggttatccatgagggccctgcccctgcagcgaacttttgcctggtcatccaggcattttcatacatcttctgaagtctaggcagaggttcccaaacctcaattcttgacttctgtgcactcgcaggctcaacaccacgtggaagctgccaaagcttggggctttcaccctctgaagccacagcctgagctctacggtggcccctttcagccacagctggagcagctgggacacagggcaccaagtccctaggctgcacactgcatgaggaccctgggcccaggccacgaaaccactttttcctcctgggcctccaggtctgtgataggagggactgctgtggaggtctctgacatggcctggagacatcttccccatggtcttggggattaacattaggctcattgctacttatgcaaatttctgcagctgagttgaatttctccccagaaaatggatatttcttttctattacatagtcaggctgcaaattttccaaacttttatgctctttttttttttttaataaaactgaatgactttaacagtccccaagtcacctcttgaatgctttgcctgcttagaaatttcttctgccagataccctaaatcatcgctctcaagttcaaagtttcacagatctctagggcaggggcaaaatgctaccaatctctttgctaaaacataacaagagtcacctttactccagttcctaacaagtttctcatctccatctgagactgcctcagcctggaccttattgttaatatcgttattagcatttttgtcaaaaccattcaacaagtctctaggaggttccaaactttcccacattttcctgtcttcttctgaaccctccaaactgttccagcctctgcctgttacccagttccaaagtcacttccacattttggagtatcttttcagcaacaccccactcttctggtaccaatttactgtatttgtttattttcacattgctgataaagacatatctaagactgggaagaaaaagagacagttccacatggctgggaggccccagaatcatggagggaggtgaaaggcacttcttatatggcagcagcaagagaaaatgaggaagaagcaaaagtggaaacccctgataaacccattagatctcatgagacttattcactaccatgagaatagcatgggaaagactggccccagtaattcaattacctccccgtgggtccctctcacaacatgtgggaattctgggagatacaattcaagttgagatttgggtgaggacacagccaaaccatatcacagagtggcacaaaattttagccacatgcatattccagacgctccaactcctcctttcacctcatattataagtaagtgtctttttccccagtctacttagtgccgtattttttgcatttttgttccttttttcaaattgtggtgactttgctgtttagagtacccccagctgaagtgctatctggtgtccctaggtgtaagaaggctgtgctgtgccttacagggaaaatatgtgggttagagaagcctctgtcaggcatgagtcatagttagtgctgtcggccgtgagtccaatggtagtgcatcaacaatagatatgaaataaggtgcctttacacagaaacacataaaacaagtgatgcattgatcagttgatgaaaatatggtgacggcaggctctcaggcacataacccctgagaagcgatgggctactacttgctaattcagttttgggggtgactttgtggaatgtataacctgaaataatgagaataaactatattctacttcttttacaaagcaaggaaataatttttaaaagcaagttaaattttactgtttttgtaagagatatgttttcgaaacagttgaactgttttataacacagagaaagtctctttgccttacattttatattagttaattaagtcagcagatttttcttgggctcctgtgatgtgactggcactgttttggtaccaaaagggcattgcaaaaaaagtccagaagtagacagatcacagccttcaggattaaaagcagtctcatcaatgtgatatttcgtttaaacttagtagcaagcccattgaattctcaaaatgagaatctgctaattatcacacacttttcttatgaaagaatgatttttcatagtcaatatttctaaaatataatgtctctttctcattagcagagaccgattgtatggcagatttacttgcacctgcggatgctggagataggtgatgatttagtatagtgcacatccaccaggcggtcctcctgggtcccaatatttaggcccacaggatgagtccaggtgatattgggcacaggctcactcagaggctatcagacagaaagctctgcctcactgcacagcagcttcaagcattgccttcagtgggagtcttacttgcagtccacacagctcaggtacaaggcccctgaggtccacacctggagctaatcatctctttgaataacactgtagacatagctaccagaaaataaaagaaatagaaaggcatgattaatacaagcctcactaggttcttattgtgaagatctgagaaagagctcctcatggccctggcatgggagggaagagtgataactgtaaaatacccctaggctttctccatgacaatggttactctccaagggaaaacactttgcaagagccttgtctcagctgggaattcccaagggaattcctcaagttccagcaccctcatcactttatcacttaaaggacaaaaaactcatagtcaacaggggtcagcgcttcaaggaaattgttacagaatggtaaaggggtcgaatatccaagaagacataacaatcctaaatgtgtatgtgcataacaacagagcatcaaaatatgcaagacaaacactggtaagactgaaaggagaagtagacaaatcctgtcttatagttagagattttaatctctttctcacaaaagttgatagaccaaatagataggataaaaatgacctaagcagtactgtcactcaacttgatctaattgacatttataaaatattccattcaacaacagaaaaatacacattcttctcaagctcacttggaatattcaccaagatagagcacattcttggaaaacatgttaacacatttgaaagactaaacgtcataccaattatgttctcagaacacagtataattaaactagatatcaacaacaaaaagatggaggttttgggaaatttcccaaatatctggaaatcaaacaacagacttctatataacctatgtttccaagaagaagtctccaaaatttaaaaaaatattttgaagtgcataaaaataaaaatataatttatcaaaaattttggaatgtagcaaaagcagtgcttatagagaaatttatagaactaagtgcacacattaggtaaaaaatatataaagaaaattacttgtgattctacttttaagaaactacagaaagaagagcaaattaggcctaaaccaagcaaaagaaaagaaataattaaaatgaaagcagaaatcattgaaattaaaaacaggaaaacagtagagaaaagtcaataaaaccaatgttggttctttgaaatcatcaaccaaattgataaacctttaaccaagaaaaaaaaaagaaaaaaatgtagaagatgcaatttaccaatatcagaaatgaaggaaaggtcataactgttgatctaatggatataaaaagatgataaaggaagatcatgaacaactctgtactcacaaatgtggtaacttaggtgaaataaactaatgcttgagtgacacaaactactaaaacttacagaagaaataggtagcctgaatagccctatatctttaaaatttaaattaatataacctttaaaacagaaatcatcaggcccagatgggtccactagtgaattctgtcaaacacttaagaaagaaagaataccagttttccataatctcttccagaaaatagaaatggaggaaacagtttctaattcattttatgagttcagatttcacgtaataccaaaaccagttaaggcattacaagaaaacaaagcaatattacttatatatacaaaaaccctcaacaaaatgttagaaaatcaaacccaacaacgtatgaaaagagctatgtaccacagccaagtggaatttattccaggtatgcaaaacaggttcaacatttgaaaataaattaatgtgatacatcacatcaatgggctagagaagaaaaatcatatgaccatgttaatggaggcagaaagggcatttgacaaactcaaaacactctttcatgtcaaaaaaaaaatcttaaactaggaatagaggaaaacttttgtaacttgataaagagcattaaaaaaaaaaacctacaggtaacatcatacttaatggtgagagactgaacactgtccctctgatattgaaaacaaggtaagactgtcctctcttaccactctgttcaacatcctactgggagccctagctagtgcaagaaaacaaaacaaaacttatacagatcagaaaagaagaaataagacatcttttttcacagataatatgcatgtccatatggagaacttcaaagaatccataaaacaactctaataaccaataagtgagtctacaggatgctagatcaatatacaaaagtcggttgctttcctatataccagtagtaaactattgaaatttgaaataagaataattaccatgtataatagcaccaaaaagacaaaaaaaaaaaaacacaagaaaatacttaggtataaatctaacaaaatatgtacaggatctgtatgcagaaaactacaaaataatgatggaagaatcaaagaagatgtaagtaaatggaaaagtagtccatgttcgtacattggaagactcaatgttgttaaaatgttcattctgccaagcttgatctgtagattcaacccaatcccaatcaaaatcccagcaagctgttttgtagctaatgatgaaatgattctgaactttacttgggaaggtaaaagatctagaatacccaacacaatacccactaaaaaggacaaagttggaggactcacactactcaatttcaagtcttactagaaacagatacaatttctgcccttatgggacaaacagacattcatcaaaaattcacatgctagaaagtaaaggtaaattaagtcaaaacagtggtcagtggtacaaaaggaaagcatgttagttttgactgtggggacagggacatgtttatcctgagctcaaagggtagcctggacagtggaggatttttagcagagaaaagggccacagcttagaacatgtaggaagggagcaaggtgggggcattgacagccagagctactcaaaagagatgtggaggaaaaggatgttatgtggttttggagacaagtaggcatgtgtgggaggctgagacgtgagatgggagggattggcaaggggttgactttcagcagtgtagagaagggaatgatctaagagagcttggattttcatcttcataaatggatggagctcttgggccaaggttctcaaacttgagcctttaaaatacaaaacctagagcttcaccccagagtttctgatttggcaggtcagggtggaaccctaagaattttcatatcctccatgtttcctggtgatgctgacattgctggtccagagacgcacattgagaacccagctccagggaacaagaaggagctccaagttaggcaggaaagccccaagcttacatttggatgggttgactatgagggcctttgcactgccacctgaagatggtagctaagagaagaggcaggcttcaaatattggctccaccacatactgtgtgttcttcagcaagccagttgaccctcctgaggctcgatgaccaggtctgtgaattgaggataacaatagtatctaccattagggatgttgtgcacatcagttgataacctttgagtcaagtactcatggaatagctgttttgcattatcctcatcaccttcatcatcatggccattctggccagcactaaagatgtacagccaacctcttctgtggctgaagtttatcttctataaaatgagaacttgtttttcatgaagctgtcattttcacaagtttggggtgcaggtgcagattgcctactgttgtgtttctgaacacttccctcgcgaggctcctaaccccaccccagtaaactcatcaacatgactccttccagcttctacagctctggagagggttcctttttatcttgcgtttccagggatgtttcacggccttttgtggagtgggccctggctgagcttctggcccttcttgagtgtggaggatgtcacagactgcagtgggaaattaaaaagctgcttgcttcacagagtaagggaatgttagtagatgcttgaaaagtaccctgagggagctggtcagaggtgctctgtaaagttgcatctgttgctagcaccatgagcagctgtctgaccaggaggcctgggaacagggacagagagagctggcacccttctttcctctgccctacacattggcctttccgccattaagaccatctctgcttgactttttcagtctcctggctggcaattagcatcttgaggtctccattaagatcttttcaaggatgctcttcctatttggttcaatcttctggttgaatttgatacatgttatgatgtaggactttttaaaaaaacataaaacaatcaggaaaacctcgctatacccattccagcaattcaagaccaagttcatttttggtaaaaacacttgggaaagggcatttccaggctggctaagcactaaatggcacagccctgtccactgactccctcctcaactggtgtgtgttctggagggatccatgtctcagagcattacttcattttgaatgtgcaattaaaagaggccccgtgctgctggggatctcacacttctgctttctggtttgttttgcatgctgacactttgaggaaaagcccatttccctaattacagacatcgtccagcagcaggaagcactctggcttgttgatgcctgtcttgtgctttctctctgtttcagctgttttccttttaagatactcctctcagatttgtgtgcttcttcccttcccacattctatactgcccagcgcctgggattccagatctgcgtttgaatccaggaaagggaggtaggtcaaatttgtgggaatcaagcatatttagaaaccctaacctcaggctctgcgcatctgtgggtgtctgtaggagggatacttaggtttcatgcctgcatctgcgtttcctctcctctgccgctaacattcttccactgagcacatgtccatcttgagctggaaggtttagcggtttgccatcttgtcttgcctgcagttatgatgcagctaaagcatccttctctccttcctataacctatgccactttgctttaagcattgagtatatttatgtctcaggtttatgaaagacaattataaaatctcaggagaccatcataagctcctgtaatatcttgcagtcctgagtcacccacaattattttttaactggctaggaaaaagaatgctagcgatttttttttaaatagacattcagtaaaactctagatatttcttaatccacatttactgtgtcctttttgcttaagtcaggtgttttggtttctctagcagctgcaggatccccataaagattatgctcataaggtagtgatggaaaagtaaaatagagcctgaaagcgggaaacttcagcaaggcactaaggcacagacaagagatgttaggtctgccggctgttgtcattgcagtctgctgtggcctcacccccgcccccccccccgccccgcccaggccttcacagctgagtaggaaaggatcttgggatgggtaccagggcaggatcaaggaaagcctgcaactgcgctgcccttctcatcatccatatgtggtttgcccagataaaagcaatatagtaagatctatcaggcatattcaacgtgagttcttttttctagcatcttgttggttgtttgtgtttttccccagagaagagtgagtgatgaggtggccctgggacatggtagatggtgcagttcactggggagacatccttggccccactcagggtcaatatgcgccccacaccgctggctgcaaccccaccctgtcctcttctgctcaaaagagcatgcaagggacattgctaagtggcaattttggttgcaacccagtgttctgttaattattcacaaaagctagctctctttttaattaccaattgtgtgtgcgttgcgtgtgcgtcccttcccccttctctgagcacacctgtatgatgaggcatgtacttcttcctggtggagaagaactgcagagatgtctcccaggttgagcctgcagcctggcccggtcaccagcacagcacggtgacttgactgtcctccctggctcccttccccacccgtggcaagtggcaacttgctttcgctcacactgaacgtggtcaacttgcctccctgtcacactgtagcacttgaatagggcaatattagattatagcagaggttctcagacattagagtgcttaaaaatcacctgggaagcaggccaggcgcagaggctcacgcctgtaatcccaacactttgggatgccgaggtgggcggatcatgaggtcaggagtttgacaccagcctggccaacatagtgaaaccctgtctctactaaaaatacaaaaaattagctgggtgtggtggtgtgcgctgtagtcccagctactcaggaggctgaggcaggagaattgcttgaacccaggaggcagacgttgcagtgagtggagatcgtgccattgcactccagctggggtgacagaataagactccgtctcaaaaaaaaaaaaaaatcacctaggaagctgtttaaaatttacccttcttgtccgtatgccctatttgctgggtctgaggtgggcccagaaccctgctttccagaagggagcctgagggtggggtgccctgaagaccacactcaggaagaaccggacatgtgagctttcatgagccagagtcctgccaagaactagaatctgcaggtggctttggccagtcccacttagaggcaagaagacgtgaggatagtagagaacctggaaatcacgcagtccccaggatgaaagtggaactctcggaccagatccttattctcttactttcgtgagccatttctgcctacctgttgtcagggaggcaggaggttcatttttctctcacatggtgcctgacataatgacttgcacgtgatagatgctcaacaagcatattgaatgaatcaatcagttagattgtaaattaaatgcaccagatgggctggttgtttatttataactacacagttaacatttatattaacataatgttaacaccaaagcgtaatatctgttttctgtgttaattatggcaaggtgggcatagagaagagatttctgagtgtcttttgcagagcttgaaaatgtctatgtgttggttgagatagatcagcctttacttgatgcactttcaatcttttaagttctgaaggcacagcaagagaatttggtgttgaaggtttggataatgttttcaagtatttcaatatccctctatttctaaacattagtaaaaatcatgcctcatgctaccatccttagcttcactttgtgtttctgaattgtgtatctctatatactaagaagtcccccatgtatgcctgcaaatatgggagagtcaaccgctcagcagaatgtgcacaatgtaaggctgtgccttggagaccaggcaccctgtgcagtgtgatgcacaggcaggcctcaggatggcgccgtggagggcaagtgatacctactgacgaagccagtggagtggatgcaaggccaactcaggccctgcagctggggttctgttcctcagtgttgaggccacaggtctgtgtccacatgttttcttttgtacagtgggattctgccgcacaaggcagtgcccccagccctttgcagatgagtcaaacatgcttgtttgcagagcctggtgctgggtggggtggtcccatcacatcacctcttccttggtcatttctctgtaattaatcagccagtccctgaccaaaccagcaagatcaattctccctctggttggactcattcctcttttttttttttttttttttttgagatggagtctcgctctgtcgcccaggctggagtgcagtggcatgatttctgctcactgcaaactccgcctcccaggttcatgccattctcctgcctcagcctcccaagtagctgggactacaggcgcccaccaccacgcctggctaattttttgtatttttagtagagacggggtttcaccctgttagccaggatggtctcaatctcctgaccttgtgatccacccgcctcagcctcccaaagtgctgggattacaagcgtgagccaccacacccggcctcctctttcttatgaaaattaacccacagatgaagtttcctttcacccaagtcttgacaattttctcagcttcaagctgcagaggaaattcctaggcacatcttaacagggctgctttgcattgagggggctgtgtggtttgagcgtgataagcctggatatctttctgcactatgctgatttttgttcccttaaatggtatggatttggcaacaattgtttgcaggtgatcttttcccagagaaccacttatttcccccactgtctctgtatgataggagggctctaatggcccagggatgtgaaagtgagacaccttcaatcgctaaggactgctggaaatgtgaactacaggaagttgagggggctggaggggaggaggcagcacctgccggagccatgcttcagtgggtctcaagaaaagcagaagcctggaatctcagggctgaggccccttgataactaggacagatgggttaataaaaagggatacagagacataggctacctcttctggttcaatgccaagctagaaaatcctgaaatgaacacagatttatgagataggagtaatatatttaagaacacagtcttacatagagataactattttcccaaaacatccaaggtaaatttatatatctttatggatgaggttgggtcttttcagggaaggttggggagacggaagggaaattacttattatcagtcctcatgattcatggattccatatctccgcattcatctattcatttaaatctgtttgcaaccccaaaatcaatactcacagcacttttgcagtcatttgtgacgtgcacaaagcagtgaaaaatttaagtcacccaacacatacgttgaggtcgcacaaggtgacactctgctttcttgttttagctcttataaacacattttcttttctcttggcccatttagtccatggtttttgcatttttgtgcttttctggggtgattttgctatttaaaaatggccccaaacacaatgctaaagtacttactgtctggtgtctctaagtgcaagaaggttgtgatgtgctttacagagaaaatacgtgtgttagggaagctactttcaggcatgagttattgtgctgttgaccatgagttcaaggttaatgaatcaacaatatatatgaaataaatatctttaaatagaaatacacataaaacaaggttctgtattgattgattgacaaaaaagttgtaaccagaggatcacaaaaacctaacaccatatttccccaggagcaactgttcaggatttgcaaattcagctttcatggtgattttatagagcataactattgtgaataacaagaagcaactgtattttgtttcatgcataagatggaaagagaacagaaccagaagtatgatatcgatgaaatggagagaggagaaagaaaagaaagaaatgacactatgaagatttattagttaaaatgttactagtgataataaattaatcagaactttggcctctgcctttgatcctggttcccataatctctaagtgccaggctcagataatgtggcccttgcagggtttgggcagctagtcctctaaccattttctacaggtaaacgtggacatgaaagaagccagggtgaggcaggcagcttccagaagcacacactgggctcagctccttccttcctaacctctattttagctccacgtacctcttcaataccagaaagtcttcttctgattctgccagagcccagctcctagaacctagctcatacactcaccagccttttttgtcaacaattcattcaaatatttatttacttaaatatccattaagcactgttgcttctctcgcccaactccattgcacatgctatatcagttatctgttgctacataacagatcactctaaacttagtggtttaaaacaacaataattacttattattgctcataatttctgtgggccaagcatttgagatagctgggtaggctcaggccctctgtagggttgtagtcaggtgtgggccagggctacagtctcatctgaaggcttgatagaggctggaagatactattccaaggtggctgctcatacggctggtcacttactgctggctattggctagaggcctcagttccttaccacatgagcctccccaaagagctacttgagcatctttccaatgaggcatctggtttccccagagtgagcaatccaaaagctgaggaaaagtgttaagggctttcatgagctagcttcagagacccaacattgtcactctgcagtcagccactctgtgtgcaagggatgggagtaccaggaagtgaggatcactgggcaccatcttggaggctgcctgccatgtatacattttaactctcaaacaaaatttgaagactgaagacccatacttaaagtagcctctgttccaggcagtagagaacaaaatgtaaacgtacttacactaatggagtgtctattctagtggctttggggaatatagacaaaaaaacagaactaaaactctaaggtgggacagggagctgggagtgttagtgtcaggtgggcctatagagctcagccccccttcatcatgttggcattcatgctggctgttcctctgtaggggatgaaattttcccctgccagaagaatgggctctggacagcttgttcagctgcttgctcaggtgtgagcatctgtgcctaatcttccagtcagactgccctagaaacatcatttcttaattagctgaaagggtatctgaaacattgtacttatggtggcaagcatggatctattgctcttcatctataaagttgctgcctgataaggtagaactacacaaatgatagtttcccaactaaatgcattttaaagggcaaaggttgtatagtcagctttagtcctggcataggggaaatggactatggaagtctagttggaagagaagattgaaacatgccagtaagtgcaaaaggatacagtataatttaaataaaacacatggaagacatgaggatgctagtgggatatgatgggctcatccatttctgcaggctccaggagggtggctggcagggcttctttggtgtggggcagaaagaatcaaagcctgtagaataaatctgactccgttctagatttaactcctcatggtgtatcacgtgcaaggtgaagcctgactggcactagggaggattttgaggtaaggaagcattgtctttggttcagtccaagccctcactgactttccaccatcttcaggtgggggtgggcatgtccgtctgtctcccagcctcatgcacacacatgtgtgcacacacatgcacacacatgcatgccttcttatgaagtgtgggtctggctgcccgtgctttttccttcatctcaccatgacttatccttccctcttctattcaaagttcccacttgagagggtccagttgccctgggcacccctccacactccccactcatgactgaaattagttacagtggctttggtatactgtcatcccctttcaccagtgaagaactctattgctatagtgcccaggtcacacaaagctgggccgggtcgccagcgttcccgattctcacctctgtgtccctgggtttcctgctctctggcccagtggaaccacctccacggggtaccattcctttccagccttgtcttttgttcattggcaatgatgttaacaaattaaataggggaatatttgttcatctaatttattggtaaaaaggctagaacaagcttatccaacccatgacccataggccacatgtggtccaggatagctatgaatgtggcccaactaaaatttgtaagctttcttagaacattatgagatttctttcccttcttttctgtagttcatcagctatcattagtattagtatattttatatgtggcccaagacaatccttcttttatcagtgtggcccagggaagccaaaagattggacacccctgggctagagcaataaaatgggcacatcagatttgtgtccacaacagctgacacagtggtttccagtcaggggtaagttacccttagggaacacttggcaatatctggagacgatgtttggctgtcatgattggggaatggggtgctactggcatctagtggggagaggccagggatgctgctcaatagtctgtactagatgagacagcccccgaccctacacacataacagagaaggatccagcccaaatgtcaagagtgccaaggttgagtaaccccgagctaatgtgatgaatggtgccagatggaaatgggtgggaccatcataaggagggggaacagggtaaaggcaaccatcttaatttgtaaattgagtgtgggggatgtgttttgaccacatgcttttgaaaagggaagctgttcattctccagaagcccagcggagatgttggatggatggggccacccatagctgcattcatggacagctggacacgggcccaggaaatcttggcagcgtcactggggccggtgcacttttaagaggagcttgggtgatatgaaattgtttggacaaaatgagtgagaggtcttgaaataatgtcaaggcaggaagaatgcattgacttggagtggctgccaagagcaagcatttgcaggttgttttggggaagcagaactggctgtgttctctttgtcctgtgcacagttggaagacgggaaatggaggaggagagatggggaaggagagatggggaatcagataagaaagtgttttccaacagaagcatcggcacacattggagtgagttcccttcccttaagaggccaggagcttatgtaggaaccaagctccatctgaagcagccacagggctggagcatctcgcagattagttgccagggttctctgattctggccctgttagcctccatctggacacacagcaattgcatgtttagcatttttattacaaaagcaacatacaattttgacccttgaacgttacaggtttgaaccatgtgggttcacttatatgcggattttttttcaacaaaaatattggaaaaaagttttgaaggtttttgacaattttaaaaacttgcagatgaactccatagcccagaaatataaaaaatgttggccgggcgctgtggctcacgcctctaatcccagcactttgggaggctgaggagggcagatcacgaggtcaggagatcgagatcatcctggctaacaaggtgaaaccccgtctctactaaacatacaaaagttagccaggcgtggtggtgggcacctgtaatcccagctacttgggaggctgaggcaggagaacagcgtgaactggggaggcggagcttgcagtgagccgagattgtgccactgcactccagcctgggcaacagagcgagacttcatctcaaaaaaaaaaaaaaaaagttaagaaaaagttaagtgtatattgaatgcacaaaatatatgtagtctattttttcatttactaccataaaatgtgtacaactctattattaaaattaaaatttatcaaaacttacacataaatacttatatgccattcacagtcgaggaaaatgtaaataaatataaagatgcagtattaaatcataattgcataaaattaactgcagtacacactgtactgctgtaataatttcatagccacttcctgttgctattgtgatgagctcgagagttgcaagtacctgcctaaatcactgtgtgatgctcatcatctctgtgtgagcagttcatctctccagtaaattgcatattgcagtaaaaagtgatctttaataagtgatctcttgcagttctcaagtatttttcataatgtttagtgcaataccgtacaacctgaataacaccatgggtcccatgtgaagggtcacagtgaggctggaagtgctcccaagaagtcatgacattataagaaaaagctgaattgcttgatgaggattgtagatggaggactgtagccatggttgcctgccatttcagatggatgagtcatcttgtaaacagatgacagtaaatttatggtattgataaatacagtacagtattgtaaacatatattctattccttatgattttcttaatgacattttcttctctagcttacctcactataagaatatagtatatgatacatataacatgcaaaatatgtgttaatcagttatttatgttataggtaagccttctggtcaacagtagactattagttaagttttgggggagtcaaaagttacacatgaatttttactacagggtgggtggtcagcatccccacattgttcaagggtcagttgtatattcactgtggaaatcctaaaaagcaaagagcaacatgtttccatcaagcaggattttgccagcctctggttaaaccctgaagcctgagcaaggcagtgaaatctccagacctttggggctcacattttagggaaagggcaggtttgtgttgatgctacaaaggtaatagatgcttttgagaagttaactatgtgcgggggtggccaaggtaggccgaagcagcacctgagactggatcatcatgatgcaactctctgagtaaaggcctgagaaggaggaagccaagcaggaggcaggagaggcctcaacctggaggcagaagcacagtgtggtggagatagtgagcaaggtgaggttgcaggtctcgggcctggtcaaggagagccttgtggaggagcaatgaagatttgcgatgtgatgtggatggagaggttccttgtgagcctcactccaccttcagggtagggaattgtcagtaaggaaaggaaggaccaggtgagacttccaatacctgagagatggcggtggcttccacgagggcagcctcaggagctatggggagacatgatggcttgggaatatattttaaagaaaagctactcagaggacctggagaccagctcatctaacctgcttcaagattctccatccctgtgactgcatcagatggagctcagctcctgcacaagctcatggcttccctgcatcactgtgagtggccaatgcttctggtagaaagcacattcctttctgacttggtgagagggaagactcctgaaagcagccagggtctcatcctcagcaactgtggtgctcaatgtcatttcctcaattaggagagactgagggaggaagagatttgctgagggagtggcaggaggagtcaaaagcctcatctggagtatgtggaggtcaacttgtctgttacacatccaaggggggacgtcagataagcagacatgcagatcaggagctcagtggagagaaataaatacccattaaccaacaaatatttttgatgacttattctgcactaggagctgttccaggcatggtgatatggcagtgaacaaggtcatcctattctcacctcccagagctggccctctggtgggaagaacaagacaatactcaaattcaacagtgaatcatgatttaaagggctgctgccttatggagatgtgctgcagagaaaaattaggcagggaagggaggtatgcggcccaggacattacagaagattatttcatgtcaaaaaacatttttctacaactaagtgcacatttaacttgtgtcacaaaaaaggtctcaaaagagcaagggatttgcagtgttttcaggagctcaccagacacctgaaaaccctccttgctgaaccactacctgcccaggtgttcactgaggtgccagacccagcaggctgaggggtacaggtggagttaaggaggagctaagtggcctggtttgtttctcagtttcgtgctttggaatgaagtagtgtcacacatggaaaaaaataactgggaatgttgaattaagaaaaaatagggagcaagttctaaacactatttggaagaaaatgatccctgggaatgctaaagagaatttgagccatgagctgttcctgtagtcagagttaagcattgtgagttggcaaaagcatcaggcgggaaggactgagtctgtgtgtgcaggaggaatgcctgcaggggaaagtcacgggctccgtccctgtctcagttggtgggggtggcagagatgccacagccgtggccaagactacgctgggtgaaaagtgagactctctggatttgccatactgactgaaagctgatatctgaaaagtggagctgagaacagcagcctgggccactgtgggcagtgactggaatggagatggccatttcctgccaaggtggcctgagaaagaggaggttggagaccaggacaaggccccgggtgggtgccggtgggtgccagtcctgagaaggtatgcacaggaacaccatggacattgtttattcccccaattaagtagcccaaaaatgtgccataagctgtccttgcagtgaaccagtgattctgcccaaaccatcaccaccaacatacccaggtcaactccggcacaggaagtcacatggccagaaaagggccatcagccacatcggtgctgacactgagtgcagcacattcttctgccacctgcttgcgaacatatctgcaatgcaccatcaaagccacacagagtgtccctggcgtgtgcctggaggttgctccgggtctgcagatgctccccaagacccgaccacagcctgtctcacttcctttccattcacttcaatatgggattcatgcccaagtgccagcaccgatgtaatgattagtgacaagccaatgaatttttaaaatagtagctatgttaagatttatatgaattaaaaagtatttgctctcattttatttaaaattttgttcctacaaagttactgtctcagtttgagctgatggtgcagtctgctgttctgcaactacataaaaagtaacctgggccctgcagaggggacacaagcatcggggccaggtacacagtgacaggggtatttgagctgggtctgtaaggatgactgagatggctgggaggaagagctgcacgcctcagcagaaagcacacgtggtgagaacaagaagggaaagccacagcatcccggtgcagtccagtgtggtctgtggactgggcatgttggaataggcaggaagggctgatgtgcgctttgagggaggaccgggcagctggagagggaggcgtcaggaagcaggagggcagaaggtgaggagtgaagggcagcagtggaaaggacagggttacgccaagcagtggtcatggatatgggcagtaaggaacatgcaccaagggcgcctggaaaacgaaccttagagaacgcaagtcctgcggaggactcctgggttcctggctgggacaccgcctgggcagggaaggcagagaagatggagaacctggtctcaggtggcatcagaacccagcatccgcatcaccaggattgcaggagcagcagcgtctcaggccctgggtgtgtcagagcccccaggccacgtggaagtatgagacgtgctgggctgcaggggaaacaatggaaatgaggttggaggcccgagaagacccactgcaggaaaagggtggagtgggggaaaagcaggctgggggcagtggctggcctgcaacaaaagcattgtagaatgcaggcgtgagccaccgcgcccggccaaggcgggcagatcatgaggtcaggagatcgcgaccatcctggctaatgcggtgaaaccccgtctcttctaaaaaaaaaaaaaaaaaaaaaactgtagaaaggggaaagcagtccaaagagaagtatttcttccaagagactcatcagcacactgtgtttccagagatgtctttctgttaacagcattcttagactcaaaagtaaatgtagatatactttaaaaaacaaaaacaccttgctaagagatgaatttttagaaacttgttggacaaagaaaagtcattgatagtcaactgctgtgagaggcaagccaggaaatgatgattaataccctcaaattataataaaacccatgcctcattaggggctcgcccaggagtactgacttgtggatagacaccgtctggggaaaactctgtcgcctgtgtcaggctgacgctcttacattttatagccccttgtaggatagtgcatgttgagaagaagccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcttctgaaatgtatttatttactgcaagcagtgtctctcctgtgtcagatgtcctcgtgggctgggaaccggcactatctctttagcacgggccctgcagatgggaagtggcgttgcccaggaagtggtctggagaagcggggagaagacagcctatgggccccaggcctcgggagccagggagggtgtcactcttcatgtctcaggcagtggcttgttgctatcatagccccgggctggaggtgggaaggccttatggtgaccacaagtcacagttccgtgtgggccctcaacgtggcctcacttcacctctggggctcagcaccagcgtgtgactgactgctcgaggcagcgtctcgcagctcaggtgggtgaggtggtggtagcgtcctccttggtaatatcactgtgatgaggagcaaggcttctctaacattgtctggactcaggaggagcagttggtttgttctcatgtagattctgcctcctgtatgctgctgggaccctgagggtcagcccaagagtcctgttttgcaatagcccttctgtttgcttctctttgcggtatgtttatttttagaattctttgtctttccccactccccccaaaaaagaattatttaatttggtcacttccatcaaatgctctgattttagcttagttagaaggcatgctgaaaactgtaatgatgatgtgaacagaaagacaactgtgtgttgggagggccaaagagggaagtgcctttgttcagagatgggagggtttgtctccactttgaaagggtttgagtggttttagcaaacgttccctgccacgtggggtcctcaccaaagttctctgtctctgtcttgcccaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcaggtgggccacagctggtcctgctccctgggcccagggggccctgtgaccccacacagacttcctggctacatgcaacacatgtgcctatgtgccctgtgtgcccaaataacacaaccatctccttaagcatcaattttggccaaaaaatgcctctctctgataagagcctttcctctttcacagccacagctgagagggtgggtccctttgtgccagcagtgtgggtttctccacagcagggaaccactgttacccagtgcaaggagggccttttcagagaggcattgataggtgttgattggtttctgtttatctgacaaggtcctaccatacacactgataggcacttgattttatggcttcctaatatctcttgcagaactttctgtgtcaacactcatatagttgcatcacccgttctttggctatctggtatcacctgctatgcaccacaatttatttaactagtacctattgatggacacatttgctgtttatgaataaacgctgctaacaacattgctctagacctatcgtatactacacttgtatgcaacgtctgcaggataaactttgaaagggttgggattgccacagcaaaggatatgtgtgtttatttttttattttttatttttttgagacagagtcttgctctgtcacccaggctggagtgcagtggcatgatctcagctcaatgcaacctctggctccaaggttcaagcgattctactgcctcagcctcccaagtagctgggattacaggcatgtgccaccacacctggctaatttttgtatttttagtagagatggggtttcaccatgctggccaggctggtctcgaactcctgacctcaagtgaaccatcctccttggcctcccaaaatactgggattataagcgtgagccaccgtgcccggccatgttatttttatttatacacttgaaagtacttaagtaatgtgtaaaggtctttctggttttatttactgaatgaatgagtgaataagttttgatcctgttttaccatgccaggactcgagatagattggaaatgccttctgcatcattttcatttttcctcggtatggtttactctgctttgctctccatgtggcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgtgagtatcgtgccttccccctcacctcctgccaccaggcctgtgtggacaattgggaataattcagcttccttgtgactggccccacatgaccctgggaagaggccatgcattgccatttgacaacatgcatgctggcctgttctaaagacatttctaaccaaagctatcacttgtgacccagtgtttattttgcccagtctaactctaaaatgaacactctttttgggcaccgagggatgtaatatttaaagaaaatgtgattcagccccatattctccttttaatggcaaattataggttgcatagcacattctgtggttatccaactaaaattaaaatactgcagtttttttactcaaactacccccttgatctcagactttacttctattttacatgaaacaagatgccaacaggaaagatgttaaggaaaagttcctgggagtagcatccatgagtggtgagtgcaggtttgaagacttcagccttaggcccacagtcattagagggtctgtctgaatcctgggttctgtttgctatcctcagtggttcagtgtaaatctaaattgtagaaggttctgagatacaggccaacgtggtcagtcagttgtccagagaaggtaaagaactgtctttgggaggtgtcaaccttgttccctcgagggggtctggtcaaggtggctcagtggggcagttgtccctgggggaaatgatcccctggtcacctctcagtgtccctacagagatgcttaccttggaaacataaccagaaacagcgatgcagcctcatggtttggcaattggtgaatccccagccgacttcgtaaacttttcctagatttagaagcgttttctctgcctgtccatctattcaaaggaatttcctcagacttcactgtcataccttgtattttaaaaatgatcttagctgagtgcagtggcacgcacctgtagtcccagctactcctggcaggaggatcgcttcatcctcactatgatctcactatcgtttgaggctagtttgagaccagcctgggcaacatagtgaggccctgtctcaaaaaaagaaaaaaagaaaagaaaaattgaccacaatactcttaaaaaaaaaaaaaaaaaaggaagaaggaagagtggcccaggttgccacgcggcagtgcctagagtgatggtctttagtgggatgcagccccagccagcagcagaatgctgtggggagggaagacattgcccctcagtggaggcacctatggctatttttgctgaggtttggcttcttaccatctcagcaataatttccaacatgaatgtcatgggaccatgcacatagcatcttggcatgtgaagtcaacccaaaatagcataatccacacgatgaggctggccaacttctgctggttaagaagcctgctcatagcctctttggccacgaagctgtttcttttttcggagttgtctattcccgaaaacagcagttgcatccttcatggccatgacttttgctctctccttcctttctgggagatgtatataaaccccatgcagaaggctgggaggtgcagctcttgtttgatgaacatgccttgttccctatctgccctgtacagactgacatctcatgtgtcctcacagcacatgtccctgacactgaggcttatggtttatgcaagagagtctcaaacttgccgtgcttcctattcagctggtgtcagagctaaccaggcatgggcctgtgagagaggggcctgggcttctgtgttttcatcgagcaccctctccttagttgtcttcttctcctgggttcttattcctgggttcttattctcctgggttcttattccactttatattgcagttgtccagttatcaccccataattgccaacctcccagataatagcttccaaggctttctcccttgtgttgtccacagctcagtcccacaccttcccgtgctccctccacacctgcagggctcacctgtggactgatggtgcatagcaccccatgcccaggcctggcatcaggcagggtattagtgagagggaagagcagagctaagcctgggcagcaagacccagcttcagaacccatgttcccatgatggttgtagaaccttagactaagggaaactttccccaggctctgctcctctgggtctgtgactgtcttgaggattcaatgaaaatacacaccacgtacaccgcacagcacatgtggtcatcactgatgtagcttttcttctctcttcagtgctctttctccatcatgagcaccaggaaagtctccttgtcagggtatcttatggtgtttttaacagagaaagtgtgaggaaacaccttggaggggtttgccacctggcaatttcacctcttgacaacctttcatctcctacagaacctggctggggttcttggctgttgctgggtgtgtaaaccttccttgttgcagtgtagtgggcgtgttatactgtgagtgtttgaatatggttgtgtatgcttgtggagagcagggagagtttgccagcatactggatacagtccaagtctaccatgcttccagcacggggcagggtctgcatccctgaatacaacgtctcccaagtccaggttgcctagacgttggtccagattctttcatctttagaagtgtttgtttgtgtgtttctttcatgggaaatagagctaaaaggctccagggaactcttgtaaaccatcaccagatcctgtggctgccctctcagtgtgagtgcgtcagctcctgattcactgtgggagtctgtcctatattcccctgttgggtcaggccaacgttgcaggaagtcccagacctggttttgaatcatccaaatctgccctacttgcagatagttttataaaatgcacattatttgcaacgaatagccacagcacaaggtctttggagtcagaactagattccagtcactgctggatgtcctcactgagccagctgctgtttttttcccactgttcttctcgggccttcattcagattctcctaacgaatgtgctcatgtctactttccaatcatcatgtcagctaatccatccatggaccaacattactggagtctgtagttgcatgaagcactaagtgccaggcaccattctggactttgggaagggagaagtgaatcagcaagcacctgccctcatggaccctgcatttcagtgggagaaaagacgctgaacaataggaaagaactgcatttaagtaagggcgtagagcacactggggtatggatgctgggtcttctttctgctgcgtggggaggatggaccttgctgtgagggaggccattgagaagaggcctgaaggcagcgaggaaccatccccacccagggaatggcaaattcgaatgccctgtggcaggagcgtgcctggggagcagggcacccacagaggccagtgtcactggcagagagtgagtggagaagggtggagttgagggccaggttgcagagcactcacggcactgggaggaccctgctttgggcaagttgggggggctgtctttaggaagcaaagggccagggccagctgacattcggtgggctctgcctggctgccacatcatcggtttgctgtggggagttgtgcctgtacatatacttgcaaaccaaatgtgttgatttttttatcgtgatttcagggccttcactttctcatgcctgagcatcagtcagtttgtctccgctctgatctcctgtccaccccacccaccgtgcttttacctgggtcctgtacaggcctgtgggctggcccttaagaggttttcaatgaatgcttgtcacctaaatcaatgaattgtttggatccattctccatctcccagctcgtttttgctttccacttcctgacatgtagtaataccactgtagttctgtatgggggcagctccacacctgtctatgttggggagggaatggggattcttgcacctctttctacctcctcttaaatcattactgatggacagatgcagggacacagcaatagatatagaaatataaaaacatgacactgcgcactctatggtttgtaagattcactttctctgggtaggaggcagtgtggcctgttaacaacataccattcgggttgtctggcctcaaatgctggctccaccttatcaccagctatgggaccttgagcaagttactcagtggtctgtttccttcatttctttgtctgtaaaatggctttaatgtcatctctgactcttagagtcattgagggttatagagtatcataaaccgaaggcctgctgcacggtgcttggcaccgaacgaagcagcttcaccccactcctgcagtggcctggaccacacttggatacatcagtaacatacactgaaggtcaggtcctccatgcaaactctttccatccctgcatcacaggtgtaccatgacctctgcaggtgagtcattcttctgcaggtgagaaaaccaggcaggtcccccttatccttcccttctcttcttcagtctgcagtaggtgtgtttatttccactctgtggctatgaatagatagagtgagagtcactggccataaaaggattcacactaggcttttgcttttatgaagtgacagacttaaataaagaataattatttcggccgggcatggtggctcatgcctgtaatcccagcactttgggaggctgaggcgggcaatcacaaggtctagagatcaagaccatcctggccaacatggtgaaaccccatctctactaacagtataaaaattagctgagtatagtggtgtgtgcctgtagtcccagctacttgggaggctgaggcaggagaatctcttgaacccaggaggcggaggttgcagtgagccaagattgtgccactgcactccagcctgggcaacagagcaagactccatctcaaaaaatatatatattattattattattatttcacagagggggttggaagtttatttttgcattgcaagccataaactaatcaagaggattttactagtttggtggataatatgggtaaacaaaatcccagcgattactcttcacactttcatcgtgagtaccaatatgctgtctccaccattcagatgccagcatttcagtctgagaatcgctttacgtggaaagtggcattggtaagaattggactaaaaggtaaaaaaaaaaaaaaaagaattcctgaaatgcatgcacctccatagccatcacaaaatgcctttgctcaaacagaccttgaaaacactgagggtaaggcagcatattttggagatcaaaatctgattataaatcctaggtaatgcagttcaaaatgcagatgatggaagcagattacgtctgggagatgctgtccaactcggatcccagttttctctcctcagaactatatgtgaaatccacttacagtgagagtacacctgagctagagggcatttaccacttaagggggctaaacttattgtttttcaaacaagaactcgggtgtggaggagcttgtccaaggcaggaaggcaaaaccaggtccctgatgttgtctggggctaagcagaaacagcagccagcaaccaaatccatctccagatggatccatctccacaaccacaggcccctccctattccccatgcaagatgcagcaccagggcatgtccatgtgaaatctcagaacacacagaggcgtccatcagctttcccctctcttgtgtcctgtccacagagcttacccacaccattcaggagtgactttgagaaggtagttacagggcctttgcacatgtgcttgaagaataacgaatataaacagaggctctttgtggaggggctgggcagtgtgggtcagtggttgtccctcacagccgcctgtggcatttctggaggtgatgttcatcacctggcctttgctatataagcactgcccttgtctggggtctagctggccagaagcgagcactggagggggagtcctccagcccacgtttggtgggtgagggtcagagtgctgccttgttggtgacgtcagggaccaaggcaagggagaggagctgagtggggaaggagatcccctgcccccagaggccttgtatagcagcacagtttgctattttgagaagctagtcacagctgtctgtgaaaaatgaatttgttaggaaaaggaaacaaagcttactttataaaaattatatatcccttccccaaaagggaggatccaggattgaggggtccgaagcatatacaatttgaagactctcttatttttttaaaaatataaaattaggcatacaatagaatgtattttttggactaaggaaaaaaattcaataaattagaatttttttaaaggctggtcaatactacaagcatacaaactttagaaaagataatgtaatattttaattaactgcctgacacgtctctataacaccttttgtttcctccatgtccttgacttcactgtgtttgactacatcttagttcaacaatatttaataatatatttgtctatatatagaaaaagagactattcattccttcctctaggttcacacttcattattaataatatcatgtacatttttagaatccttgtcaaatttgggaggggaagataaagtagaacagagtgagcttccctggctgtgactaaaatatcttttgcaatctgtacaaaacctaaggccgtgcagtcacattgctgggctcctcttggtctggaggaggctgtgatcaactcctctctgaccctcatccacttggttcacacaatgtggtttattgccattgtgcacagccaattctcccacacacatcgctctgctaaaatgtaatgggatgtggccttcatttcatcttataaatgatcttagaatggaaatgctctaaaaagtccatgccaggcaaaattttaaagatggaagtattgtttctttgtattaagtgtattgtttttggctaagagtccttgtaaatcttacaaagccaagaacaatttcaaggtgacctttaagacacataagtggctgctctccaaatagctcgattaatgttaaaaataaaaggtagtatttcagatttgtggatggagtcgtccaaccagtaagtcaccaatgctattttaactacagtttctaccttctgactttagaaaaaaaagttacaaaaacagtcattcattcaacaaaataggcatgttttcaaccagacatgcagcaggcattgtgataggacttggctactgtgaggaataagtcagaccttagtccctgccctcaccggactttgactgcagggggaagatgacaaacgcaagctgatgtgctgcaaagtctgcaatgcatggcagtaggtcccctccaccacgacactgggcctacgcagcatgatcttgattttgttttcatttacttgtttatagtccccacccccacttgtgctggatgcacaagggcagagatggggctgttgccttcacgagtgcaacccagcacctagaacatggtcttggtgggaaaaatctctctgggtaaaggaacattctggctgctaacttgaatggtggccactacttggataggaggagggacaacatggttcatcgggcctgtctcaggtgcccaggctggactatcatctagtgtgtcgctaactataggaactgggaagtggccttcagagcaagtgggctgactggatttggcagagcttgacacctcaccaggcagatgcaacaaaagagcagggcagacccagccatcccattactgggtatatacccaaaggactataaatcatgctgctataaagacacatgcacacgtatgtttattgcggcactattcacaatagcaaagacttggaaccaacccagatgtccaacaatgatagactggattaagaaaatgtggcacatatacaccatggaatactatgcagccataaaaagtgatgagttcatgtcctttgtagggacacggatgaaattggaaatcatcattctcagtaaactatcgcaaggacaaaaaaacaaacaccgcatgttctcactcataggtgggaactgaacattgagaacacatggacacaggaaggggaacatcacactctggggactgttgtggggtgggaggagcggggagggatagctttaggagatatacctaatgctaaatgacaagttaatgggtgcagcacaccagcatggcacatgtatacatatgtaactaacctgcacattgtgcacatgtaccctaaaacttaaagtataataataataaaataaaataaaataaaaaagaaaaaaaagagagcagggcagcaagagattcacggggtagcatgggtatggtggccagggcaggcctggatgcctgcaggagagggagggaagtgaagcggtggatgccgagtgggtgtgcaggagcccgggcatctacagaaccccagtccgagccccaggaggcagcaccatgtcatggtcacgtggtgccctgagaccattttggtgccctgagattctatggatggtggcagagttttccttgatggtggcagactggccgggtggtggagggattggcacgtggctgccccaggccacaccatgaggtgttgagagagatcctggctgctcagctgccccgagtgtgcagcatggagcaggggcggctgctctgacggctcacagcaggagaggcacctggagagctgggctgtgatcaggcccagtagtttgcagatgtctggagagaaactgagtcagagaggaagcccaggaggttgtgagcctcagcgatctgagaggcatgcatgttgaagagtgagtgaggaggatgggaagcctgcaggcttggtgggtcctaaagttgcaagaacatcactgtcccctgcagctaagtgggcctgatgtactccactcaggccacagttgctgtacatgatctcttgggaccctagaagtgctcctttccatgatagctctttaatacattagttaaaacgattcccaggaagcccttgttccaagtatgcaggatcagataaaaagcgcagaaaccctcagagcagggaccgacggtgagtgcagtttgccctcagaggccttggtagtcaccccttcccaacccccatgccaccactgaatccccatgtggcttgttcttatatgccctgcagctgaaattcaggtgccctcctgaccttccttcccctgtccattttgaaaagaaataagcagtgtaatctttgagtcatcccttttgtactagccaagttccaggtgcagcatgacacactcgttatctccacctctcttctccccttcctttccctcatgtctgcacacactcccatcccctcacttcttccccctacagcccgcctctctctctctcacacacacacatacatacacacacacacacacacacacacacacttgagaaccgcggctgcatatcatctcctgtggacctgtgcacaacctgtggggcccaacttaaagtactgcatccattctccgtggtttatcctaatttaggtttgtttcctggtcatatagaatactgaagtatatgtctttaggaactgtctcaatttcttagagaaatgggatatacgtgaataaaatttttatgattcccttatactgagtcccacttgcactgcaaaggattaataacatctgtttccaaagcaaggcgtcacctgccatgcaagccacctgctggggaggggaggtgaagggtgtgagcattggtgagaggtgttgttctcatgttcaaggtgacaggtatgttatctggtgtccccaggctgggtcccacccagggcctgctcctggacgagggctgtatggctctgatttgcacacccctgattctggtggacacaaccctttttcttagaaagccagaatcactgtatcttctagtccttagctgcataaaaaaatggggtgcaaaacttctctggactgtctattcttattgttcattggtttatcctgcagggccacccatggagcccgtaacttaagatgcacaaatgagctattgagtgaatatgtgtgtgtgtgtgtgtgtgtgggtgtgtgtgagagagagagagagagagagacagacagagaaaaagaaagaaccatctggagggctggcaaaagcacagatgtctgcgttccatcccctgagtttttaattcacaggtctgtgtaaggactcttccatttgcattcctgccaagttctcaaatgatgctgatgctgctggtctggggatatggtgtgagcctgtttgagatacctgttacctacctgggctggattaacaactatgatcatttgagattttcatagttcattggagggtctgtaactgcatttgcagttgcaattcctgcaaaatgcccaaatactgtattattggactggttccgataaagttatctttgaaaatgcctctatttctagaaacttaagttagatagtaaagaaattcaggccatgagtcagacaggccctgccacttaatagctctgtgatttggacaacttaattttgctctctgagcctctgtttcctcagtaataaaatggggagactgatgttttatctgagtcattatggagatgacttaagtaatgtgtataaagctaagccaatggttctcatgtctctgtggttcctacatccatgaattcttttctttcatcagttctgaaaaacatcttgctacttttttcttcaaatattgctctctgttgttcttgcccatttcttccttcagagactcctattaaatacagtttgaccttctcaattcatcctttatattttttattttcccttgccttttctgtgtcctgtgctatgagtaacgtcgttgaattattcttccagcgcactaatttttccttcatttgtgtccaatctgctcttacgctcattcactgattttttttaattacattttttagaaaatttctagcagttctgtttgtttgtttgtttgtttgttttttcaaatatttctggggcatttttagagtatcttattggttgctaatttccatggttccgttttttattttgttaaacatttcatagtttatattctatatctgattattctactaccgaaacttttggaggatgtaaatctctctctctttccctccctaccccttttctcataactcatgcttccttatgttttcagtgatctttctgagcttatgcctgattgatattaatctgtgggaatcctgagtattcgatgctgggaacactttcctccagagttgaaggggatttcctcttcacaggtccttgctttaaggtgggaatcccacatccaggtgctcactgggctgctggcctgagattctgtccctgtccacagctgtgctgatattggcattggccctttggccaaacccactttaattgctctcatttgccactcactttttgctgttcaagtttcaactcactttttgtcctatacttcaatttcaaaagtgaatttgcggcttaggaaaaaccttttccttgttcattgaggaatgagactgtgttaggctgtcacgagcctcctttgccacaacaaaaactctgttccatcagtgctttcatatgctgccgtaattgatcaaagtatgccattttatttgacacatgtggttttgcagacctaggtcatcataaagagtcatgacctgtctgaagttaaaacttcaaagagagttgtgggctgatgtcaatatcacttcattgatgctgatcaaagtctccttgaagctgaaagacaagatgcgttaaataattccaccttcatgaactaaagcagagggagagaatgagagggcgtttgtaataaaatgttttaaacgacaggtgtgttaaaacagcttggtgtggcctcagatagggattgtgtactgatcttgctcttctttgtgtggaatgcacatgtgcctcagtagtgctatggcgcaaggcagaagcactcagaagttgcattatctatatctttcatggatcagtaaagctggcatttctcctgcctcttgctgacatacacactgttcaggacctcattcgctcccacatcctcctcttcccctctcccagctctctttgagaaaccactgttgggagatggctctgagtgagaactgcccacccaacccagcacaggccccctctgtccatctgcccagcccaccttagccacagtgagcattcatcctttgcacatctaatgcacacagccaatcccaggcatcttccttccccttgtatgagtctgacaactgacccggtgatactctactctgccatggaaaaaaaatggcaggggagaatgagaacacctagtgggctggaatgtgcccggcttttctgttccgtctacagcagatacaggcagtgtccccgtagccctggggaggccaccttgagtgcctcactacttcttacatcctcactttccccttggtgcccgggcatcacctctgtatattctctctcccctaggagggtgcaggagagtagaggagtccagcccttccaggccatgccccagcagagtcaacatgcctcacctttggatagtgttctagtgtctgtgaggcacaaggcctgctcaccccagaggccaaggctgcctaccctgggaaagtagacatgccgcaggtcaaggactgtctcaagaccagttaggacagcttctcagcatcatctcaagctcaagccctggaaatctcaggctttgcaatagcaaaacacaaatctgttaacttactcctcccaagacaattactgggaaaaaatattttgtaaatattcaaaggcttctgtgaacagcctgaggccagatgaccctgaaggcggaaggcagcaagccagacaggagccaggagccttgcctgtgtgcacgccctctctgggtgtctgtagagccataagcctgggtgggtgtcctgatgccaccaccagggcaaagctctcagtaagaggacacagccaagaggaggagcaagccttccaaatcagtttgtctcctatgtttaattaaaaatagcctggtccaggatctgcctgcagccaacagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgttgccaggactggccagggctgcttggtggagcacaggaagagaggggatcgcctgcagaacctgtcctcttgaagagcctcaaggaagtgaggcctttgcagaaactgcttgttccaaagcaaagggcactctctgtttcctctgggttgctctctatttcctcctggtaccagctctctttttatactgcttttattgtgaaatataaaacaaacacataagagtgcataactaaataggtacaacttaatgaatgattatcaagcaaacacaacccagtcaagaaatgaaatgcacccagcattgcaggagaccactccgccctcacacactcatacccatctgtacagctggcctcctgggaggcaccacctcctgaactcttgtgttcatcacgcccttgctttttttgttatttttcatttgtttgtttttttagttttaccacctaggtgtacatcactagataaaacaggtggcttttgtctgtttggggactttgtgtatatggtagcatggagtgagttttatgtttgtgagactcatctgtgctttgtatagctaccatttgctcattttattgctttagaatacagtattgtgtgaattcctacaatttacttgctctgtggtcacttacgttgtgtgcagtttttgataagcacagatgaagctgctataagtagccttggggtgcatagtgcacacatttcatacacctaggggtggaattgctcattcacgaggtctgtgaatgaataagttcagtttcaggagactgttccaaattgttttccaaagtgggtgagcccatttatgctcccacaagcaacgtaggaggggccttgctgctccccactctcagtagcacttagaatgatctttctaacttccaccagtctgaagagcgtggaatggtacttccctggggtcttcattcatgtttgccagatgcctaatgaggttgatggcatcatctctcagggaaacctgtgcttgtctgtctcagtttttaacaagaaaatgtcaatcaagacatagggtaagatggagtacagcagattggacatggattcagaaaccagagttcagatcccatttattactactatctttttttctggagagatggcgtctcactctgttgcccaggctggagtgccatggtgcagtcttggctcactgcagctttcacctcctgggctcaagtaatcctcctgccttggcctcccaaagtgctaggattacagatgtgtgccactgcacctggttcagatcccatgtattatctccatgaccttgaggtcacagacgtaaaagattaaattataggaaatactttggagtgacatattgtcaccattctttcaaggccaacttttataggcatatgcatccactcttactgctgtagtatttggatagctctctataccctcaaactataagccactgatatgtatagaataaacataaatagtctcactttataagatactttccctataaaacagactcagttctctctttatatgaaaagattaccatgtggttttttgttgtgttgtgttgtgttgtatttaacagtcaccaactgctggctgtagtcggccatgtggctgtgaaaagggagctcacaccttgggcgctggcaactcggttggtttgggaggaagaggttgttctcacagtggggaggtttcagcacagccacctgctgaggccacagagaacctagatatgtgtcctgtaccctggccagctgccctgagctgtggggtgctgtgcatggccaagcaccgctagaaaagacacttattctgaatttcactcctcccatgccatcgttcagctttcaagtcttgggttagctttttgagataagtctccatggcaagggacaggaaagcatggccatgtccagttctgaaggccatctcaactctccctgtggtcgtgtatctgacttcttgcaaccaggaggaggcatcagaaatttccccagtacccagacgtcccaaggcagttgggcacacttgaactctgccccaagtacagtgcatttgggcacgtggcttaacaattttggacctcagcttcctcattttagaaaatgcaggggccaaagaggcttcctgggacttcatgactcaccctcagaacctaagatctcatgaaccaaagggctgcagctgtggagaggggagaatggggcagtgtgtgtgactacgaagctaaactgggggattcgcacccatttcgtgccttttcagcctccactgggacctcgaactccccaagtcccacaggtcttccaggggatctctcacctccccatgagtcataagccttacgtggcatgcactgcagtgggggtgttgttccctgcctggcatcagactcctgtgtttctgttcaccaggacccagggcagggggttgttctgagggtcgcccagcattaccatgaagacagagccttggctgctcagcacggccagcacagctctggtttcacctctgtctcttcaccccacagtggatgtcattttcttctcctgggggtgttacccgacaatatcatcatttgaaactgtttgaagtccagccctgcctccctttcctgcattgggagcttggaagtccagccctgcctccctttcctgcagtgggagagtggaagtccagccctgcctccctttcctgcagtgggagcatgggagggactgaggaaggcccgggggatggaggcttccataaccctccatctctggtccagaagatggctggttaaaatgcccaccaaacacccccacccacactccaagctaggtggtagagctgtccatcttggatctaacccaaatgcaggccctggtgaagaaaggtgagtccacagtgctccacagataatcagggcccgtggtgcccctgtgctcatcaccctgagaagcgtcactgctactgagcaccaggctctcctgaccactgcccagagctcctgggccctgctagagcttagccatggtccattcatcaccaacctgctagcatttccttgttgcaagcttgcccactggcatcatccctgagtggtaaactgggccttcctgggttgggtaaagcccttgaccctgaggctccaaactctgccctccagctgccttgccaggtgacaggccccagagagcggctgctgaccattcaggccagggtgcttcctcccagggtcccacctggagactggcgggcctggggatgatgcagttccatcctctcttctaggatccgagccagagacaacaacggctcctacgccctgtgcctgctgcacgaagggaaggtgctgcactatcgcatcgacaaagacaagacagggaagctctccatccccgagggaaagaagttcgacacgctctggcaggtacccagcctcctctccccaccttgtgggtagagtacagggcacgtggggctccttgtcccatggactcttagacatgagaggaactggaccacccactgcccacagtgtggtccccaggccagcagcagctctggagctcatgagaaacacacacctggaccacacctgggctcctgccccacctgcccatcagaccccactttcagcctccaggtggcttctgtgtttgagaagcactggtccagaggccgtcatgtgaggtgaacgaaggttccatggcttgttcagggccactcagccctcagtgccacaaggtgatgtaagtgcagggctgtgttcagagtttaacaagacactctctttggagatctagaaaatatttcttcctaggatattctaactagagcccagaacagcctttcagacaaagacacacaaaataaaggaatggatgcctggggaaggaggcctaggaacagccaagcaggactttgttggtggtgtgagaggctgaattagacagcaaatgtcaggtgccctcctcattgtaaatcgagtctctctctgtggaaactaaggcaatttaggaagcatactccctgggctccaggctgctgcttatgctgattgccacagccctggtctaaaaagtgcttattcctgacccagctactagaaaaccctgaaacaactcccaatttggaagttccttaggcactaatgagcactaaaataatgctcatcactgctttccctgaatcgcagtgagcacagattgcttgtcttaattttgcatcacagctacactggctgatgatgaaggaaataaccgtaacagtacttcgtgcatcatcttcgcagagcatcctataaactgtagtaggttcagaaacagggagaaagccaaccgactctgccaccaccccaccgccccagagcaccagctaccttgaacatgtgtgggtgaggggcataatcagggcgtgttccaatgtcctcacccaagcccagctggggccacacatgcagtcaatgttgaggaaaggactcaactcaaaatcctgtcttttcaaaaactgagactacagagccttagcccctttaaagcacttaaacttactacttccaaatgtgatttgctttctagtgctgtaattggaaaaaaaaaatactccttttttgaatgctggatatgatcatattaaaaaatgttagtcacaacatttacattgtcttttgattttgtggctcattgccatttgtcatcattaaccacaggcttctttcttttaacgatattgattcgaaagagtatttaacctttctacactcaaagccccaaagcacatcagggaggtgagtagggaatgtggccttctggaatgcaaaggcacctggagtcctctatgccagcttaatgctccaaggtcccaggccccatcacttataaacagccattcattcaccttctcctgaaagggcattttatgtgtgtggcgttctgtcaccatttcaaaggctgagcactcaccatagtgttaagcatctctaattattgagaatgtccttcccaagaatctttactatttgtattgattcccctggtagatcatagcattcatccctaattaaatattcctcattgtatattttctaggcactgtgtttaggaaactacgtcaaaaatgccagcaatacgttccaatttcccatgcatgatttcattgatttttcttgacagcgttctaaggtacttctgtaccctacccaactccagggccccagtgctatttcacggagagttggtgattgccataataccctatttcaatattctttactgtagaccagggatctgcaaacccacagaccaactctggctctcagcctgtttctgtgtagtccctgaagagaatggtttgtatgctgttaaaggtgttgttttggataaataaataaataaacaaaggacacagatacggtatgaggcccacaaaagcctaaaataccactttctggccctttacagaaaaaatttgctgcccctagcccaagaggggggatccctagctgtgggcccacttccccagccacccttgtggagtggacttaagcacataaaagcatttatgtgtcttggggccacttcgaaagcccaacagtcagtcagtagctctcagtcactatttgtctatttcctgaccttggtatttaccactttcttacttttttctctttcagctagtcgagcattattcttataaagcagatggtttgttaagagttcttactgtcccatgtcaaaaaatcggcacacagggtgagttcccaagacactggagtctcagtgtttgaggtatcagtgacaatcagcctcattttagacttagctgattgcagatttgggttggatgaggacttctttttacgggttgattaataatgatatcagagcactccgattttgtatatcgtgaatcaaaaaatagccagttgctttaactttaaaaaaattgtaatttatttgtcttcattgcatgcgggaaaaagtaaaagagggtcgaaagaagtacctgcagaaagcgtgctcacttctcaagcagcagcacatcctgatctcattgattgatctgcagtggggaggggaaggaagtggtttcctcagatagagcagtaattgtccatgctctctctaaccaggaaatgttaattttggaggccgtccacaacttccaggttcccatcctgcggtaagtgtcactaggaataccactgaatgagaagctgttgcatatttcacaaatgaaaagcatgttttagctaacaggagtagtaggcattgatattttgattgcgcttcaaaacatactccgtgatgagctgggattgctagtgagtgttaggcagaatcagcctcctattagtgataaactaaccacattttcttttctttttttcttttgctttttttttttggagatggagtgtctcactctgtcaccctgactggagtgcactggtgcaatcacggctcactgcaacctctgcctcccagcttcaagccattctcatgcctcagcctcccgagtagctgggattacaggtgcctgccatcacacccggctaatttttgtattttttagtagagacgaggttttgccattttggtcaggctggtctcaaattcctggcctcaagttatcctcctgcttcgacctcccaaagtgcttggattacaggcatgagccaccacactctgcctagccacattttcttaacttcttgtctagatgaaattctcttcatttttggagaatatacacaatgcgaatgaaacccaatattaaatcagaagtaggcctcttgcaatatttgagaaatgggaacatattttttagcttcatccttgagccgtctatgttaacacacgtaattcacaggacctcagctgtctcctccctccagcctgttaggaggtcaggtacagatttatgctctaagcaggaattattttcctgctcttttcttggggctacatatggccttttttttttttttttttttttttttttgagacggagtctcgctctgttgcccaggctggagtgcagtggcgcgatctcagctcactgcaagctccgcctcccgggttcacgccattctcctgcctcagcctcgcgagtagctgggactacaggcgcccgccacaacgcccggctaatttttttatatttttagtagagatggggtttcaccccgttagccaggatggtctcgatctcctaacctcgtgatctgcccgcctcggcctcccaaagtgctgggattacaggcgtgagccaccgtgcccggcccatatggactttttatgccctttaatgccatctgtgaagtgcgccctctgcacctcactttttgcctggtaacccttgaaaaacaaaatctgcagaaagccaaatatacatcctgcctccagtagggacaattggctgcccagtagctgagcccaggttgaaacaggggaggctgtccaggggcagcacttgttatcaaatgcagggaacgtgaatttgctaaaataccagtgacctttgggatcaaaatgtaatgcctttatggaagtgtgactttattttgccctttacagggctcacaggcctggcaactctatcttaatattataggctcggtgagacagatccatacacccttcagatggatgagggcttagggctgagaactcttaaaagaatgtcaagccctgtgcttagccatcatcacccaatgactacaagaagttagatattttggaataactttttaattgactggtaagatacatacgggaaaaaaaaggcatacgccctatgtgtacaactcaattaatttccacaaaattttccaccgtggaaccagcacccaccatgaagaagcaacacaactgagcactcagatctacttgtagtttctttcggtggtttgtcttgagcttacaacttaataattccacgtgaagcatgagctagtgaatgtaacagctctaattttgtagccttcagtggaacatatttcccaaatatatttctagatccttcttcccaagtggcaggcccttccagaagccttcccaatgatcaggtgttgcccgtggtcgatctcattggcagggacaggagggggttagtggtgcgattatagaagcaaatttaagtagcatgtcatggaagggatcctgtatttgttttctgaaacatttactgttcctctttgccgttgtggtttctagacttggtcagcgggtggaataatctcaagaatcaaatcatactccttcccaaagcctggccacagaaaggtgctaaagcaacccctgcttgctgtccaactaagtggtaggaccaacgcgcactcagctcccgcccgcccagtctgccctgtgtgtgcgctgccccccatctcttgccactctgcttccaggcctctttgcccttgctcacacctgctgttcctgggcagccgcgccccaggtacatcatgtgcttttcatgtgggtcctcagtccgtcagctggaagtccaacagtgtgagcatgctttctgtgctcaagcgtcattttaaagtcgtttcagttggcgtcatccgtcatagctaattatcatgtcggaaaatcttttcaaagatggcccacttactttttggtggccagactcacgtgttgcagtgttctggtaattgattatgtaagttacgttgtgatggagggaacaccaaggttttgtgaggcgcgctgcacagtgaggtcaggcagtgcatggtaacttcattatggcttagacgtctaacatagaactgcaaatgtgacatgtaaagaagaggtgtaatctgaggtctagaaaaaccagttttctttttgaggcagtaatgttgacatctcattgatttccatgttttgttctattattggattttgagggaaaataaaaataagttctttttcatgacttttatttataatgacttatttattccttcccccaaaatatgtatatataatgtgtttgaattgctttttttccattctacttttattatcagtggggtaaaattggttcttttatcagtaattctttttattttcatattacttggtgtttttaccgacattttagcatataattgagcatccactcatgaaatagattgcctaaagtatttactagaaacaacagaaataaaagacataaaacccttgagattttatttagtaataattttccaagtttactcatactcaagaagttctcaatcgtgttgaccatagaacagaaagatttaatgcagtgttcgagaggaagaaaaggtttattttacacttgaataaagtaactatgtctgtttttcatgtttacccaaggcaaaacacccccacagattactcacagtggctaaagaaatacctagaaaataagttttggtgcatctttagactacaggagaacatgtcagaaaaaagttgaagaaaatatcagtgaccacctaaaaataaagaagtatatgtgtagataacaaccataacatcatcaaaagagaaatgagaaactgggagtaagtagcactaatgctgacacatagattaatagctttagtatacaaagagattctaaaaataattaacaaaaatattaactgtctactaggataattggcagggaatatcagtagtagtttatagtaaagcaaatataaatagttcttaaacatatgaaatgttgtttaacttcatgagaagagaaatgcaagttaaaactatggtgcttaactgtgtccacctatgatccaaattttaaaagcttgataacactgtagtaaaggcatggtagataagcactttcactcttccttggggaagtctgaaatgatgcaatctgtaagaaaggctctgcaattttatttctaagtatgtacagatattcttgcatttgtgtgaaatcatgtacatgtgaaggtgttttttccaaaattgtataattgacaaagtctgataataatttaaatgcctatcaatggaaaacaaatgaaattggttacagtaaaattgctactatgggaggcagctgagatctagaattgttttcaaaatataattttaagtgtaaaagtcaatgtcctgcaacacacacatacacatacatatatgcagaatgtgttgatatcgtatacagtatcctagaaaaatacagaaaatgctggcaatgctggttgcctctggagtaagagatgggaatgttaagaaatcccacttttcattgtaaactctgttgtatctttttaaatttgaacctgttaagaaattttaatcaatttttttaaaacagaaaattaaatagtagagagtaattaatctgattaatattgtgaaaatacctttctggcaaaaaaaaaagtttgctttctatttaagtttagaagaactttaaagtatacattgaattttttatagaaataagaaactggaaataaatattactaatgatgacacatatataaggccaaaaatatcaacagataatttttaaaagatcaaggttgtaaggtttaagctatagattaaaaatattttaattgcttatcagaaatattttagagctaatatgtatattttcacaaacaaatggggaactttccattatgtaatcagtcatgagaaaagaattgtgagaattatgtcaaatgtcccatcatgttagctaagagataaataactttcttgaacttgttaatttgctcagtgtacatagttgttttaataattcaggcacaaaaaatacatgttagaacttgaactacctatagcatctagatagttaatgaaaagtatgtttagatttgaagatgattatgaatcagataatttaaatttttcataaaattactaacaggctgatgcattttaaacttgtctttagaaattagtagcttactgccaagcacagtggctcatgcctataatcccagcactttgggaggccgaggcaggtggatcacttgaggtcaggagttcaagactagcctggccaatatggtgaaaactcatctctattaaaaatacaaaaattagccaggcgtggtggcacacgcctataatcccagctactcaggaggctgaagcaggaaaatcacttaagcctgggaggtggagattgcagagatcgtgccattgccctccagcctgggagacagagcaagactctgtctcaaaaacaaaaaaagaaaagaaaagaaaagaaattagtaacatacttataaagtataaacaaaattaacttaagaatacaactagtagtctttaaatgaattaaacccctcccaatattagtcctggaatttctttctctgctgctttaagcacagaaccttatccttcttttatggaaaataggtggaaattaaacagcaacatctctaaaaagacttccagggaacttttcagctttgcatttcaaaggcacatcccctaagaggattaaactgaaatgtgtcccagaatttccaattaaaacccatttttcatgttttattccaacacatacattggtgattataatattttaaaacttacatttaagtacagggctcagtgggaagagaaaaaagaaagaaacatcctcaagttgtaccctgttgcttggtaatgccttagtagaccagacccttgagaaaatgtgttttcatataattataaaggaacagattttagatcttcactgtaagagaacagtaattgcagaggtcaagtgttattttcatggatctcagagcaaagctaatagtagcctattccccagccaacagtctgccctcgcctgtgggggtctactgaaccagggtaattccaccaaaaaaaggaaaccaaacctagtttattgcagccaatatttctaaagccagctggctcttttgtcactattattgtgatgactaatgactgtattgtcatctgcattactgctgttgcctaatttgaaaatggcccaagaatctgggagtaaaaattaagatctagtaaatggatgttaggacacttggcaatactctggaatcaggaaactctgaatggacctatcagttccacagaccaataattttttcctcttttgttcacttttggatcaccagcttttaaacataggcactcaaagaatgcttgtcaaatacattttctattcgcagttaaaccttaccaataggaaatcagggataataatttataactggacttattattgcagagtgatatccttacctgaatttataaaatttaaagaaaagtcaccagttgttcttttggaaggtagaaagcgaaggtggctaatgccatctagcggtggactgaaggtttgagcctgttctgagtattagcaaaaatgaagaaagtggaatggtcaacatttcatttacaccttgttgctcactgtgcagaacagatgacacttattgattgggacagaatggctctctcaaatgcaaacataaagaataaaaggttaatagtaatgtagaccggaaatatattttttattaaaattaaatgtcattacattttttaagaatagtatttttacaatttatcattatgccactgtgctcattctttacaaactcctcaaatttttctttttaactgagcattttcttttagagattgttttggttattgttctactaagtggcatattcaccaagtgctttgggaaagatgaagcatggattttgcatcttcatctttatcataaagtaactactgttcttttaactgactcaataggaaacctcccatttcttccacattcttccagttgtggcatcattctttgctccagtcctgttagtcaccagaaagagataggggcagggagcccagggatctgggtaggagagagttgatgtggggttgttgagagacatgagggttctttgtggcttggcttaaaaggcttataatcacatagtggtctgtgttgggcagcatggaaatgaagccccaagctttattggctataaacgtggagttctaatttccgaggaagatctcccatctgtttccctatccataagccaagatagactaggggtgaacaacacactgctagtgagagtataaattatttgtgcccaggggtttagattctctgtgtccatcgctactaattcttactcattcctgacaccctagtatccctttcagcatattttgacaaccccatctctgttttaaaattcttccctgcaggattcatatgtcagggaattgcgttctggtttaattggaacaagccatttggaagtcctcctggtctggagaacattctgtgaggtagagaggctgcaaccccaggataatgtcctcagtgggagggacaggaggtcttatgtcaagaagaggtgatggtccctctcctcaccagtgatggctagtccgaggacatcctttaattccacatctgttcaagttttgtctttggatctcagaatgtgcctgcctgcagggaaaatcaaaggagttgaaatgacagtaaatattaaccttgaaagagactttaaaaaaaataaaactattttcagcctagaattggttgcgggagaaaactgggcaaaagaggaggacagaaagcctaggggatcacccagtttctgtcaggacagttttccagaggcaggataattatattataaatcagaagtgaaaccacagcacagtcctgtaatcatatgtaaatgtttaaaagaaatagattgtcatttggaattattcattcttatttctcttcatcagcataaaggcttgagagagagctaatttttaaagcacattagattatacttcacatctcctagtttttagaagtgattttcattcattcacccatccattcattcatgtgtttgttcaacacatttttattgagcgtccttgtggacgtggcacagttccgagtgcagtgaataaatgtctccccctccttgagcttatattctatttttatttttgatgtgtcatagttacttctgttaatcagttcagtagaagtgctgagatactctgtgacaaaacagatcccatcgacatcatttttacaaataagaccagatgtcctttagccttgtcaacaggcttgggccatggtgaacaatgtctgcctctgaagtgctcagcagaccgtgtgaaagaagaaggtccgggtgtttggaaacaatggctgagtggcggtagtggtgcattgtgacctcattattctgcttttggtttctcgccttgtaatatgaataaggcacatgaggatttagtgtgtgtcataagataagtgactgtcacgttaagcttaatgtctctgtttctgtaactttctccataatctggcagtatctcatttcttcgtggccagtgtttgggcactgaaaaggtcaatcaatacatagaattgtgactcaactcacgctgaaaaaaaaaaaaaagcatctgaatcatggttctcctgtgaattaaatttagtagcaagaatcttgttttaatttggaagaaagggtgggtcaggaaaactcaagatagagactttcaaaagggaaagtccttaggataatgagtagatttccccccccagttgtttcatgatataaactgatgtggaccaaataaatacctgtctcacaggggtactgatttccagcattagctgtggcagctggagcattgctggcctaggtggcagcaactggccttcccttgggacctgtagttactgaccagtgccaccctctgccatccaccccaatgctgctgcatctccaccgaagataaagacttgggtggagacttggaaaacatatgtgcgttggagttgggaagtaggtaggagcagctgatgagtactaattttcctctttaaataatgtccatgtaatatgaaattgaagagcacaagttaaagaaggaaaatgcttccaaggcgaacatgcaaatcatcagcgatctttggtaggtgggaataggatgtgcaagggggtgagtggggaagcagctctatccaggccagtagagttgactctcaccacaccctctgaacacctcacagagtcccttgagttgtagcagcacaagcttgctttagcccttgcaagatccaaataattgcccgaagaatgagatcagccttattttcttccctgtttttcgtaattctttcctttgtctttcctgcaaaagttaaactgtgattattggaaaataaaaataattatgcagatcaacttaacagttttgtggatgaagaaaaacaacctgttgtcctttatgtactttagtcctcccctgcccaagggaaccggcaagagagtactgtgtcattcaatccgtatgagccagaacttgcaccctgggctgcagacaaaggtgagacttcctttcattcaagggacattcacagagcaaagtgcgtggtcacttgtaagtttgtagagttggttcacgaatccacaccacgtccgtgattgcaatacagccacagttagccatggaaacactcacatctagtggcaggcagcaggcaccacatgcccatgagcagtgatggtgctattgaatgaaatggtctttcccacctccctcacccaacgacgttggaaatgtccctgccactcttcagaatttctcatcccttgcaacattgatgctactctgagttcatattcccatgaagatcatgttcttggaaggatgaatcctggtgtggggtccagccccaggtcgtatgtttcttgactgcattgcaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaagtaagttgctatgttccaccagcctcaccctcacatgagctcaggttctagacatgactgagaataacaaaatgtaacctggcatgactaaaccctttttttattaatgctaccattcttgttaatttctggtactattataatgaaagcgtccattacctttaatggcaaaaactgcaattacttttgcaccaacctaatagtacatgcaccttatggaaaattaggaaatagaaacaagcagaaacataagaaaataaaaacatcaaattggcatggtggctcatgcctgtaatcttagcaatttgggaggctgggataggaggattgtttgaggcctggagcttgagaccagcctgggcaacatagcaagaccctgtctctacaaaaaaaataaataaataaataaataaataaaacataaaaaattagccagacatagtagtgcacacatatacttccagctgctcaagaggccaagaagccaaggctgcagtgagccatgattgcaccactgcactctagcctgggtaacaaagcaaggccctgtttcaaaaaacaaaacaaaaaaaagaaaagaagaacatcatatttgtataataccatcccaacactactactgttaactaaacattactactgttaacttaatcttattgtatatatttttagatctttatttgtacacacagatattatttaattaaaacaaaatcattccattataacaatagtttttacatttattttctttaattttatagttacatctcatttttcttacatgaaaattattgattccaaatatgattagtataattatttattggctttatcctatgatttcagataacaatacatattatacaacagttaaaattgctaaatttcgaaaatatctttgtatttcttttggtctttagaaggtacccaacatagaatgtacaagtaaaactactggtttctaaagtcctttgaaatacaccctctgtttgaattggtatgatactaatatgaatgtggttagatttagtagcttcatggtatttcaaatgtaagggatttttgtaaaaaaaaaattcgtgagtaggtaatttttatgattcaagggttaaaaatatagacaaaaatatacacagacatgcgtgctttccggccgggtgccgtggctcatgcctataatcccagcactttgggaggccaaggtaggtggatcacctgaggtctggagttcaagaccatcctggccaacatggtaaaacctcgtctccactaaaaatacaaaaaattagctgggtgtggtggcatacacctgtagtcccaactacttaggaggctgaggcaggagaatcacttgaacctgggaggaagaggttgcagccagccaagatcacaccattgcactccagcctgggcaacaagagtgaaactctgcctcaaaaaaaaaaaaaaaaaaagaaagaaagaaaaaagaaatgcttgctttccaatctgtcccttcgatttgtttttgtgcatgtgtgtgtgtgtaaattagatacacatacatgtatgtatacacacacaaacatacacacatatgtatacattcacaagtatatacatgcgcacatatatacacacacaatcaaaattggctgtgatacttattttaaaatatatgtttgtatatcacagtcattttgtacaatgagtaaaaatgtttctgtattaatcctaagctttttcagattatgaaaggttgtgatctttattctgtgcttaaatttgtgaattaacatagacatgactgtggacataatttcaactagagaatttggggagaggagaggctctctcggtcaatttggggcaaaatgatgtctttacaatactgagtctttcaatctataaacacagcccatctctccatttaccaggtcttcttcagcctctctcaggagagttgtttaccttttcaatgtattacattgaaatatatgcttttaaattctgcacctagaaattcactttcaacaattatgaaaggcattttatattcacattcattacatgtaatctgagatggtgaatcccaagatgttacaggaattcgtacatgtcatcgttggtgaagtttatttacaagttatttaaatattttacagtttagggtttttgcttggttgggacattcttcagtactgttcttcaccattctttttattttatattattttttagaaacagtgtttcactgtgtcacccaggctggagtgaagtggcaagaagctcactgcagccttgaactcctgagtccaagtgattctcccacctcagcctcccgagcagctgggactacaggcttgcactgtcacgcctgggtgattttttttagagatgggggtctcactatgttgcccaggctgaccttgaacttctgacctcaagcaatcctcccctttcaacctcccaaagtatggggattgtcagcatgagccaccatgcccagcccccaccattcttttttagtaatggagtattactctcattgtctataaaataagggaatataggttggaaggccagccatccattacaggcttctgaagacacattgccactctgtggcaggtatttccgtgggactgtttccacagggggattatgcttcacaggataagattatctagaagtgaggcattttggaaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacagaatgatggccaccgaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggcattgagtcctgaagagctatatgctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggtaagtacaacttagctaatattcagagcagcaggtggtaaaaaatgcaagataaatgtacgttttctttattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcaggaatcgaggtattaagtgaagatttgttttgaaaaaagaagaatgggattccttcattaagttaatttgaaaagtttgcattggacagcttgattcttgcaggatttccccgaagcccttttcatgctacttaacattacgaatctcagtagagggtttactgcactgcatttctcaaaccagattcatccatggcatccttttctgataggacatttcataacatgtggtggaacactgtcccacagcatggagctattggagcttggagctccagtactgcagttcagagctccaatattgcagcttggagctattccaaaataactttctaatgaacacctacctatacatgcaaaagttagaaagtgaagatttaccaaataaactcgtcatctgtgtatgtccactacatatgtagaaattgttctattggcttaactggtatccagaagagttgaagtgtcaaaaaatagatgcagtgctggaaagaagagatctagatagttatgtgactgaagctaaaagaaatatgccccttggtttggtgaggcagagattatcaagaattaagggtggacttccagcaaaacataaagtagaaactagttctgggtgcaggtttggacttcctaaaaaataatttcacagtgaccaatccccttgctaatataacttgacccctctctgaaccctcaaatgaaccaataacaactaaaagaagaaaagataagaaagctctatcttcatattaactcatctgtggtgtatacctagggtctatgttaaccaactggaaaacgtgatggcaccaatcccactgagtcaaagagggtgccgaaggcaggttaacaaccctgctagtctctggtgaagtccacatgctcagaaatagatggcagaccttcaaaatctacctagtgggtggcagataggatcctgtgtttcatgccctgcagtggtcagagaccccaccctgagtgacaatacccacccactcacctttccctaagaggcagtccatggactggtaggtgatggggaatggtggacctcggccagcaaagggactgcatgaagggtaagccacaagagccaagctcccaggcaggcaggcagactccaccatcttgagcacaaaggccaggcgagagtacagcaggggtcaggctggccctcctcaccccattcttcatacagtagcttcccagaaggaagccccttcagaggtgaaccactgtgagaaaggcatcagcatgggcctggatagaaatagcagggaaacagagcaaggaagacagcagcctaggatgaccagcatgggacatgctggagaaagaagcctgttgtaatgctggatgtacctcatcatgatcattacagaaaagaagacagcctgtctgaaacaaggacacagaggagatagagaaaatgaaacatgaatgctgggcaccttatccactgctgtataacaaatcaccccaaacttactgccaaaaacaccaccaggtgttggtttccctgccgtcctgctgtgtgggcagggccaggtaggcagggttcagtgcgtctgctcacacaggggattgcacagtggcccgagggacaggaggaccgtttccactctgctcactcacactactcagccactgagcagctggttagacacagcccatgctggagacctctgcggggctgtcagccagctcacctgcacatggcctctccttggggcccttgggcttcccttgggcccatgcttcccttgggcagcatggcagctgcgggctgagagcagttacccaagaggcaggaagtgggggctgccaggcctataaaaccaggcccagaaactacctcagggtcacttccacctgatcctattggtcagagcagccaaggccaccagcttcaaaggatgggatagatagaaccacccttttgaggagaagtgtcaaagagtcaaagaacatggggccaattctaaaactgctgtagatattaaacagcataccattaaaaagtaaactaaactaaaaagtaaaccaaagattgtctttggacaatcaatgaagaaaaaaagccactagggaaataaaagccatcttggaagcagcaaaaagagacaaaactaccgaaaagatagggtagtggaagatttctgtatgaaaacaaagcaaagtgaaatggaaaagaataaaaagtgggccgggcgtggtggctcacgcctgtaatcccagcactttgggaggctgaggtgggtggattacctgaggtcaggagttcgagaccagcctggccaacatggtgaaatcccgtctctactaaaaacacaaaaattagccaggcatggtggcaggcacctgtaatcccagctactctggtggctgaggcaggagaattgcttgagcccgggaggtggaggttgcagtgagctgagatcgtgccactgcactctagcctggccaacagagcaagactctgtctcaaaaaaaaaaaaggaataaaaagtgaaacaagatcaaagaaaagtgctagctgtggaagcaaacgaacgctggcactcgggaaaccatgcgtgacagggtagatttgtgcagcatcacaactgaaaaacacaggtgttctttgatccagcagctccttccgagagcaaacacacacatctggtaatgtgcactctagcacgggctgccacggcaaaaatctggaaactgcctgacgactgctccgcagggtttggtccaatcagtcatagcagattcacaggaagctcacaatgcaacccttttaaaagtgacttatttgcatgtgctgacctagaaatatgtctactatacatggttaggtagaaaaattaaaaagtacagtgctcaaagaatatgcccctagttttatgaccagaaaaaagtatacactacctatttatgcatgtatctaggttattctgaagacagcctaaatttcattgcatttaagatttgtcaaaggtttacttttttcatcagttcaaaattcagaagaaacctgaaataacacacatggttgtattgttcatgacttgtaagatcaaaattttaaaatagcacacaaggtgatggaaacagaagtataatcagttgtatcatttggaagagaagtgccagggcaccttatggtctccagattgatgtcctgaatgtctccttgtgatccactgtagtgtcatgaaatcagttttcactgaaatcatgtccccctctccaccccaatgagacctcacacaggtgacatcagcagaagataaccagactccgctgtgtgccccctgaatcccaaacccagagagagggttttgctatgcagttttgacctctgtactatcacttgctttttaaaattaggaaattagaatgcttagatcattttttaatgatgctagcaagtagtgcatgctaaaataattgacctgggtggagaactgatcaagatggacgactaaatgcaactagtatatgctcctccgtagagacggaccaaaataacaagtacatattcacacttccaatagatggtctaagagagaacacagatgcaaccaaggagcgacaggaagcaccaaaagcaaagcacagggaaacaaggcagcctgcttggccaggaatgactgggagctgggagaagcttccagatatggggaaagcataaatgagagatccccagggctccacattccagccaaggacttctacaatcctagcgacagaagaacccctcgacccacgtgggccttaagactaacatagggagctgcctagggatcacacagaggcattgctccatagagggaactcacgctgagtcccacaggcttccaagctctgagtagctgcagcttggtgccatactgagaaccaagtccccaaaggactgcatcttgccctgggactattgctgatgctgccatcaccaggccaaggacagaggggagaatggacaccttcacacaccccagggacagatccccctgctgctacaggctgctgtggggctgagacacaagcaaatcacaccccctatagctgcctgcctacactgctccccctgagaatgtccgcagcctccccaggagcaggcccatagccagcgccattctgagagccaagcctccaaaggtctgtgtccttccttgggccagggctgatgctgccactgccccgccacatagggagaagggaggccaggcactttcacatgccacaaaaacaaataccaccaccactgctgagggctgctgtgggaccaaggctcaagaagactgcatatcccacagctacctgcctactctgcacctattgagagtggccctaccctttctggtggtaggccttcagggcagccactgctggcaacctagagaccacccctccctgcgtatcacagccagcagctgaatgcaccaccagggagcctgagcacaagtccattggcctagtcacatgccccaatacttgagcatgacatcctgttgcagccaccgccaacaccaacatggaccacttgggttccagtgagttgccctaccaccattactgccatcacccacatcacacccactccccaggaacccaagaacctgcccacatgcccagccactgcagcatccacacaatctacctgaaagcccaagggtcagccttcttagacctactaacaccagtgctagtgtataccgccctagggcccaaggacaggcatactcagctcactgctgtcaccactggggtctgaagactggcccacctagcatcctattcacagtacaccttcacaacagcctccactaataaccataccctaaggcactgagaaaatcacaggtgtcactgaggctgtttatggccatagaaattatacatagattaaatactgcattcaccccaaatcaaacccaaagtgccctacatatatatatgtgtgtgtgtatatatacacacatacacatacgtgtatatatacacacatacacatacgtgtatatatacacgcatatacacatacacatacgtgtatatatacacatacacatacacatacgtgtatatatacacacatatacacatacgtgtatatatacacacatatacacatacacatacgtgtatatatacacacatacacatacgtgtatacatacatacacacatacgtgtatatatgcatacatacacatatgtgtatatatacatacatatacacatatgtgtgtacatatacatacacatacacatatgtgtgtacatatacatacacacacatacacatatgtgtacatgtacatacatacacatacacatatgtgtacatgtacatacatacacatacacatatgtgtacatgtacatacatacacatacacatatgtgtacatgtacatatatacacatatacacatatgtgtacatgtacatatatacacatatacacatatgtgtacatgtacatatatacacatatacacatatgtgtacatgtacatatacacatatacacatatgtgtacatgtacatatacacatatacacatatgtgtacatgcacatatacacatgtgtacatgcacatatacacatatgtgtacatacacatatacacatatgtgtgtatatacatatacacacatatgtgtgtatatacatatatacatatatacatatatatacatatgcacatatgtgtatatatacatatatatacatatgcacatatgtgtatatatatacacacatatatgtgtatatatatatatacccaacatatatatacccaacaacatatatatattttcaggaaaaagacctcctctacaaaagcaatttcaaaaaactggaagaaatgactgttgtaccacatgggcagatatcaatgtaagaacacaggaaacatgaaaaagcaaggaaatatgatacctccaaaggaacacacaattctccagcaaaaaaatcccaatcaaaaagaaattcacaaaaccccagatgaacaattcaaaatattgattttaaagaagctaaataagatataagagaattctgaaaaacaatagagagaattcagaaaaacagttcaggatatgaatgagaaatttatcaaagaaatagatatttttaaaagaaccaaacagaaattctggaactaaagattcattgaatgcaataaaaaatacatcccaaactccaccaatagactagatcaggcaaaagaaagaatctcagaacttgaagacaggtcttttgaaacaacctattcagacaaaaataaagagaaaagaataaaaaagaatgagcaaacccttcatgatatatggggcagtgtaaagcaactgaatattcaaatcatcagtgtccccaagggtgaagagagaatgaaagattagaaatcctatttaatgaaatattagatcaaaacttcccaaatataacaacaaacctagacatccagatgcaggaggcccaaaggtccccaaacagatacaatgcaaaatcatcttctccacagcacgttataatcaaaccacttaaagtcaaagcaaaagcaaatatactaaaaagagcaaaagaaaatcttctaattacccataaaggaaccaccattagactaacagtggatttctcagcagacaccttacaggccaggagagaaggggatgacattttcaaagtgctgaaagaaaaatactgccacccaaggagaccatgtccagcaaaactattcttcataaataaaagaaaaataaagcctttcccaggtaagcaaacactgagggaattcatcaccactagactgatcctagaagaaatactcaaaggaatcttaaacgtggaagtaaaaggacaatatttaccatcataaaaacacacaaaagtataaaactcactggtaaaccaaacatacaaataatcctgttaaatagtgggctaagaacatagatagacatttctcaaaagaagatatacaaatggccaacaggtatatgaaaaaatgctcaatatcaccaaacagcagggaaatgcaaattacaaacacaatgagataccatcttaccccggctagaatggctgttattaaaaagactttttttaaaaaaatgctttgcagatgcaggaaaaaaaggaactcttatacactgtttgtgggaatgtaaattagtatagtcactacggaaaatattagagagacttctcaaaacaaaaacaggctgggcacggtggctcacacctgtaatcccagcagttttggaagcccgaggcgggcagatcacaaggtcaggagatcaagaccatcctggctaacacggtgaaaccctgtctctactaaaaatacaaaaaattggccaggcctggtgacaggtgcctgtcatcccagctacctgggaggctgaggcagaagaatggcatgaacccaggaggcggagcttgcagtgagctgaaatcacactactgcacactccagcctgggcgatagagtgagactccatctcaaaaacaaaaagaagaaaaaaaaactaactacacatagaattaccatatgatccagcaagtctactattgggtatttatccagaggcaaataaacttgtatcaaagggacacatacactcaacgtgcttatcatagaactattcacaatagcaaagatgtggaatcaacctaactgtccatggatggatgaatggataaagaaaatgtggtgtgtatatatatatatacacctctagaggtgttcactggttacttagggtacaccctatgtaaatgaagaggctaaagtgaagttacaaagttatttacttggtgtacaccctatgtaaatgaggaggatgaagtaatgttacaaagtcatttactgagtgtacaccctgtgtaaatgaagaggatatttcctgtcatagctgaagtgtttccatttgatttagttctaggaagtccttaggttccctgcctccaggccctattctcctgtctcaatttcactcagcataatgtcctctaggctcatgcatattgtagtgaattcccttccttttgaaggctgaatgctattccattgtctatatagagggtgttttgtttatccactcatctgctgaaggacacttgggttgctttcatgttttagctattgggaataatgctgctatgaacatgaatgtacacaattttatgcttttctttctttctttttttttttttttttgagatggagtctctcgttgtgtcacccaggctgcagtgcagtggtgtgatctgagatcactgcaacctctgccttctgggttcaagcaattctcctgcctcagcctcccaagtagctggaattacaggcacccgccaccacacctggctaatttttgtatttttaatagagatggggtttcctcttggccaggctggtctcaagctcccgatctcaagtgatctgctctcctcagcctcccaaagtgctgggattacaggcatgaaccaatgtgcccggcccacaattttattcttaatggaatttctccctctgctttgcttttaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagtgagccagtcctgcttcattttctcactgtggggccattagaacagataagcaccagattgtctttacaacaacctgaaaatcctaatctgagtctctcattatcttttaccagtaagcagttaatgtgccctcagtctattccaaactgagaatgaaatatctgatgctcactgaagagtgtgtttttcccattgtgtgtcaacacatgtaaatatacacaaaatataacccagatcattactcattagagttgaaatagaaataatgactatttacagtatcttaattacattttttagatcttttaattaaaacatatataccaaaaagggcacaactcttagcatgcagtacagtggttttccacaaatgaaacatacccatgaaatcagcccccagatgaagaacagaaccccagaagcctgtttcctctgcacacacagccttccccaggggtgacccaactgactccaacatcacagattaagtgctcctgtttttatacttcgtataattgaaatcatacaatgtgtactccttcatgtcttggagtggctgttttgttttgtttgactaacacctttaaaaaaaaaaaagcttatgcatatcttgcatgttgtaggggatgaaaggaagtgaagtcaccgctatgttagagaaaggagagcggatggggtgccctgcagggtgtccaagagagatgtacgatctcatgaatctgtgctggacatacgagtgagtacctgacactgactgtgatgtattcagatgctctggaaacaggtgaaatggttgggcgtctaaaaaaaaggataaagttcaccttttcatgaatcaggaatgtgcccgctttctaaacaaacaacggtgggggctggtcttgctttagagaccttgctttctggcccatgcacttacatgtagtagagcctaaagagcaagtttagatggggactctaacccgagtgtccaaatttaaatgtcgataatggtggagagatggggcaagggcagtcaaagtaaaaaagtgtttgtaagagtttggggctggatgccatttttggcatagaggatggcagaagcactcggtaggggatggtatactttcctgactccctgattaccatgagcagtgaggggtgacctcggactctggccagctcacagatacattggctaaggttgcacttccctagaatctacctcatccttgaagtggtggcctcagtccaccctgactgccgtcatacgtctcgcttagtggatcccaggtgctgttatgcttttaaagtacacctggcattattcttaggtgatgttcagggcagctcagcaaggaaggaaaatgcattgccactgaaaattaggagtacagttttgccaggctcagcagcctgcttgtgcgtgcatagcacggtgaccccaagccgccatctccagttccctggtactgaactgtgcacacagagcccacacagctgagaatcgatgtggtttgtgatcaggaggacatcacaaatcctggccatggatttgatgctttgcggaatcaggtttgccttcagatacagctgacattgccagagcctctgaaagatgagggctattccaaatgctgcagatgccacctgggattccgagacctcccctccccaccctgggagtatcactctaccacaattgtgagtgacagggaaataatctcattctgtatctagaaaccacccagggggcagccacaaaggcagcaggcaaactgtgggtatatgcttccctgcccctgctgctgccgtggctcaggagaggagcctggcctgggccccggagcatcttctccaaccccaagtgttagtgcaacagggagagctaagtgtcagcaagagggaagtgctactcatggatctaagaggatgtttattcctaagtcttggcttaattctcccagtgcctaaactagaatcgtaagaaccattggcaggtaggcactggcagcactggaccctggggagggcagcccttgggcacgtggcagcctatgaccctttactgaaagtgttctttggtccagcctgcagctccctttgcaaggcttcccttcttgtagaagggtgaggagggtagagtttaaaacattgtgatacaaatgcaaaaactttgaattaaaaatgaactcgcagtgggggagtttttgcatttaacgttgatgctgatctatgtacttctgtcgattcttctttgtggtgtgtgtttaacagtgaggagtgaaaggtgggtgggaagagagcagggtgcgcagccaggggcaccacctcccacttggctcccaggtgggtgcagtgaggctgctgaataccctttgggctcgtggtgtattcttgtgactcaaggaatcaggataggggctgctgggccgacctctgtcctccatggacgcacgtaacagtgggcagttatttccagagtggtccaccaggggcagaccggggagggaaagcagtctacgtgatattcactggatgttcaccagaattacagcaaagtagagcagtagaacagtctccttaagagagtattctttctaaacgtattttcccgcctggagatttaagatggaacctgagtgaggttcacaggcaggcaatgtctttccccttggttcccaccccagtccgctctgcaggggtgcatttcagtgagttctgcaggcttggaggagtcagctccagggcacaagccccagtcaaaaggaaatcatgacaatggcccatgccccatattagaaatcacagctctttatcagactttgatttatttcccaacaaagctatatttctgaaggttacagtgtttctagtagtgacctcaaacagggttgggggaggtggggagatgttctgaaacttttgaagcagctgtgtttgtctggggtaatacctgagctcgttgcctcacgccaaggaaatcaaagatgcagacacacaagaagtgagtttaagagcagaggtttaataggcaacagaaaagagaaaagctctctttcctgcagagagacaagggctcccaagtggttcttccggctccgtgtggaaatgcaagggttttatagacgagcttgagtctgattacatagggcccaaagatcggttggacagccaggccatttacataacacgaaaagaaactggctgccccaccctaatcttttattatgcagatgaggtctctccttggccgacgccatgttgcctgctttttttttttttttttttttgagacggagtctcactctgtcgcccaggctggagtgcagtggcgcgatctgggctcactgcaagctctgtctcccgggttcacaccatactcctgcctcagcctcccgagtagctgggactacaggcgcccgccaccacgcccagctaatttttttgtattttttagtggagacggggtttcaccgtgttagtcaggatggtctcgatctcctgacctcatgatccgcccgcctcagccttgttgcctgcttttttactgcacacgtggcaacaaggaaagtggaagagggaacctccatgttgaatatccctggctccagggatcccttttctattgacacagctgccggcatttacctatgtgagcttttagcttgcttagctatgcttgcagcttgatttttcaggctgctttttgttataaaagacatgatttaggagctgctttttattgcaaggaaaccttacagaggactctgttaccctcactatctgcctaaataatttctttctagctctgaatcactttgtctaaacataagaaattcaatgaggtgcagttgaatgaaaaaaaaggaaaagattccttggagcagggccacaaggagaactcagaagcgccaagggctggtcctggtaacccgggctattgcttgaggccctccagaagatgcagggggtccctcactgcaggcattgtcatcagttccagggtgtggtcctggagggaattcaaagggacttcccagcctcaatgacaaagccctgagaaggcagacagcatccctcacccttgtaagacagccagagattacctccaacccctttttagtcttaatggactcttcagctggacctagaaaccaaattgataccaggccagattaacaaaagaaaagcttaccaattttactagttttacatgtttatggggatcctcacaagacagtgaagtctaaagaagtggccaaaacaacatgcttttataatctttagacaaagaaccatacatttaaggagaaatgacaggacaaataaaatctggctagaaggagtaaattttctagagaaggcgctaggagatatgaggagggtgtaaaaccagtggaagataagggatactgtgttaaatatgtttactcaggcccattgcagctccaatgcccagtctctgatgataaggggcattttctcatcctgctacaggaagggtctccttcccagaggaatctttatggcttgctgcaggcatgaagagacaggtcagttagtcctatccgaaactacaatgtatccaatattttcaactcaaaataatcaatatcccaatctggcatattttgggatggcccatgcttcactccttccccctctcactttccaaagaggaaacacaacatcagagtcctgccctgtgcaggtcactcaaggaggcagcgtgaaagccaggaaggaaacactggccctaagaaaagcaggaatcagtcaggaagccttccactgtagtgttttccagagccaagtcatgcttggggtgattaaagacaccagtggggaaagcccttgcaaatggagagaagttggtgctcttgatcctgaaaaacggtttcctaatagtcccagccctccagtgggggcctctgccgaatggagaaatttcctgggctctccaggttctctgagagtcagggaggctctagatgcggctcaaattcctgtttaaagatcaacaagcccaagataaaacatgaattcccaggaccttggtgagatgtcccctggctccctgcacaacctcagctccaaggctttcctctgagcggcacatcctctgagagccctgggtcattcacagggtcggtggccactgccggagctcctgctatgcaggctgccaccccaggtgcaagcctcacagaagcctcagaccctgtccctgtcagaccttatagttggggctggggcagacaggcaataaacaataagctaaaaataagtgtgtcctatgatgtgtcttaggaaagggatgactccagtgggaattctaagcaaggagggcacaggggcctggaggatatcacgtgtatatatggggttttttaagccctctcgtgtcgaagtagtttctcacagttgcctgcagcacagaagcacattggagcttctagaatgtggtggattcaatgaagggactacaggtggtcctagtatattctctgttttgttttgttttgctttgttttttcattttttcctcagtagtaaacagccactctctccaaggtgatatatagagacagacagagagagcgggagggaggtagatgaagggagagaaggagggagggagggagagaaatagtctcattagcacaaacccaggtatggttgaagggggtttattatgagtaacaaaagatgctgctttcagcccaacaatcaggaaattccaagggttttaggagctctgtgccaggaacccaggataaagaccatatatctctttatataaaatcacacactggaaactttaaaagagaacagaaaattatggggagggaagcctcacacttccagcaggggctccagataggccgcctttagggattgcagctgagacctgcaggctaagaagcaaggttgagtgcagggatgaggggagaggaggagggtcactgggtacaaggagcagagcagaatctgcactctggcccgaaagcagagtggcaggccagggcaggccaggaagctgggcacgcaagggcactgcatcaccctcctgctgctgaagcacagctgtgtcccagcttcctggaggcagcatctcccatggatgtacaggagagatttcctaggagacctgaccaggtgtttttcctgaggacgagtctgtattcctgtttccctgcatttgtttgctccttggctgctgggcagatgaacccccagagcaagatccaaaggtgctctttgtaccatttggatccccacagttggagcagagccccctgttttgcaaagatgctgaagtgtgttctctttgactgtagaagtttaggagcaagacagaggctgtccctctgggtggacacatgctcctgtaccagaggcttggccaccatatcccctctcggaacacacttggtggccagagacaaagcccctctcagtgacaccctgggaggcccgtgtccccagacatgaccacagatggctgaccacactgatcaattcgagcagttttatcattttgctcactattgaaagctataagagaaaccatgtattttgatgccatttgacaaagctacccattttgatttgtagaagccactctgctcttataatgatgagtgagtcttggtcctgatgcgcgttctatggctgttctcttgtgtcgacattgaatcatatgaaattgccattgatataggtcaaaatggctgaatgtggacggtttcctacaatttaacctcacattctgtttcactttttcacttattgtatttcaacttcacccacttgcaatatatccagaaatcttgcaaaataagaaaaataacttctaagtgaggatcgattatcagggttttagtacttacttccaactgatctgtacaggatgtctgtgtaagacaaaacagaagtgtctgtaagtgtttgtttagagactgcgaactgttaatgcttttgcccatagtttactgacattagtgcctccctggccagcagtggcagtaaggactggctatattaaggtggatcatagacaagccctgggtctttgctcctgccatgacatgttttgagctttcctaagaacccatatcaacagcccattttcagaaaatccagagccatcgattagagcgtggaaagggagaattaaagttatgttcgtatttcttctcttaacaagattatgagtcagatgttgactatatctgcagaacatttgccaagtattttcagacacctgttttgctaaaatcacagagtgacagcctcttcgtgttgcctgtggcacagaagcatattgtgtgccgcatatctgaacctggggctaaaacactcccagttctaatgcaaaaagtctcctactttagggtggacatgaatcaccgggaggtcttgttaaagtgcagatatgggttatttaggtctacagtaggccgacactatttttgacagccttgtggtcaccctggggtggggggcacagggaccacgctgtgagctgcaggccctagagttagccaccagggagcagcaccactggtactcagcctgcagaggccctgcttgtgatcagcaatttttcacaagcacattgacaaacaagaatgcatctcttccattccagtgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcagg

SEQ ID NO: 15607 - DNA, 29558 bp, Human
agtgcaatggtgtgatcttggctcactgcaacctctgtctctggggttcaagtgattctcctgcctcaacctccccagtagctgggattacaggcccatgcaaccactcccggctaatttttgtgtttttagtagagacggggtttcatcatgttggccaggctggtctcgaactcctgacctcaggtgatccacctgcctcggcctcccaaagtgctgggattacaggcataagccaccatgcctggccacagagcaggttttgaactactagcctgaagctattctcccgccttggcctcccaaagtgctgggattacagatatgtgccacggtgcccaggctttaagcaacttttaaaaactatcatttttatttcaaatacttatggagatggtggtatgataatcttttcagtttgtaacgccctctaactgtgtaaagtagatctgaagtgttttcctgaccctcactgggatggttatttcaagtacaaaacgttttcacaccgtgggtgataatcttccataaaaaatttcatatttgaatgaaaacagctcaagaaatacactaatgagcaaaaatatatggggaaagaggaacgtgtagttttgacttaactgaagaaaccaagaggaaactggtctccatatgaaaatgtgatcctggaaagtcaggtgtcaagattttcgagtaggaatctacatgacttgaatctcccttacttcctgaataaaagtgacatctttcagtatttatttaaaaaaatcatatgtcagtggagcttccaggtaaattatctttaaaaaatcatatttgagtggagcttccaggtaaattatcttcctcttttaagggagctccctgtatttctagcggctttaactgatatccctttcagtgagaaatcctcattagctacataagaggggactgggtgtttttttcaaaaagctggtattgggacatctacctctgtgatgtccctggtcagctatattgtctaggagttgaaacattttgtattaattttctatcatttactgggtgcctcttctgtgacagtgccactcaaaggtctattgatatattatcaggtgactgaattctatattctgaagtaggagatactgttattgctgttattacattttacacataagaaagctgaggctctgagaggtcaagatcacgcagctaacaaatgagccaagactcttgctttagagcttgtcctctattcttgcttttctttccaaaaaacactacaatttttgttttgttttgttttgttttgagacagggtctcgatgtgtcacccaggctggagtgcagtggcgcgatttcgactcaccgcaacctccgcctccgcgcttaagcgattctcctgcctcagcctcccaagtagctgggactacaagctcgggacaccacgtaaaaatgatcaagttctaacatgtatgcatacgaattacaatggaaataaaattagcaaagcgcttatgctaatgctcaatacaattgatttcctcacatttaatcctcacaaccactacaaccacctctaactcaagctctgagggactgacgtgcccggaggacacagctcttatctggtgagaacaggagcgttttagcgaaactccaaactcctaggtcccgccttccccaggaaggcttttcctggcactgtgcttccggaagtcccgccccaggagaaaaacagcttccggaaaaaattgcggccggcaaaccggaacagaactaggggcggggccgcttgagacgctctagtattcctctactctatggccactgtcaattgacaagtcccgagcggtaaagctcctttctattggatgagcagcctcgcgtaggcgggaagctcggtgcacggcgcgctgattggctggatccgccatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtcagtcaacgagccacgccccgtcccgctgggccctcagtgcggcgcagcctctgagcatcggggcacctcccagggcttcggcttccctgcttcacacatgtggttcactgttgcgggggttcgtggagttatggtgggtgggaaatccgagattctttgcatccatgtgatttctgcggatctgtgaagaacttcaggcctgggtctgagcgtccttttcccaacccttgggccccggcctggctgtcagcactttcggagctccaccctcttccgtgcaccccaaggccagtgtgtcgttgttagcgtgtggggtggacagatctggtgtgtagccggtggtggagaaaggactcattttgtcctagcacccacacacacaggcccccactcctctccacctctgctaaggagggctcaaaacccaccagcataaatgtggctcggtagtccaacgtggacttttaatttttttttcttttttttttttccagagtctacaataaaacatctaattggtgtcagagagtttacagaataaaaccttctgaatgtcttgtgtaatgtttgtcttgtaggtatctcttcaactgtggagaaggcgttcagagactcatgcaggagcacaagtgagtcagtctcttgctttcggagggggagttgattacggggcttgaaagccgaaatgagaggccagttgttttttatagcaaaagtggtccttgttctgttcatgttatcctgtttaaatgttttttcattcttaggttaaaggttgctcgcctggacaacatattcctgacacgaatgcactggtctaatgttgggggcttaagtggtgagtatattctttgcagtgtcagaggctggtgggaagtctctgggattttaaccggctttaccatttttccaagtctggggtgggcagctacttttttttttttttttttttttgtcagtggcgtgatcttggctcactgcaacctttgccttctgggctcaggtgatcccctcacctcagcctcccaaatagctgggaccacacgtgtgccccatcacacctggctaattttttttgtatgttttgtagcgacggggttttgctatgttgcccaggctggtctcaaacttctgcgatcctcctgtctcggcctcccagagtgctgggattacaggcatgagccaccgcacctggcctggaattctttttataccagcccagtcagcagcagcacagagcattaaaagctgtgactcaggagaacagattttaatatggataccacctcttaagtgttaccatccacttagtttcttgcgttgcggggacagagatttgtggcagtaaactggagagtctagcagtggtgattacagttaatatgtttaccgcagacgccattggcacattggcagccacacacatacccactgtccagattaccctgtcatttatgtctatcaaccggaaggtcaggattgtgttgcagccaaattgtgtgggcttggtggcatggaccggaaggagtgaagtgttagaccagtctcccttctcagggctgagactagggtgaggcacttagggtgccagcccttcacttgcatgattccttacattttgcacactgggtgccttgctgcttcaccctagtgacagctcagcccattctagaggcatttaaagaatatttggtgtctgttacacctctagctggcatcacttctgctctgtacatcttccctggttgtacttccaaagctggaaggtggagatgtagataaatagttggattagtacggggtgctcctcctgttagtgacgacaggtcaaattgatgagagatctgattttatgcatcctttttaggaatgattcttactttaaaggaaaccgggcttccaaagtgtgtactttctggacctccacaactggtgagtctttcctgacacatctttcaaaagcaatctttccttttgtaatatcagtaacaagaattttcctttttgcaaatcagtcttctgccctccagagatacctggtcgttgaaacgcttcccctttcaagttaaaaagacttgagttctgattaactatgtgaccttgatcaagttactttacctttctgagctttagtttattcatctataagatgactatcacgtttcatagagttgttaaagattaaatgacgtagcagcacatataaagcactaaatcactttattagatatatgtttggcaccaagtaggcacacaagaaagggcagcttttgtttttattcaataaatttctgacatcttcttacctttcagtccagcttattacactcttgagaaggcgtgtgtgtgttgttgaatataacagttcattttccagtccttaagaagaaagtcaccaagacctgttaagtctttccccaaaataacgtttgaaatccatccatttgtctcttattgaggccttccttatttctgttttctatgcctgtaaactacaatagcctcccatattcattctcgccttcctgtaatccatctgccacacagcagccagagaggtcacttcaagacagaaaagtagtgtgtcacttgccaccctaaagcccttcatgggctccccattgcaatacaatcaaaacaccttgatatggcctacaagtcctgtaggccccggccgctacccacacttccatctgtacccatcgctgaactgcagctgcatgggctgactcttatgtccctctaactccctggccacttcaggactttcgcccttccgcgggttccctctgcctcttctaattgctgcctatattgttactgaaccttcagggctcagctagagggtcatttactccagaactgcctcttcttctctagacaagttggatcccagccttctgtatttttcattttccttgcagagcacttagcataatgccactaagctgtttctgttatcgtgtttccttttgtctcctccactggcctgattagagcaaggcctccatctctttttcctgctatatccttggcatctgatataatggatactcagtaaatatttgtaataaatgatgttcaaaatatttactaagctttgttttatgttgatacctattggtaaccttttaaatacttgaatagttgctgtgttctacatttgttcaaccataactgctcatttctttgtttttcattaggaaaaatacctcgaagcaatcaaaatattttctggtccattgaaaggaatagaactgggtacgtctttgtctgtgactcatcctctgctatttctaacttatatatgccctgacctctcaaattagaatccattaaaaacatcaacatcaaacctcaaaatcaaatgcttcatcaccacgagatttttttttttttttttttttttggatagagtcttgctttcttaccaggctggagtgcagtggcatgatctcggctcactgcaacctccacctcctgggttcaagccattctcccacctcagcctcctgagtagctaggactacaggcgcatgccatcacgctcagctaattttttgtatttttagtagagacggggtttcaccatgttggccaggatagtctcgatctcttgaccttgtgatctgcccgcctcagcctcccaaaatgagctaccatgtggctggagatgggatttctaaatagtgacattttctgtgttcccacctcatgctgtaaaaataggggccaggtcggcaggagtgattgaacagctgatgcctgcctgtgtacatgctgtgtggcattctccatccagacggcagggctcctgcctcagttccagaggtgcttctcgtcgttgagttgctttgagttgggggcgggggtgacaagggttccctagaggttttgtggccaactttgtacattgaaacgcagctccagctgcgcaggggggcttacagcctcttgatgggaagaggcctcactgaggatgctagtagggctcttgtcctggcactggtgtgtatctgtggcttgttaatactcctcttttatagaaacactaatactttgtttcaaaatatacatcagctcttctggtttgcgatgataggttccctggcttcactattctgtttgttaacttgggtctctgaaagttgagtactagtttcttgtttttcaatttttaacggatagtcaccaaagattataatgtcttttcatctggctgtagtaaatataaatggctgaccaaaatacacttttatttatttcctaaaaatggtaatctccttagaaagtctggttttcgtgtcagattcccaccataattctgaggcaattcagttgctcgtggttggtgatcctgaagttactcttcccacacatcttcactaatgcaatcactttgctgttgtgtggttttcttgtagctgtgcggccccactctgccccagaatacgaggatgaaaccatgacagtttaccagatccccatacacagtgagtatgaaagccaggtttcccaggaggagggtgtacgtcctgagtaaagaaaacatggatgaaaatagaaactgaacacttgctgtgggcaccctgttttgtgttctgagcatgattagaaaatttagttgaggaatgaagatatggctcctgccctggcttataaacttacggatgtctgacttatgcctaatgatagtgattatgctttggaatattagataatcaagcactgttggtaaatagattgcattcaagtttgcacattcattgcttggaggttttttcccacaggcgtaataccctcttttgatcagacgatcatgaagaggtttgcacagatagatttttttaaataaataatgattacagcaacctaaaagaagtgttgttgggggttagaagctcctgcaaattccgaagtatcagggccagatgatgtggtcttagcttaggaaaagagttagtcttgtccttgaacttggctaaagacattcatgtctggttttacttacatgtgaagagagtaccaagcagtaggggtatttccttgttagtactaactaatgtgatgcttactaagtagtgctgatgggtgacagaccagagcacccagcaaaggccagagaagtccagaacctggcgaggagatgaggcttacactgactgaaggcagaaggcagcagggaggagaggaatgtgccggagcaatggcacaagtgctcctaggccagtgctgtgatgagctgatcagcactcccattgcctggcttgctcctcctgctcagatgccttctctcacctgacccctgctgtagccacccccagcctgagttgcatccacctgtttgttgtccatttccagcaccctgttcttcgctccatggcatgtgacagttaactttcatatgtgatttgcgtgatcgatgttaacatgctcagttttgccgatcactgttttttcagtgtccagcggccctcagtgagtgaacttacgttcattctcgttgcagctgtgctttagcttcttagagcagcgaatttttttcccttgatcttgagccttaactaaatgtaaaatgaggctccttcttgagataggtaccctttgggtctatgtgttttagcgggagtgatgataataaataagcatgtctacaacccacatgctgtttagataacacgttgttgagttggtactgtggccgaggctgtgagctaagcagaaacataaacattaataggacataggtgcagcccagaaaccaggtaggaagttaactaactagttatttcctactgtatagtaaaaggtgtgctgatttaattggcgttctggcattcccatgtatgaacgtctgggccttggctgtcagctcaccttgtgcagtgtgtaatttggtggtatctgtactgaccaggtgaacagaggaggggaaagcaccaaccatggcagagtccagaaaggcctctcagcaggctcagtccagagcgatcttcagactccgagtcgaatgaaaatgagccacaccttccacatggtaatagtataaacaaaacagagcagcagaaaggcttgcgttttcttaattctctgccttgtaatgcttgtagagagtcattattgtaagaaagccaggtgtgtaaacagatccttcttcctgggcttactataacttggcccgttgggggaatgagaagggttgttgtaaaggtggcagcctgcaactttaataatgaccagtccacagttttggccacccagggtctgggtaggcccaaaactgtgttctgttttcccagaggagaacagggcctgacaaacggattcattttgtatttttcattaatgtaacatttatgcaaattttccattaatgtggaaactataactgctaagccaatgagacagtcaaatcagtgagaggctctgcacgtcttccagaatgacagcccactgggaaacggagttaaaagtccaagatgagatgtagctcaggagtcaggccgcttcgggagtttgttgtccttaacagaaggtcagcgttggcaaagctcggcagctcctctttctgtcctgaggtcttgtctagtgactgagaacaggctgacccctatgtgctgtccttgtttggatggcaccgggtaaagactgacaccagcattttctctgcaggcctttgaacttttgtgttatttcatatattatatgtgttataaagcacattacaatatatttttctctgtcttctccagtcctaggtgaaatgtgtcatttaaaaaaaatttcacttgccattctaaagtttttctggtgagagttttgtgtttttcatttacgcaaacacatctccacataagtagggaaaaaaagtcttcttgagtatattagtgtcttcagcctttgtattgggacagtagcgtccattaatttttatgtgaagtgaaattaggtatcgggtcataatcagtctgtgatgtcttcacagctttcacatttaccttgtgataatcaagtgtgtttttcctcaggtgttagccagagaagaggggtcagggactcttccctggtcgtagctttcatctgtaaggtaaggaagactttccggagggctgtacatgactggggtcttggtcagcgacctctggtttgcactttttcattaatttgagggtaggcactcctgttacctgagacaagaagagatagcagatcttcagaaaagctgatggaaggccgggtgcagtggctcacgcctgtaatcccagcactttgggagtccaaggcaggtggatcacgaggtcaggagtttgagaacagcctgaccaacgtggtgaaaccctgtctgtactaaaaatacaaaaattagctgggtgtggtggcgcatgcctgtaatcccagctacttgagaggccaaggcaagagaatcgcttgaacacaggaggcggaggttgcagtgagttgagattgcaccattgcactccagcctgggtgacagagcaagactctctcaaagaaaaaaaaaattcgatagaaatgacactggcaatgagcctgcaacaagtattactactgacctttcataattgtcatcacttgtaggtttcagagtttagatgctctgtttctcaaaataaccccatacttttatttccttttaaatttttttccagtgccctgtcagcctccgtacattttttttttttttttttgagaccatgtctgtctccatcgcctaggctggagtgtgcagtggcacaatctcggctcactgcagcctccacctcccaggttcaagtgattctcctgcctcagcctcccagtagctaggattataggtgcgcgccaccacacccagttaatttttgtatttttagtagagatggggtttcaccatgttggccaggctggtttcactcctgacctcaggtgatccacccaccttggcctcccaaaatgctgggattacaggcgtgaagcactgtgcctggtccatattcttttatatttgccaatgattggtccttttagaattcagaaattattgaaggcagctgtgtttgttttccttcaactccatcaggcctttattcaaagtcttttaactctgttttactttatttcattcccctgcaatagctaaggtctaacaccagattaattggaatattagctagcattcacaaaggcctagatctgtaactctgaaattggtcaaattccattaaaaatttttgttacaataagctgtttgtaagatctgactagtggcttatttttaatagaattttgcattaaaattttatcaatacaatttgcaacaaatttgtctaaatatgtgaaaagatttcattgcctttttgtgggcttagattattttttaatgttgattttgaaatatatttggaattgttatctaaattctaaaagctacaagtgaaaataataatgaaagtaagtagttaatattagtggcaagatcattgccagtatcatttctatcgatttatttgaataatgtgattttcataaaagttaagtactactgttaacaggcttattacttgtatgtttctgagttttagatagcaaaatcattttttaaagttttaaaaatattttatttttgataatctatatttatattgtctgatttttaaactgttttctatggtaatctttaaatcgtattcctgctttccggaataggtaacagtgagcatgatgaaaagtgacaagctcacttttacacactcgggcagttgccctattatcaggcagccgttcctgggggctgccagctgcctgccctggcttttccatctccttccttgctgtcttctgcggctccttctgagggctgctgtcactggattagcctataacgcctttcccctcttctaattaatttgctgctctcaggtgaggttttggaaagcaataaagctgagctaggtcaagttccaggagtctcttggcatgaggacctgaaaaactcatctgttggaagacctcggctttgggcagctggtgcactgttggggcgttattggctgcgttctggctctcatcagtcttccagatactctgcattcctcagagaggaacatatctccatgggttgagttcagctcccagggagatgggtttccctgccttaagtcggcaagtacctttttttttctttttttgagacagagtctcgctctgtcaccaggctggagtgcagtggtgcgatcttggctcactgcaacctctgcctcccagggtcaagcagttctcctgcctcagcctcccgagtagctgggactacaggagcgcaccaccatgcccagctaatttttgtatttttttagtagagacggggtttcaccatgttggccaggatggtctggatctcttgatttcctgatccgcctgccttggcctcccaaagtgctgggattacaggcgtgagccatcatgaccagcctttatgtttctttgtttgttttgtttttctgagatggagtctcgctctgttgcccaggctggagtgcagtgttgccatctcgacttactgcaacctctgccttccaggttcaagtgattccttgcctcagcctcccgtgtagctgggatcacaggtgcctgccaccatgcccggctaatttttgtattgttagtagacacagggtttcgccatgttggccaggctagtctcgaactcctgacctcaagtgatctgccttcctcagcctcctaaagtgctggggttacaggagtgaaccaccatgcccagccttcaattaccttttatttattttatttatttatttatttttgagacggagtctttctgtgttgcccaggctggagtgcggtggcgcaatcttagctcactgcaacctcctcctcccaggctcaagtgattctcatgcatcagcttcccgagtagctgggacttcaggtgcccgccaccacacttggctaatttttgtgtttttagtagagacggggtttcaccatgttggccaggctggtcttgaatttctgacctcaaatgatcctcctgcttcagcctcccaaagtgctgggattacaggcgtgagccactgcccccaacagcaagtaccttttaaacattagagacatttagttgccatcctcaaacccgtttgggtgtgtggagagaatgttgggtcgtgacatggttgttagttatctaaagatgtcagccatcaatcatcactgtgtgatgtgcacactgaagctgtaatccttcatctaggatgatattttttaagatggaaaattctacaaccctgagaataaggatttcagatccaaatttgagactcagccctacgagtaactctttaacttcagagagttaaaagaagatgcacagttgatgaagatttaaaggagaaaatggaaatcaaatgtcatttagcactcaaaggcctacatgtcatttctgacatttttctgtttgtgtgaaattttttttttcctataaaatgattgtgaagttttctggtagaattattgtttgcctttctaatgtaatagcatattagggtttttttttttttctttttctttttttgagacagagtctcactctgtcgcccaggctggagtgcagtggcacgatctcgggtcactgcaatcttccgcctcctgggttcctgcctcagcctcccgagtagctgggactacaggcgcacgtcaccacacccggctaattttttgtatttttagtagtgacagggattcaccgtcttagccagggtggtcttgatctcctgacctcatgatctacccgcctcggcttcccaaagtgctgggattacaggcatgagccgctgtgcctggctattagagattttttattataatttatctccaagataaaagcagtgacattatattgccacataattgaaaaatacaagagaaataaaaatcatccatgcttttgttagcctatcactgtcattgaaatattatgttacatggcagtttgcttgctggttgctctgttaggcaacgctctggtgacattcctttagctattaattgaggaatgtagaatgacagaacagtgtttctcctcaatgatacttgaaggatatttattaactttcatattgaattacattttattaaatttataatgagttaatgctgggaaataaaacactgatttaagtcattttggcttttagtactaaagcatttgacaataaatgacttcttcagaatatggtataccttctgaaagcaataaacgcattttaatgaattgtaaggaaacaacatcattttattttttatttttttttttgagacagactttcgcttttgttgcctaggctggagtgcaatggcgcgatctcggctcactgcaacatccgcctctgggttcaagcgattctcctgcctcagcttcctgagttgctgggattacaggcacgtgccaccacgcctggccaattttgtatttttagtagagacggggtttctccacgttggtcaggctggtctcaaactcctgacctcaggtgatctgcccgcctcagcctccgaaagtactggaattacaggcgtgagccaccgtgcctggccaacattattatttttttttaatctagaaaaatacacttctaagaaaattgattaaaaccaaccttcttcattagcccctaagatcacatctatgttctctttgttgcagcttcacttaaagagaggaaacttcttggtgctcaaagcaaaggagatgggcctcccagtgtgagtgtggggggtaaggcttctggggactcactgggtacacctgtccacttaaggaaatcacatttcacagaggccttgcctcttcatttcagtgggacagctgccatcgctcccatcattgctgctgtcaaggacgggaaaagcatcactcatgaaggaagagaggtgagatgcctggttttcttgattcagcagttacaggtagggtctgaaatgctgggcagagtctgtcttcttcaggccctacagacaccacttttgaaggacgtggaacagtttggacatcactcagctaagtgataaaatggcctcttttatctgtgtttgtcccgcatgtcaacacggctgcattcgagcatttttgtagattgtccatttaggatctagtcaccgtcctccttaaagggtgcatgctttccttggtacttgagctcaggacagtgtctaacaacagaccccatatggatgggcctggggtttatggtccagaggaatgccacagtattctatgtcaagatatttcctctgacttctgaggacattaggaccagtggccacagactgaagaaaaccttaatgccaagcctcctttcctggccagtgtaggcctgaagtgcctcaacctgacagttacctgtttaggtatccacaaagagaccagaagggtgttgatggtgatgtgtaaagttggttttgtgctttgtttacctctcagctcactggataggatatgtcatgttagcagttgccttgaaggcagttcagtttggtggctgagctgtgacccccagtgggcgggcttatttggttttgcagattttggctgaagagctgtgtactcctccagatcctggtgctgcttttgtggtggtagaatgtccagatgaaagcttcattcaacccatctgtgagaatgccacctttcagaggtaatgaggggtctctagggtgggagaagtgagagctgaaacccagcccagcatcgacatgggcatcttgtggcaagagctgtgtttctgggaagaccactatctgggtttacagttcagaggccggcactcctgccttaagtcactgttggtagttggtgggctccggtgtacacagcctcaaagtgaaattagaaaagattgaaaactagaaacaactgaggactagaaattcaactagaactcttacagctcttataccagaagaaattctagaacttttttgaattctaactaatgccccagattatcatttggattattttgaactgaattaattttcttccattacctgcattgaaacaaatgaggtgggtcagagtgtgtgagactgtcgtggtcaagagtccgtgttatgggatggactcacagctggggaatgtcttttgggctaactgccactctgttgttgtcctctatcgaagttaaccagttttgcggttcagctttcattccagatggaatcatctttgacccacctatctgagtttgaatcttttcccccactcttaatggtttacctgtatttttcctgttcctagtttgtatctatctgtattttttcacttgtttttttctacttaccacaacaaatccttttgggctgctgtaccccttccgagtcagagcgttaggagttgtttcatggtctgctttattctctgtgggtgaatttggatgcgctggtagccccggctttgtattttaatccagttttgggcagcaaaacctcttcaatgaatcaggtgtcatttgagagccatgtgtggatgtgtgatgatgctgggatagataaaaatagctactgtgtatatttctttttaaagggaactggagggaaacacatcagcatgttagtaagtggtctgttgtccaggtggtgaaatttcagatgattttcatttctcgtgcctgtgtctcaggtcctctggaaggcagacaccagggtggcattggaggtgcaggaggtttattcgaggaaatttgactgtgagagaggaaggagagagggagcaggaggaggcagggagagcctgggtctggctttgcaggttggacccgtatgagtggagagggtaggaaggaagtgcagtgctgagaaaggatcagccaggcctactggaaagcccagagcagagcttgccagatacaggaatcccacgtccattggaaatggcccagcaccggggtctgccgtgagcagcctgctgtgagagcatggcctgggcgtggaggctgtcagctcactgcagtgctgcagagggccgcacgatacccctccctggctgcgtggtccctgtcttggtgtgtcctgagtctgcatcactttgtaaagccccactcttctgcccaggtaccaaggaaaggcagatgcccccgtggccttggtggttcacatggccccagcatctgtgcttgtggacagcaggtaccagcagtggatggagaggtatggagcccagcccagcggcacttggggtaactcttctgggcagtggtggattcccctttcctcccctcgtgctctttccagcgctacctacccttctgcacctgcctaaactttctgtgggattcctgccttcccagaattctaggcttcccagatctgtgctacactcgtgaagaaaatgcaccgctaggtggcgcagtgtccacacgattccatttattttacaccctccacactcttcagggtgtctgaacaaatactgccgtttggttgaggattccataagtgaattccaaagaagagattgcagctataaaatgatagcttccatttactgaatgcccactttgtgggaggcagtgtgtgaaatacccttcatttcacttcatttcctctagggtcgtcgccagcagccctgggaggtagatgtttagtcactggaaggcatctttttcctcggggcatcgctggccagggccaggtggaggagtatgagttgagctcgggtgcggggtgaccttgggctgctttttggcccctgcccgtatctccccacatggcccgtttacctgcccctcactccatggcctgctctcctgctgtctctttcattcctcagggtttgggtcccctatttgtatgccctggacatcttctttttcttgtttttcctctcactcttcccagcacacctgaaaggcagctgagctagggaacaccgggctttgagacagcaggagtgggaccatgtttggccatgtagtaacactgcttggggcaagtcactgaactgtttgaacacctcatcctcattaccactcctgagctcagcaccactcctcagggggagctgcctcctaacagacgctgcaaatgccgggtctgtttcttcacaggtttgggcctgacacccagcacttggtcctgaatgagaactgtgcctcagttcacaaccttcgcagccacaagattcaaacccagctcaacctcatccacccggacatcttccccctgctcaccagtttccgctgtaaggtagtgtctcagaccggccccttgtcggcccagctctcgtcccctctctttctctccatgaatgtgttttgtctctttcagaaggagggccccaccctcagtgtgcccatggttcagggtgaatgcctcctcaagtaccagctccgtcccaggagggagtggcagaggtctgtgccatcttgaactaatggaatcgtctcagtcgagttgggaaacatttctgtaaatagccacatagtaaatgttccaggaggctctccagaccatatggtctctgttgtaactattcaactccgctttgagcacaaaagaaacacggacaataagctaatgaatgggcttggctgtgtgccagcgtgaatttatttagaaaagcagcctactccaggctgggttgaggtgggcggattggggccagtagttctccttttccaaaattgccttgcatgggaatagcagtgatagagctcgtgtgtttcacagtatagaaaataggaaatgtgtgatgaacaaagtcacccataatcctgttgcccagagataatgattgataacattttgtgtttcttgatttgtgtatgtgggtttatattgtcagtcttttcctgtatcactaaacagtcttaagtaacaagatttttattggtattccaaatagggatgtttactcatttgggatgtttccaattttttgttgtttttaatgaatgaaacaataaatgtcttatatataaatctttgatgggaactctgttcccttcaagtcattcctaaatgtgggattactggcccagagtgtgagacttgttaaggtacttgataaatgtaagatgccatcttgaaagcctcttccagtacaatccaaccaggaaagtgaacagccttactgccccacatctttattttaattaattaatttatttattttatttatttatttatttttttgagacggagtttcactcttgttgcccaggctggagtgcaatggcgtgatctcagctcactgcaacctccgcctcccgggttcaagcatttctcctgccccagcctcccgaatagctggaattacaggcgcctgctaccacgcccggctaattttttgtaattttagcagagacgggtttcaccatgttggcaggctggtctcgaactcctgacctcaggtgatccacccacctcagcctcccaaagtgttgggattacaggcgtgagccgtgcccggcctgttttaatttttaaggatctgaaccttgattttaagtttcctgcccactccacagtatttgtattagaatagagcatgtgctggattatgactggatgctgtgtgctgttgaggttgggtagttggggccctttaagagactatactagcaagactcgggcccacaggcaacatcacggggttgaagaacctggtgtccctttgttggcatctgcgcaggctcttaacacacagcagcgatacacagccctagccgacattcagatttaccttgtgcttgtgaaaaatattgcacagggcctgccctagacctagtgaattagaatcttgagagttaggcttgggactcacaagctcccagatgattttaatgctcagcgaggttgaagagccgcctgtccaaggagttgccactccgtgtgatctggggcttgctaggaaagtgggatctcaggcctcactgcagagctgccgaactggcttctgcgttttgccaaggttcctgggtgtgaacatgagtttcagagtcactcctctagggcccctgcttctcagctcggaccattgacccctcagaggacatttggcaacatctggaaacgttcttggttgtcacagcctaggaggtgggtagtggtgctgctagtgggtagaggtcaggggtactgcaccaggacagcagcactggccacagaaaaaaactgtcttgccctgagcatcagtagttccccgttgactggccctgaggcagagcgatgcagcatccaaaaggcggtggagcagacctgccccagatcctagtcacttaaccttcagtgttgatctgaaggaacttcctgcagattgtccccctgaatttattctggacatccccaatggggtctgctgaggccatataccctgtccgtcacctgagatgcttctctctcttcctgcagggatgccattattacttgcaatcctgaggaattcatagttgaggcgctgcagcttcccaacttccagcagagcgtgcaggagtacaggaggagtgcgcaggacggcccagccccagcaggtgagtgggagcccacagagcagcctttctttcctgggctctgcccctgctgctgttttcctagcattaagtggagtgctggtggggcgcattctaacctggcttttcagtctaatccagggcttctctactcagctctacattagaattatagtcattggaggagggggctttggggagtttaagaatcccaattcctggctgggcgcggtggctcacacctgtaatcccagcacttcgggaggccgaggcaggtggatcgcgaggtcgggagatcgagaccatcctggctaacatgatgaaaccccgtctctactaaaaatacaaaaattagctgggcgtggcggcgggcgcctgtagtcccagctactcgggagactgaggcaggagaatggcgagaacccgggaggcggagcttgcagtgagccaaggtcgtgccactgcgctccagcctggacgacagagtgagactccgtctcaaaaaaaaaaaatcccaattcctgtgccccatcccacccaatcagagcatttggcgatggcacccaggcattcttggcaaggcacgcactgagtgaaacgttttagtgaacacctgtggaaagagctctgagcagggacttggctggcagagatctagtcctggctttgcggatgcaaatccatggaggatcttggccacgtcactcaactgaggctgagggccgggcacaggctttggaaccatcgggtctccctggatttgaatcctgaccctgcctcttaccatcttcactggagacctgggcgtctgagcctgtttcccccttgggaagcagagcatttcctacctggtagggctgggaggatgcgaccgaagtgcatggtcttgcagtgagagctggatgcaaggcacacactgttctcttgaaataaatgacagttcccagcataaagaaatgtcattttttaaatgtaaaagaattacagcaattcttttgaagaaaggactggagaatttatttgttcttcttagccttttggtgacagatagcctgtgggtcccacactggtgcgaagtcctttgtttcagagcggttgccaggggcctgccagtccccctcctgggaagctggatagaactatgttgcttacccatctgtcttagtctgtgttttgttattataaaagaatatgtgagactgggtaatttatcaagaaaagaggtgtatttagttcacggttctgcgggctgagaattgaaggtcacggccctagcttccagtgaaggcttccatgctgcatcataacgtggcagaggagcgcaagtaggaagtggacgcttgtgaagacgggataacctgagctgcactctggctttataacaacccccctctcctgggaacaaatccattcccttgagaagtaatgcagtctcctgagagccagtacttactactgcagctccaagccactcaggagggtccgtccctgtagcccaaacgccttccactaggccccgcctcccaaaaccgccatactagggagcacgtttccacatgaggtctggggacaaaccaatgacactcaaaccattgcaccttctcatggctgcatgctggctcacttttgacccaaaggaatggattgtttcacatggattttttcacagagaaaagaagtcagtacccagaaatcatcttccttggaacagggtctgccatcccgatgaagattcgaaatgtcagtgccacacttgtcaacataaggtatgctgctttcccaggaagcatccttccatcaagggcacgtttactttttaaacaaaagtcctgctgtactcaccagtcgatttgaaatgcggtatcaagccctgtcacttgtcatgtcgactggagtgtccaggagaggagcgtggccttactgcattttatagcctcagtagcaaactttaccctgggaatcaccaaaattcatcccatgatgtcttttaataaacagctgattttactgtgggcagtacacctagctaagaaattagctcctttaatttttacattaatcctatgaagtggtgaataactacccattttgttgatgagtgacctgatattcagagaggtgacttgctatggttcctacagctggtaagtggggcatctgaagtttgagcggggacttggggtcttgattgctacatggtattgtcccccagccatttgttggtagtatgttaaaaagctttagggttttgcacatttgtgttcagaacctttattggattccccttgacatgttttttagttgattctcttgggtttgcctggggtcatcagcagagagattagtcaaatgcgttgtgacatgtacacgttatctctacagatagtatgtgaagaaaataagattgtgaattaccaggtttgttttaaattttgctctgccatcttacatgctagtggtggatgataaacaaccaaatagtgcattaaatatatacagcagtgacgagatgtgccctgacatcagaaatatacaatctggggtgtgtttctctgtggatgaggacatgcaataaagcagcttggagtgagccggcctctcccgggggctgagatcctgggggaagaagggctttttgagtttgacctgacaccctgcgagcagcttttgaaccagctgaagctaatgggaaggtgctattgccaccttgcctccgcctcccgactcctttttcccccagaaggtaatgtcttagcaccggggcttctctctgcaaaatgggtgcagccctctcagtgttcgtggctcctcccagagaatgaaggaggccagagcgggtcagcactctctctgccttggagcagagcttctgaaatggactgcacagcagaatagcccaagaagtttgtcagaatccagacttccagagccctgcctaaaaccaagtcagaaaccccgagtgacacctgggagtctgcgttaactggctccctgaatgaagcacctgcagcccgccctgcaccaggtgtctttgaggacatgagctgaggaaaccccgaccacttgcaaagggggaaaagtccgatggcagctggacctagaaagagtctcatatggcccagtgcctgtcctggtattttcaacagaggctgtggccacagtcaatctgcatggtcagattcattgttaggactaaatgctttaagcctcctataaactttttttttttttttttgatgcccagcctttgtgtaagtctacttgaaagggtttcagggttccatggatacttctttgctataaagaggatgacacatgtaaaatcacctttatggttaaattaattggcttttatattagctcctcaaagcaaagcaggagagacagaaatttctgcagttgcttcttggtcctgtccaaagcagacatcagcctctgaaccatcagcagtcttcctagtggcagtgactctcttcctcttctcttctgcagccccgacacgtctctgctactggactgtggtgagggcacatttgggcagctgtgccgtcattacggagaccaggtggacagggtcctgggcaccctggctgctgtgtttgtgtcccacctgcacgcagatcaccacacggtgagtgttgggctggaccacaaagctggagcctggaggaggcactgccacgttgagttggccctttggctgcgtcttttcctccgcttccaaacttgcccagagcttttgttactcatctctggctaggaaatggttttttgcaaaactcaacatagtccttctgcgccacaagaatgtcttctcttcctgttcagttcctttcctgcagcaggacaggtttgagtttacccagccttccttgagtcttgaatctcacacggcctgctcagcggaagctttgaccggatgcaggaggtgtggctatgagaccctcaccttggtctcctggggtgccgggccctgggccgttgccctcttcccagcacgggtcgtgtcgctttctgcctgtgacatttcagggccatggcgcagggggctcggcctgtgccacccccactgcggctgtgttagaggctggtgggtgacgtcgggctggcaactcctgcaagagagagggctgcagaccctaacccggaggggatggccctggggcctggctgacgcatgtctcctgtttccttgccagggcttgccaagtatcttgctgcagagagaacgcgccttggtaagtgtggcacttgatgggcgttctgagtttcagcggtttacacatcatccgccatgcctcttggcactccagtttttattgagatgttctgtcgtcgagtcggcacttgcattttttgttccaggcatctttgggaaagccgcttcaccctttgctggtggttgcccccaaccagctcaaagcctggctccagcagtaccacaaccagtgccaggaggtcctgcaccacatcaggtgagcatccagggcagcctggccccctgggctgttgcttgctgccgtctccttcagaagctcaaggtggacactggggtagttaccaatatcccccagcagccttgcccttgacatggtcccagatggcagaagcaggggagaagtgcattggctgaaggacagaaaccattagatagttcccatgtaatgcttattttcttagaagcatttcttcccagtcctcatttgagttctgagctgctttctaaacttcgagcagcttttcttgatgagacagttccagagccaagcacccaaatagtggctagcacagagaatgtccatagcaggtgtgtggctagctggcaggtggcaccatcctcaccccaaggggaaggagtcccctctgctggagccatccgtggcccgtgctgcctgagccggaggcagcattcacctgctgggtttctcccagtggcctagaggctttggtttggctctttatatttgactgctgtttcctcatcatagtgactatgatttaactcatgttttctcctaagaatgattttggggttctccagccaaagacttaaactttggttccagatgtccaagaaacgtttattatcattttaaatgttttgtctttttacagtatgattcctgccaaatgccttcaggaaggggctgagatctccagtcctgcagtggaaagattgatcagttcgctgttgcgaacatgtgatttggaagaggtaaggggcacagccgcaggcatcatgggggcgaggtggggagcagagctgcagagccctccagccccaccctttcagtttcagacctgtctggtgcggcactgcaagcatgcgtttggctgtgcgctggtgcacacctctggctggaaagtggtctattccggggacaccatgccctgcgaggctctggtccggatgggtgagtagaggaagaagcaagccaccctgaggttgctctggggtttgtgtagctggaggtgaatgcaggtgggcttgcagggaaacgtcagcagaggcaggagactcaggtccccaccctcagagtctctggttgtcatcctagtaggcagacccagggccaggggagctgagtgttgagaccaggaaacagcacgtgactgaggcctgtgtgccgctctcgcagagaactctgccctgatccttgtgctgcttctccagggaaagatgccaccctcctgatacatgaagccaccctggaagatggtttggaagaggaagcagtggaaaagacacacaggtagcaaaggccggtcagtccttgtcgcccacatcctctccctcccccactacgtgacactgagcagccgtcgtttgtctccactgatgtggggctgccctgcttcctatcaagggctatgggggcttccttgacctgtggcagtgctcacaggctcttggcctttatttttgcagaattttctaagcaagattctagagtgaggcacagttttttgaaagcatctagaaatcggctgaataaactataagccatgtcagggaattgccaggggaaggcgggggctgggggactgaatttttggctgctaatttcaacgaaagagtgcattaccccaggtgggccctgtggtttctcttgggtgccctcatggacagatttggcagccagcacagagggtgggcttcatccaggggtgtgtgcgaaggctctggccctcaggggagatggtgctggctacggaggtgcccgttaagaaaacccaccagcttccccgggtgccctggcagttgatggccagggtctgtgccactgtctgctttgcagtcttgcagttgagttcagcttcagtctgctctgtccttcacctgcagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgtatgtcacacggacagcacagggcggggacggggcagggagacaggactctacacactgagtaggacggtcagctggagtttgctttcttatttggggccaccgtgggaaaaggttatctacccatcactaaccaggtcgaaccaccctgggtttgctggtgagacccacctcctgcaggggccaactagtcttcagtctcagttcactggaaatttctgagaatccttttaggcctggactgctcacacagtcatggcatttgagcctcagcacagacctgtgagacaggtggttgcctcttgtgagtgggaaagccaggcctgacccttggccttccggaatgaaggggcagagccggagccaggcctcgtttttcaggagcttgattttgagagcatctggactgctctcccttccctctccggaggcccttagccaggcctagggagcctctgcccctttagagggttccctccatgccattcttttttccatttcagctgtggcctgttggcttgtgccaaggaaggggcgttggcgctgctgtgtgagcacatgactgcatcccttccagctcctgtcccccacccctgcccctctgagacatgtccttgtcttctattgtgtcttctaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtttgcaattgtgagttcttttgcttcctcctgcacagatcagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaactcgagctgtgccagctcacagcagggcgtgctttctctatcaatcaatcaatcaatcaatcaaatcaatcagtgagagcctggctgggctggtgtcattggtcagggaaatgcaagtcttctggtggttctgggtaaaagtggagacaatagatttgctgtgttgttgcttccatactgagaggagtgaggatcactttgccctcgaaggttttgagaaatggcacacggggctggtttccattgtcctccttgcgggatttacagacgtggattagtgctcgacaaatggagagcattttccaaggaagtaagtaagtaaagtaagtaagtaagtaagtaagttgaatctagtatttattgtgtatattccctacccaggagaatgtaaaaagaagagctttaaaaactcaaaagacaagcaagcgagagatcagccagggacctggctttacacaggtggtgaccttcaggctccatcccggtgtgcatttgagattgacggccatgtccccgcaggtttattaaagcaagaacagatgccaagctcagggataataaatctattttaataacgttacttttgacaacgatttgtacatgtatttaaagataacaactttcaacccccacccttaccccagactcccattacaaattgaggcatgacctgcccttgccaggaagtgagcaaagctgcaacatcaaaactctgcacatcccactctcagaggagggtgactttacactgtgttgggaaaaataactaagcatttaaatttttcattgtacacctgtacattggtttagattgaatggctcaaattaaacaaatatagagagatttcatatatacaaatattatatcatgtataggtatattatatcatctatttgaaaaggataaaattttaaactttgactttgcatgcatggcccaaatcttttctcactcccctaatccccaagtgtgaaaaggctacccggtgccctcccggccctcgtccccatgaccagatgggacttcatgagaaggaaatgagcggctgacgctggtgagcaaagcaggccacaccgcaggccgagcccgtgggccagcgtctccgtggctggtttcacttttcctccacatgctttgggtaacgtaattattgctattcagtttgaacctccagaaagaagagacaggctccaggaccccacagactagtgaactgggtgcctttaggtacgtagaggggtaaaattactctcatatagccaatatatttggggacagggaggccacctttggctcctccagacactgtcaggcttgtttgttttgttttatagattcagaaatataaaatgatataggagctttcagtcacacagtggaaaaaggaaaactgttaggaagtgaaacatttttgttttcagccatttactttggagcccactgatgggggcggcctgaaaggttttccagtggcaagccctcccccaggtagctggcaaaggtcagtgccccaggactgctagaatcctggacctggtccagttgtgggtgagaggggccctgctgtcctgcttcctttctgtggccattaaactgatcctgcaagacctgacatgagccgtccaaggaaaaggtagcagcccttgggtctaaccaggcaaagtgagcctctcccgcaccaccccgaccctgcaaaggacgttcctgaccagccttggatggagaggtgggtgttttctggcatggaggctgaaagtggatcaaaagaggcacaaagtcaaaaggcaaaggtcaaacaaaaggccgaa

SEQ ID NO: 15608 - DNA, 86128 bp, Human
cggcagtctaataaaaagtctgccacctaggtttcataataaactgttcattccccatttattcattgggtgatactctggcaaagtcatgcacatggtgtggtagaacatactggggagagattgtgagaagacaaatcccgtgttttcatcaacctgttttgtaatccatgacagtcagttaactttgtttcttcatctataaaatgaagtgattggactatggttcacttgaaactgggagccattctgttctatcactataagctctatactgaatgtcttctgcgagtttgttattctgttttcgtctgtgttaatttgaaattcttttctagaggtaatgtaaacagttgggaataagaagaaaaacattcaacttttctttttcctctgcactaaagagaacatgcttgtgtaagacttatggactgaataaatgatcaaggaatcagctgaaaccattgcacagccataagaataatttttgagacttaatggaggatctctgaaattctgtgggttggaaaccgcatgcataaggctttcctttataccaggtattcttaacttggtgtccatagacagaatccaaggggttcaaaaacttccgtagaaaaaagatacaaacctcttaatttttttcacatcaagtatgaatgtaggcaaaaaccagggtagttatgctgttatgtcaccaataaaaatcagttcatcgtagtgcagttttcaccgctatctccaaataattatattcttcactattttgaagttatggtagtttattagccttggccctagctcctgttatttaatgcaaaagaagtacacctgtaactatacacacacacgtaaagctcctgctatataacaaaattgcctttagtatttttgataactgcatttaaacataatttatttcctgggtaatcctatctatttcattgtatgcattttaaaacactgcttgagaaataggcctcaccagattgccaaaggggtcttcggcacaataaaaggctaagattaccctggcatgagcatagacataaagatcattagaggaccactatgcagcttgcagcaactgacggcaggcactgtgaatctggaaaactgaaaattatggctctataattgagtggacagccgtaaggagcaatcagaaacttcagtgtaagaggaaaaaaaaagatgtttttcagaaatcccggaagctaaggatcagcagaggataggaggggcccatttcagtctcgtgctttgttactggctacaaaggcgacggaatgaccaacaacccacttcctgttgactgaaactattgcctgtctccaccctattgctccccctcaccacctcacccccatcaaaggggcataacaacacaggggaacccaaagtctacaccccttaacctacgaccttccaaaatcatgtccggagctttcgccgacaccgcagactccttagcggctaagcgtgagtgcgccggctcccttgcctcgggtcagcagcaccccggggctggggctcctgcagcagccgcaccaaaaagtttcatccacaaccttaagtttggaaactatcgtttgccaagcgaagggttcccattattcctggctggcggtccatctccttgcccgtctctcggggagtgattcggtccgggacaccaggactctgcttggaggcctgctgttgcctaaaaaccccaagcgcgggcctcttcaaggccccaggttcgagatccgaaccctccagtaatgtcctcagactcctcccccttcactgcagcccgggcaatactcgggcctagctcctgagagcggcgccgttggcttacgtagcagcacgtgattggccaccgctccctggcaggccgggattggtggaagacgggccgaccccgcccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggtgaggcggcccccgagggcccgggcgcgggggcgcgggcggccggggacgcgggtggggacacagtctcggagcccggcaggccaaagccccgctctgcggccgagtccgggccggggtgggcagcaccggggtgggcagaggtcagagccaggcgcgggagggacgggcgcccgccaaggggactcaacggcgcacagtgccagggtcgctgggcgggcgagggcccggaccccaggttgggccgtggtccccccagctcaacaaaagcagcgtgcccggcgcggctgcctggggaagcctgggtccccctttggccccagggactccccttccttctcgcttcggcgctgccaggccggaccccccaggctccttccctccacgccgccttcctctgcctacccctcgtgcctcggacaccggtcccagcctgacgtttttaaagagaattttacagcttttatcattggggtggggtggagacaccagataggcaactgacatgtgagaacttaatgtttagggatcgggagatttggtttggggaagaatagtttgtctttaagcacgaaagctgggtttccagaagataacccagtcctcttccggaattgtttcctgtggtagttttgtgtattctatttttaaacggtcttctgcagcatgtttgcttagggtcattgaatcttgtggcttagtcttcgtttacataaggagaattcagttaggtttggttttggcgagcttctcagaccttatgaaaatatgcgacttttttttttttaaacctgaaaacatacgacggtttttaaaaattacttagttttttgccttaggcaactttaaaatctgtagattcaaggtatcataccagaaggtagtttttttgaaagtatgttgtctctcgttaaaagcattctgtttaaagtctttaaagtttaacttttgtacttttaaccctttactgaaatccagtaataaaatttcaccgttattcaagatccatctcccagcatccctgactaatcctactgtatgctgatctctcgttgatcagcccctggctatcttatcctcctttctacactaaacactcatcctcctccccacaatgtcccttcccttctggatcctttatcgtgctttctgattattgaggtagcattttggaagtaacgagggggagtctggccgaatctgcttagaaacccctgggaatcttgattcctggtgtgtgttcttcagcaccactctggagtacagcacaccttttgtgaatcagaagaggatcaggtactgaattccctcccggtaactggagttatatagttgtcgttgtattaataacttaaagacttagaacaatgacagctatcaactcatttggggctttattacaaagtaataatgcttttcattcagctgtggagtgtgtttactttttataggatgagtgggaggaaaacagctgggataagtggttcaccggttcttttgtcaggataataagagggtcagaaaagtttggagaagtgctgcttggtagaatttgttggtagaatttccagatctgtttctcacattattctgttactctctctaaagtaacaataattttcaccccacagcgttgctgtgaaaattgattataagaggactggctaattacatgtgacttttttaaatgctcaagaaaaatattaaactattttggcaatgatatttattcttttttgtatatataatttcaacttttattttagattcagaaggtagaagtacaggtttgttacatgggggtattgcctgatgttaaggtttggggtgtgattgatcctgtcacccaggtagtgagcgtggtacccagtaggtagtgtttcagtcttatttccaccccttccctttgggatccccagtatctgttgttcccgtctttgtgtccatgtgtactcaatatttagctcccaccataagtgaatagaagtttatgctggatctttcatcaccaactatttggagggtaaatatatgttagatatttgcatgtaataaatattcagatgataaaatattgaaataaaatgaaagcataagtcttctcttttaacaaccttgactcagatattggcctaaacatagccagttaaaagaaattgggtacggtggcttgcaaacgtgaggatttttttttcctgtacctttaacagatttattttgtagatatatgtgtacatcattaagattagaggatggatagaaagaaaaaggaaggaaagaatgaaataggaggaagatgaggctgaactggcagtttggaaagccgggtggggtctgaataaaggactataggcacaagtgaaaacgtggaagaacacagtgggttgtctcagtctttggtgacttccttgggcccaattcttttgtgacaggtctgtgggcatgatcaagtggaggatgggtggcatgagaagagtagtagttacgtaagtgatttcatatttcctcagcagatattcaggcacctaccaggtgcctaagtttgtgttaaatgatatagtcttgcaaactgtcactcttgcagagattgacaaggattattggggggatggggcagggattggggcagcattggccagtaagagctggactggtcaggtttcacagaccagatggaacttggactagaccagaatatatgtatgcaatagccaggaggtctcccttccaccagtcttgtttctctttgatccatccttcacatttctagagttagattccttaaaaaaaaaaaaaaaccttgtattataccctcatttaaaacaaagccattttggaatctcaactgcttttgtgtaaaaattaaaaaaaaaaattgaatggtatatatgaggccatttgccatccaactctggcctccttatgtagcctcagttctcatcatttcttatgtccatagccccttcatccccacctttcatcctttgcctccccttgaacatttcattcttacactcacctagatgtttcaggtctttttgccaatacatgcctttgcatgtggcgtttcatcttccgtcaggcttctaccatccgtcatctgtaaactcctgcttcatcctttaagatccagtcgggtcttgacaccattatgttttggaaaatcaactgatttaattctgcgcgccccctccccccaccacctcgtatttatgtgtgtttgccattgtgttagggcctgcagcttcagaggtgagtaaggcccaatccctcctaagagttatttaggctttttgtctctttgctgttatagcaatttgcttagatccccttaatagcacctgaaatatgtattttagtgtttctgtttagataactttttcctggttaacttaaaaatctttgaaagcatgtatcaaaattgtatgacatgtgcttgtaatgttaaatgtttttgttgaatggaaaaaatatatatgggcataatgaaggaatataatttcctcatagagggaaaaaaaaggtttgaggaggttacgagtagtttcataaaactctatttttacattcactaaaattttattacctctctttcagttagctttccctcattccccccaagttgggttttgtgtttttacatgtttttgtatgctttcatagatagtgtcctaacctcttttttttttttccctcaaagacagggtctcactctgtcacccaggctggagtacagtggcacagtggcaggatcaccactcatttcagcctcaaactcctgggtttaagcaagcctcctgcctcagccactgcagtagctgggaccataagcatgtgccaccatacccagctaattttttaatttttttgtagagacagggtctcactgtgttacccagactggcctgacctctattatttgttgtcctgttttgtcatcatctctctacttactttttctttccaaccaatagtaacctttacaaaagcaaagattgtcttatttatattaatcattatattcttagaataaaagtcactggttaatatttattaaatctttatttgcttaaaagaatattttcagtacctttcctgaaattttaagtcaactcattaactttgtgttgtttatgatagattgcaaacttcccgccatttgttctggtcctctctgcaaatgtcctaccttttgttctggtcctctctgcaaatgtttggcaaatcttccaaccttcactaactcctctaccttactggttacattgaagacatacactaacttagattcttgacattttgggaaaagctttgggcaatttctgtttcatccagccaacatagcccagtaagcatttcccagtctcccaccccaggacccaggatttaataccgaagctcttaccgatactaactgcccatgctttcagtccctctttcccatgtgaagcctcccccttctcagagatgagtgatatagttccattgttagcagttcagcttcctcctttcctttacttctcccaaaacaccatggcaaatcctcagggggtttgcctttttaaaaccctcctctgaccctacatttctgtttttgtctttttatgtctagtgaagtggttttctttatctaatattaaagtaagaaattcatggataggataattgcatgtataataatttgtaatgaaaatttgtgtgtgtaggagagagatccttgtaagtaaagcatgtggaaataggtgacaaataagccattaaatcccattaggcttttttcctttgctaatatattgataatgaggtttctaatgagagatctatctgacttgttagtgctctcttgttattcttgatctcaagtcactcaggtttgcttattgaggtgaagataggtgatttgggttcttagtgctactgtatatctttcaaatttcgtattggaatacattttaaaataggtgattttcttatatgattagtacatgacctagctagttttaattttataaagtagtatcaactttattttgtttccatttttattttggtagattttcttacatttttctcttttttaattatatttttgagacatatagcctatctcttcagaatcagtatctgatttaagttttatagttgtatcagggtttggtatgattcccacagtgattttttttaattatgactttgagttttctgagtattagaattcttatttgttactattataggacagttcccaagaagtaaacatccaacttgagaattaccatacatgaaaataacagctgtgcctgggaggcctttatgaccccttcagctatcaggccctcagttgttccatggcaacaagattgaaatgagatttggggtccaccaaccacccatttgctttgtccggtaaaggaaaaaaaaatgtgtgcttttgttttctccacatcgagaatttccctctccttcttcagggtataccttaattacagagcttggaggttattgcagaggaaatacttgtgttggggtgaggggcatgttggtcagaaagacccagagcagtggacattaagctttgtcgtaaagagtgtgaattctccaggtggaattggagtctgaagactgtgctcttccactttactgacagtttctacggtttttatgtttctgtttctttcttgaggatggagtttttttgtttttttgtttttttgtttttcgttttttgtttttttttcagtcgttgtgtctctgttttctggctgattcctgctggtaactcagtacatattcctgaatgcaacaaattccctttggaaagccagccaagaaagagcccagaaattattttcccacaaaaatgtgtaaaaatatatattgttacttgtagcaatcatgttatggctcaaatgaaaatttgtggactggcaagaaatcaaacctttgaaaatcagtcttagtgctaagtaacttgtgtcttgtaattcagtaatgaagtattcattgaatgcctgacaggcactgctaggtagtgggtatatgtatgttcgtgaataaagtagacatggctcttgccttcatggagctttctattctaatagggggaacagatgaagatcacctacttgtatcattagaaatagaattatgttctgtgaaggaaatgaggtacagtgagaaaaaataatccagtttaggatggcagctacctaaaggaggtcatcgaggaggcctttctgcaggagggactttaatagaaaactgagagaagatagaatcctgtggaacaactgaagagataaagaattctaggcagaaggaacctgtttaaaaagtcatgaggcaggaaaaagtttggcatgtttcaggaattgaaaggaggttggcgtggttagactcctgagtaacggggtggcaggggtcagatggtgcgaggctttttatgcgagtattctgagtgctccatgaatacattgatgggcttaaaggagaggactgataaaatacagcttgttttaatacaggttgagtatcgcaaattcgaaagtctccaatgaacatgtcctttgaacttcatgtccatgattttggagcatttggaattttcaggttagggtcactcagcctgtattacttttgatggggccaagagtggaaactgagggaccacttaggaggtaattcacctcatggaggcaagagatggtggtggtttggaaagttaggatagtggtagtgaaaatgcgatggatttgagctctcttctagacaaagaattaacaggatttcctgttagcttcgctgtgaggagtcaactgaagtaaagaatcagaggaggattgttaagtttccagtgtgaacagctgggcgtggggattcctgggttggcaaagcctggagaaaatcaggtggtggggggcatgttaagcttgaactttgttgcgtttgaggtgctagtgtggcatccaataatggtgccattaaatggtaccattactactaaacattttttccccctaaagctctaaacttgtccagcccacagctcaccatctttagatcttttctcaaatgttaccatctcagcaaggccttccttgaccagccaaacttatgttgaaaaccccacactgaccatctcccttccctgcttaatttttctccatagttaattttcaccatctgacatgttcttttttttccctaatacccagtgtgatagcacatctgacatgttctttattttactttgttattaactgaactgctttctcgctataagatcgtcagggatttttgcgtatggatcactgccatatccccagcacctaaaatagggtgtggtctatagtaaatgctcagtaaatatttgtttattgaatatatgaaacgacttgaaggattctgtagtgtttccacgattaaattttcttactagtatttgttcaggcttttggcttaaaacagttcagttctcttttttaagtgaatgtagattttgtatatacacacacatatatatgtggatttgcattgtttaggaataaaaacctaaaatctaccattcatattttaattttcttaattttcaggttacaactgatggaaaaccaaaaatcgttgatatcattgatacaacaggaagtggcgatgtgaatactgctacagaagtagagccaaaggatggtgagattgttggcctttcaggaagagtgcttaaggtgagaccttttgtcttctttttgaatttttttttttttactcttgcctcaaagcatctaatgtttttaccttacatttggtggtggtattagttatccattgccacatatcagattacctcagaacatcctggtttaaaatgacaaatatttattacctcggagtttctgtgagtcaggaatctgggtgtggcttaacggggttccagtcgccctggaggttgcaaatggttagccatggctgtgacttcagctgaaggctcagcttgggagaagaaggggaagtttgtttccaagcctactggtgggtcactggcaggccttggctccttgccattgggcctctccgcagtgctgcagtacctggcagcaccttccctgggggagtgagccgagagagtccccacgatgaaagccacaggctttttataaaagtgaccttctaagggaccacctatcacttgactatattgagctcattggaagtgagttaataaatctagcacacacttaaggggaagggatttcacaagaaatgaatcattggagctgtcttagaagaagccattattttgttgtttgatgaggtaattagaattgggcggtatttttcagtgagcttgccaaattttatgttttgaatacaaagatagagaaagtaaccacatcatagctttgccttcatgttttactgtcccttcatagtattcccagttaacttgaccatgaagaaatacttaggctatagtagctgttaacttaaatggccagctttgtcttttttttttttttaaacttctttttttcttttttttttcgagacatagagtcttgctccgttgctcaggctagagtgcagtggtgcaatcttggctcactgcaacctccgcctcccgggttctagcaattctcctgcctcagcctcccaattagctgggattacaggtgcccgccaccacgtccagctaatttttgtatgattagtagagacagggtttcaccattttggctaggctggtctcgaactcttgaccttgtgatccgcctgtctcagcctcccaaagtgctgggattataggcgtgagccagggcactcggcctaccagctttgtcttattctatgtccttggtagaaaggcctgggtaagctaaacgtaaaaaataattataaagcaagcacagaggagctcatgagctaaggagcatgaaggatggatggcaagaatttgtgatcctgtactcttaagcagcattagtttggaacataaaattatggttatttagttagcttttcccaccttttgccatctatctgaattgttcttaggccttgtcttttaagtaagcttgttgtggcagcatattggctttctgtgccgtgtaataaagcaccacagacttagccgcctaaaaccttgtgtattcctgtatttattatatcactgattccatggggtaggagtccaggcatggctttttgtgggtctctgctcagggtctcacaagactgcagtcaagattaaaggctcagctgaggctcaggcttcttttccaagtttacatgattgttggaaaaattcatttcattgcagctgtaaaactcatgatagcttgcttcttcaaggccagtaagagaatctctgaccttggtgatgaccccagtctttcttttaaagaactcacctgattagttcaggcccgctgagaatcatgtcacttttgatttgctcagagtccttaattgcgtctgcaaaatccctacaccttctttacgtaccataacgcaatcatgggagtgacatctcattatattcacgggtcctgccttcacttaggggagggacgtgggtcttcttagaaatctgcctgtcatgggcagatagcagccattaataatccaggttctacttccttttctgtgtgttaggaactgattatctgtgtccccaccccctgccaaaattcatacattgaagccctatccctctttgtgttggtatttgaaagttgggcctttgggaggtatttagggttagatgaggttatgagtatgtgtcccctcaggataggattagtacccttataagaagagacatcagagagctctctctagagcaagctctttctagggcatatgaggacacagcaagaaggtggcctctgtaagccaggaagagggctttcacctatgctcaaccatgctggcaccctgatgctgagcttccagcccctagaactatgaaaaaataagtttcaattgtcagagtcatccagtttacggtgcgggttgagaatcccttatctgaaacgctggggaccagaagtgttttaggtttcagattttggaatatttgcattgaatataccagttgagcctccctaatccaaaatccgaaatgctccaaaatccagaactttctgagtgccaacatgacactcaaaggaaatggtcaatggagcatttcagattttcgggttagaaatgctcagccttctgaattactctagagtttggcctgtcttcccccaagtcaaccttgttattagaatatgtttcaaagggaaacttgggattcctgtgagctatggtactctgagaagctagagagaattcctagtaagtcttgcaggcttagagccatataaagtattactcgagcatttatttatttatattaattttgagatggagtcttactctgtcgcccaggttgaagtacaatggcacaatctcggctcacctcgacctctgcttcctgtattcaagtgattcttctgcctcagcctcccgagtagctgggattacaggcatgcgccatgacacttggctaatttttttgtgtgtttttagtagagatggaattttgccatgttggccaggctggtctcaaactcctgacctcaagtgatccacccacctcgacctcccaaagtgctggtattataggcatgagccaccatgcctggcctcatttatttttaaatagctgcagtaatcccggctttagataaaccacatgaactaataatatcactagtgttcaaaggtagaattatatgtgtaccatatgtattgctattaaataaagtcaaaaaaattataaggtttgtcttttctcagcttggtgacgtatttctttagctctaacattaagtattctcagcccctcattgtgggtttttaaacttaatttttaattgtgttcagtatgtcttaatagtttaaaaagacaaatatttttacaaggcttctaacaaaaagagttaaatcctgtcccacttctcccctactgttttctactttaacagtacattaatacattaaattatcttcagtttaaaataacatgctaatattttttatttcttgatttttttttctagtcttaatctttacttgtagaattaatatgtggaagaagagagtttaattctcaggtcctttatttccaagaattttttttgcattttctcttaggtaacttcctctccgttgttttgctgtttttttctggaactcctgttaattgaacattggacctcttgacttgatcctccaatttttaaatttttttccaccttttcttcattgccttaatctttttccttcctgagagatttccagcattttctcaacattgtaacccttgtgtgaattttttaaaattttgcctatttttaattgcaaaagccccttcatgttcactgggagcatatttttgtatcatgtatgcaacattttatctctgagataaaattttaatttttttctatttcattgtttcttccctccccttcctcctgttctcctttcttagtctcctattctgcttcctcctctcctttctccctttttcttcaccctctccttcctctttctctgcctcctcttccttgttctctgctttttatgttagatattttgtttaggtgtctaatcatccctagctgtcttattttagcaaggcacaagaaaaggtgattggaagctcctctgcttatgtagggtcttttggtgggtttcactatagggtaatgataacatttaggggaacccccataatatcagtatacactatatttttttccctcaggatgcccagttaccttaaagaagtccttagcccatttggcctggggtttaggggaggagtgagcaagaagtctggccgtaggtattcaggtaaccacaccatgcaaggggcctggagtgatgtcatgcagactcatttttatgtctcatcctttttgtattagttccttttcacattgctatgaagaactacatgagactggggaatttatgaagaaaagaggtttaatcgactcacagtcctacaggcttaacaggaagcatgacttgggagtcccaggaaacttacaatcatggtggaaggtgaaggggaaacaagacatgtcttctcatcatgatagagcaggaaagagagccagcaaagggagaagtgccatgctttttttttttttttttttttttgagacggagttttggtcttgttgcccagactggagtgcaatggcgcgatctcaactcactgcaacatctgccacccgggttcaagcgattctcctgcctcagcctcctgagtagctgggattacaggtgtctgccaccacacccggctaattttgtatttttagtagagacagggtttcaccatgttggccaagctggtctcagactcctgacctcaggtgatctacctgcctcagcctcccaaagtgctgggattacaagcgcgagccaccgtgcccagcccccatgcatttttaaaccattagatcttgtaataattcatcatcacaagaacaacaagggggaaatccacccccatgatccagtcacctcccaccacatccctcccctgacacgaaggggttatatttcgacatgcgatttgggtagagacagagccaaaccatatcacctgttctttgctttgttgacatgtcagcttttctctggttcagcttggttggtgaagtttgggcaggatgtgggatggggcaatgggagtgctcttatacaaattttccgccagtcttcttagtcagaactctcttctccatccatccataacatgtactcacacacatgttcagtttaatttttttcagggatgtgcaggtgtttagatattttgcagtagtcaataaaaggaagaattattaatcactgggattctgactagttgcatctctgcaactctttagtacatagttttcagaaagcagcacaatgaagtcttcaagtttctttgatgtagtcgtgcatttatttatttatttatttattcatttatttatttatgacagagtcttgctctgtcgtccaggctggagtgcagtggtgtgatcttggctcactgcaacctccgtctcctgggttccagcaattttcctgcctcagcctcccaagtcgctgggattataggcacccgccaccatgcccggctaattttttgtatttttagtagagactgggtttcaccatgctggctaggcaggtctcgaactcctgacatcaggtgatccacccacttcggcctcccagagtgctgggattacaaatgtcagccaccgcgcccagctgtcatgctttgaaatgaattaaatgtttatagtctgttttttccacatagcccataaactgctaacagacttttatttttctgtcagtttaagatcaactgttaagttaggtgctttgaacactttagtagcctcattctctaaggatgatattcctaggcttccttgagaaaccagtggtaagctacttatgacctatggtactcccatgagcagataaaagtacaaaagtgaatagaactttaaaaccttttattgcaaaatatacatacataaaatacataaaacacatatatacagttttatgaatagtatagctaacaccattgtacccacccagatcaagataaagagtattgccgtacatcagaaacttcctgcatcctcctatatcacagcctatttcaacttttgtgataatcattcctttgcttttttgtgtgtagttttaccatatctgtgtggctacataaaatatattgtttagttttgaactttacataaacagtctcatttcattcataaaatttcatcatacgtcatttttcccttggtgttgtgagatttcagattcctgagacttgcccatgttgtcacgggcagcaatgatttattaagtttcattgctgtgcaatatgccatggtttgtacctactacattctatccattctgctgtgatgtgtgtgtatcctgtgcacatgtgtgtggatgtctccagaatgtgtgcataggagtagaattgctgaatcatggagatatgtcactaggtcatgccaaacagtttttccaagtgcgtgtttgtttgttttttaactggacaggacatcttcttgaccaagtgtctgtattaaaggacatttccaggccgggcacggtggctcacacctgtaatcccagcactttgggaggccaagcactttggatcatctgaggtcgggagttcaagaccagcctgaccaacatgtcgaaaccccctctctactaaaaatacaaaaattagctgggcatggtggtgcacacctgaatcccagctactagggaggctgagacaggagaacacagaggttgcagtgagccaatatggcgccactgcacagcagcctgagtgacagagcgagactccttctcaaaaaaataaaaaaaagacatttccactagcagtgtataacaaatgttttctgaccccatgatcatagagatattctcctatatttctaagaagtgtcacagcttttctcttctgtttgttctagaattcacctggaagtgattttatatgcttagtttgaagagttctgtttccttttttctgtaaaaagacccagttgtcccaacaccatgtgttccacaattttcactctaatttttaatgccttcttttcacttggcacccttcaaaatgtggtgagcttctgaagtctctttcgtattctctttgtcccttcgtttttggatgcttccccgacttcctttattctaattttagtagcattttggaaggaagcacagtacctttttcattttaccacatttaactggaagtcattttaaaaatcaacacttagtcttaaatatttttggtttttaaaaaaaataaaataaagataaatccaggcataatgaatgacttggccagattcagcatggtacttagatgcagtgacagccaaaggaaactgtgcgtgtgccctggcctgtgtgatgaggctggcaagactgaaatcatttggaagcaaaagcctctaagagggcttcactgcatggtaccctaacactcagatgacacttagcccgttaagaaaaatgtttgatttgttaggcatcctctctttaagagagtcagagaaatgaggtgtaattggtaattaaaaagattacgtgtatcatatgacaatcagtcttaatacattgtagttactgtgttattagaaccatttttaagataccaacctaaaatggtcaaatgtaaagattttattcttagaaaaaataactttgtttatgtagaatactcaaatatgcaaaataaaatttcataattgcctcataaagttagctttactctaacttggctaaagttagatcagatagcccagattataacttttatctgatttttttggtgtaatttttgtaactagtctgccttcgtggtaaggaagatacatagttgtgatttgagaagtatctggttccatggaccgtgcagactttgatctcatttataattaaattatgtctattggattgtttttattgtactttatgtttttttaagaaattgtgattaaatataacttaacgactttctattttgcagttattttaattagttacttcatttaatcttttggcatttcatgattttctgtaatgtctgtacaaagaagttgctgctagccacctgtgtagtgggacagtagtgaataaatacttggaatttaaaagctagtgactacttccctttttgttgttgcagtgctttattgttttgccgtgggctgttgcaaaaacattaaagttcagaattcctattctttaaagaaggttcagttttgagtgaaaagtgctagcttgtatgccagcgtgtttgaaattacacattctgcagacatccagttgatttggaagtgattaatggcacagaggccttcaaaaggtcactatttagtattagctccttgaagctctgtgaatgattgttttcctctatttagttgtgaggaaatttcatccaaaagttttctgcctgggaagtaattggatgaaggacatggggatgagttaaaggtattgcacaagtgaggattgatgaggctaccagctctgagtgtttcaaccttgtcatttatacatatttaaaagctggttttgatgaccacggttccatgattgcaaagaatatgaataccctacattttcttgattgatcattcatgttggttgatgctcagttcacttttttgttcacaagaataaggtagagattttcttccttttacagatgaagtagaagcctgtgggttccttctagttagtgatagagtttggattcagagccagatttatctgactttaaatcccatatcctttatacagaatttttggtttccatgatagaactaggttccagttttcaactttcctcttgttcaggcaagtaatttgatttctctgctgctttgctttctctgtttgtaaactaggcgtactgtttgcatcgctctactaaaagtttaaagtgttttaaaacactttgagatcgtttaaaagattattacaagattttagcagtttattgagatagtgtatgttgaaagcactttttaaaccatgaagcattgtataaatgaaggtattattctagttgaattatttatggatgagaaaaaagaagtgataaagacattaagtaactacttagagtattaaacacgttgttgtacatgagcatccttatccaatttaagcttattagagtagaagtaatatacttttttgctcagtagtgtatcattggaattggaaagcatttagtgaatgaacaggttactctttttttttctgtagattcctgcaagctggacaaatccctcaggcaaatatcatattggcataaaaaatggctatgacttctatcctaaggcactcaaggaaaggatacaggtaatgtacaatctggtaccaatgagttgtattcttctgacttgtcttcttcctcagattttattcctactgaagaaaaagaaatatttcataaaatctcattaacttagttttttgggtggttggtggctttcaaacaatgactgcttaaagattctgctcaatggaatgtcatccgtgtaaacttgtgattcttgatcttgggtacatggataagtttagggaatctgtgaatacactgaaattatattcaggtttttgtgtttttctgggagatgggatatagctttcactggatttttgaaggacttttttttacttgaaaaaggctaaagacagtggattcaaaatccagaccaccttttcgtttctgttcctgtagtttctgtgataatgtccctcccctgtttaactagccttcttgctcccagttagtcatcatttagtattaaggtaagtgttaattcagtcctaaaactgctgaagtgtaagaagtaccagtgtgccattagaaaaataagagtggtaagcagaatgataaagagcctgctttaaaacagttcaatagaactttctgtgataatggaaatgtttgaaatgttcagtttctgctctaaccattatggtagtcactagccatgttgctattgagaatttgaaatatgtttagtgtgactgacgaattgaaattttatcttagtaatattttaaaatttaagtttaaatagtgtcatgtggctagtgactaccgttttaagaatgctgatacaagtagctgatacaagtacctaatacaagtccagggttgcagctgtaaaataaggtataatcctgggaagtgagcttgatggataagatgtgtggggccttgcctctgtcgtgttatttccccaagggcctgtgaagcataagaagttactcagattaccttatttgtcagtttctaatcattctgcaaaacaaacaagaataatgcgtataacttctattacataatatgttattttaaaatttcaggctggaatgcagtggcatgatcacagctaattactgcctcaacctcctgggcaatcctcccatgtagttgggactacaggcacgcaccaccacacccatctaatttttgtattttttgtagggatggggtttcaccatgttgcccaggctggtctcgaactcctgggctcaagtgatccgcctgcctcattctcccaaagtgctgggactacaggtgtgaaccattgcatgactgcattttatatagtatattaaatgtaatcagctgtgttgataagatgtgatttaatatgcaaatatagtgttgttgaagtggactgttcctttagctgcgttgggagttaccgtgagttaaagacactgaagataaaggttaaaaccaatttcagtgacatagaaccctatcaagtcaaagaggatggaaaaaaaaatagggaggacattgaggatgcctgcattgtctgtcaaaatgcagctgtagtcttactctagtcctctgcgtacactaggcttatggcatttcccaattttgtatgggcccagaatacaacattttcttccttttaatgactgggaattcagtcagtattcttggagaagagaaggttttaaattggggaatatgatacataaaaatacatctggatgtgtcttggtaaacttctcttaaaccctgggtgcaatgaattgactaaccagtttttagtaagtgatccatggctttatctgcttcattagaaactttttttttttttctctttgagacagagtcttactctgttgcccaggctggagtgcagtggctcaatctctgctcactgcagcctcagcctcctgggttcaagcgattctcgtgccttagcctcccaagtagctgggattacaggcacctgccaccccacctggctaatttttgtatttttagtagagacggggtttcaccttgttggccaggctggtctcgaactcctcacctcaggtgatccgcctacctcagccttccaaattgttaggattacaggcgtgagccaccacacccggccaaaaatgattttttaaaacctctctatgagaattgtgtagtatcacaactgtaccaacaaagtccacatataaatgcctgtctaggtttacctgagtatttgtcagcctaattgtaaggtaatttttctgtctttgcagaaagaacggaaggaaaaaatctgggaccctgttcacagagtggcccttgcagaagcctgtagaaaacaggaagaatttgatgttgccaacaacggctcttctcaagttggtgctagtcgatttcatttaaacattaccctagaaccatattcccatagagtttctacagaactaatagactgtttttccacaagttttcttttttcacaaattttcttttaagttggttaattttactaatttttcctttattatttatcctcaagtcaatgtacatatgtatgaatttttaaaatttaacacataatacacgtagggtaaaagtacataaattgtgtttggttatgaattctcccatgaaagctgcacctaggaatttctcttgtgccccttccttgtcactgctccctttttccttccgaaagacaaccaccaccttgacttctaacactgcagatgattttgcctattttgatttgtgtaaaatggaaccatatagtatggttttgttttttgttttttgttttttttttttgagacggagtctcgctctgttccaggctggagtgcagtggtgtgatctcggctcattgcaacctctgccttccgggttcaagctattctcgcctcagcctcctgagtagctgggattacaggcacgtgccaccacacccgactagttttttttttttgcatttttagtagagacagggtttcaccgtgttggccaggctggtcttgaactcccaaccttgtgatacgcccaccttggcctcccaaagtgctgggattacaggcatgagccaccgtgcccggcctatgtattctctaattatatgtattattgtcacttttaaaaagggtttcaaaatacttcatttttcagttaatatattagacctcaaggtccttgtttcaaaacatgggagggtgtagtccttggttcccatatactgatttgtggaattgatactgatgaactgattatctctaagtcacctgaattattttaaaagtaattaagttttccgggctttatcccctgataattctgatttactaagtgggattagaaacagcatcgatgtttgtgatagcctttacatgattgtgatttgcgtgaaatttagtaattattggccaagataataatttgctatcctactagtttctgatgtgacagcctcagattatcataaggacaaataacttgctcaggattgcacagctaagttgctgaattgagatttgaatccatatttcttccctctaggttaatactcacaccacactatttatagaaggcagattgattttaagcaatattaagtgcttttgatcaaagacgactacctttttcaataaattgccaaatagtaaatatttttagtactctcttatgactgctcaacactccccttgtatcatgaaaacctaggcaatatgtaactgaaccaggaaggccatgttccagtaaagcttcatttacacaactttgtcacaggctagatttggcccatgcaccatgatttgtcaacccctgctggatcttaatatagtaacatagtctagagatattcgtctcaatttcagtatttatatgcctttctatctcccagcttatttctgtttaaaccagtcattttcctaattatttgagtacctaacttatttttttatatacactctaggttagagaaatgttttggagaggtaacacctgctagtgccagttgttgtctagtgtgtacgtaatcgaatttaaagcacttggttttattcatgaccacagagctaaaataaggcttcacttacccccattaaatgcttctatttaacatagcagtttctaaaagatataagatgattcatgggttttattatttatttggattcttaagaaataaatttgagatagaataggtcctgatataaaaatctaaaagtcaatagataacctattttgtagcagttttagagttgcttttggaaataagttagataacaaatatgtaacaagcatatcttggctaaatggaatcaccaacgtgtagcacagtgtatttcccaaagcaggcctagtgagtgaataaatgagattgagtaaaataactgttttttagatctttattaattagatctgtattaatgggtatctgcttcattgaattgaatgacaagttgcatagatagaacaaaattttcttacattttttcagggtaaaataattttactatggattaacattgtatctttggctgtatgttaatacaacttttagaaggacagaatgtactaatgttaatcagttttccaactgactaggcaaataaactaatcaaggaggaacttcaaagtcaagtggaattgctaaattcttttgagaagaaatacagcgatcctggccctgtatatgactgcttggtatggcatgatggcgaagtctggaggtaaacttcatgtattttatacatcttcatttacaaatgttttcttttctactctgaaaaacattaaatgctcagagctgcacagaattttggtttattcgtgatatcactcagcaaaatcatttaagggccaaattggcatctgggtagttttggacaagccccttgaacttctagttataattattgacactaaacctgacttttatctgatttaaataaacttacttcattaataatttattagtatgttgaccatccgtatatttggaaatgtttcctcatttgttaattgagatagtggtgcttacagggctttgtgaaaattaaatttgatgtttctagatatagtaagcaatcaatgtacgctgttgctgctgctgtttctattactaaaactaataataataatgcgatttataccaagttacccatcatgtacgttttttagtttcttttttagtgccttatatactgcatatgtgcttcttggagttgattagtctgccttcttgagttactatctgcatgaaaacaggaagacattgttaatacagatatttagccatatgtgtgctttaggatttctgcaaaaaaaaaacaaacaaacagggactatttcttaaacttgtagtcaagaattacttgtagtctgcgtccctgcttatacacaaagaattgcatcacaaggtggggcacacacagatcatgccatgactgcttcctcactgctctcacaattgttcaccttcacagtgcacccttcttaaaggagggttctcctcccacgtgtgcaggtactaactcatctttcatcaaaggtgtatgcaatgttaagttgaatgagaaatttctgctcaatttggggatgatggtgttaataaaataactgcacataactctttcaatctagatattaaatattaatgcacttttgtgtgtattcatacatgttgttttgttgtgtgcatatgcatacacgttttgaaaaattattttccagaggctttatacagaataataaaccttgatacatccaccatctggggtaacatgatacagtcacactcagtgataagccttaggtgcgttttagtgtgggaaaggaggcaaggttaaattcaaggaaaatgctaaatacgaaacagagtatatttaggaaagtatatactacaaaagaacttaaagaaatactaaaatattagcagggattgagtagtgaggcaataggtggtttcatttaaagtgtttgctctaggttctgaaaacactgcagattactttgtcttaggaaaaggaatccggagtcaggatgtccagggtaccagtgtgtgtttccacaagatttccttggtcttcaaggtgcttgataaagtgactcacttgtagcagtttgttgacaactattctaagggttttgtttagaacttttgagttagaaatgaaatttaatctaacattaagtgaaataaaatctgaaatctcagaataacattttagaacattttattataataaatgaatatagcataattatactttcaggtggtactagatataatgtaacttttttgcataatacagtatatcctatagggctttgatctcagagatccaaaattttttgaagagaaccttgtagatcccagggtacataaggttaatccagtcctgtctgcagatgttctcatttcacatttcaaaaatgccaaccatttctgaagggaggtaaagtgacctattctttaagtaccgtgggttttttgttttgttttgtttgatgacgaatgtccagtctgtgctctccctgccacatttctgctaattgtttagcgcgtatctctgcacttaacgggtggcctcagatgactctgttctgagcatctgtcaggacgcagagcctcagactcattgtcactccaaatggaacaaaaactggttgagagaaacagtgtttacagaggattacataaaggagaagctattagttgatttctttacagtggattttgaccttgcttatgtcatgtttccttttagattcttgatgaaagctctagattctttccatagaaaattgagagatgtgtgaaaatgtcgagaaatacataaaacaaaagccttttctctcatcctccccacttacatgtaccctgctctgtgtatgagcctcattttgatatcctttctctgtattctagctgctacttgaattcagtcaactagaccttcagaaagttataaccttgcaccacattcatacttgtcttctgtcgtgttatttagagaagtcagtaataatttatgttttgatgtgttggttgtattgttgagtcattccaatgatggtggttataagaaactgacctgtggaatgtgtcactgtatttgctgtgagaatgttgttaaggatgatgatttcgttaattccttaatcatgtggcagatgtttattgagtaccttctttgtaccaggttgacaccatagaagctactccatggactctagattccatggaagcaagtgttgggaacgtctgaaccagtctaggaagaatcgagaaagatttcccaaaagtattaataacatcttacattgagacttgaaggatcatcacagtaaactaagcagagaggtagaaggggtgggggaaagatccagaggatgttggaggaactgtgagaagtttggtgtggccacagaggatatgatgggagcaggaggtgagggaggtgagcagatgattattaggggcattgctctggagtttcaatgttaagagccgttggaagacatggaaggttttcagcaggagtcaaatgtaggggcagagcaggccatcagctcatcaggcaacagcggtaaggaagagacagtggaaataggcggacacattatggagatgggactgtgcggttagatgggctgggggaagaacagagggaggactttgtagatgacttccaggatggatgctggccgattgcataaattttggagacaagtgctacttctgtagcatgtggaagatttggtgacatgcattttacccactaatctcaagcctgattctgtttaatatgtgacttgtttgctctttgcttcattttctccataagtgtttagtttcctataccttcgtatattctattatttgaaattacatcagtcatattagggcaatgcataaaaacaaatttttaagaatccttttttccaaagtgttgtaatttgttaatgaaatatgcttcagtatttatgataaatcatctctctgtgctctaccagtaggcttctattaatttacttggcaattttgactgacttgcatagcttgttaaaatacagttcttgcatttaaaacatacttagagctaaaaacataatattgaacttttaatgatgttcatttcatttatgactttttgaatattaagtgtattttgttttaatcaggctatcttctaaagtgttcggaatataatttaaaaactattttagttagtaaaatggaaaaaacatgaaggaagacaaccataaagtaatgtagaaaatgccttctgtgagaaataaatttaagtctgttataactataggactgaagctcagtaaaattcacctagtttcaaagagcttgtgtaagccgttagattcttgaagccattactaaaagaagcagctggaagttagacctaggccatgtgtctgaactatcctaaactgctctaaaactctaagccaagttttagctgtaattcttaagagtccaggtggtttttaacctagagttttgtgaaggagggtatttttaaagcactttgtgcatgatttaagaactggttgctgtaagctatcttacctaatccttactgcccactctaagaaacaggctaaaccaggcagtcattatatttatatttgttgtggtagaggtagtagtatagtaaaatagtggagagactatgttacatgatttttagaaaggtaagaaaataaattttactgtctccatttctttttaattaatagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagcggaggtatcccatttcagattgaccaatgagatatagatttatgaggtgataaagtggtacgttgcgatagctcacagcaaccttctagagaattttaagctagagatcgtagctaaaggactaggtccagaatcataaaggtgatttgatttacctgcaagatgttgttttttaaggtcataaccatgtgggatccagtccaagaatataaaagcatgttccaacatcagaaaatccatcaataggctgggtgcagtggctcatgcctgtgatcctagcaccttgggaggccgaggtgtgtggatcacctgaggctgggagtttgagaccagcctgaccaacatggagaaaccccatctctactaaaaatatagaattagctgtgcgtggtggcacatgcctgtaatcccagctactcgggaggctgaggcaggagaatcgtttgaacctaggaggcggaggttgcagtgagccgagatcgtgccattgcactccagcctgggcaacaagagcgaaactccatctcaaaaaaaatccatcaatagaatttatctcatgaacagcaattttgcctcgaaatcttaactcttgagaaattcacccatgagtacagagaatcagataaaagaatcctcactacggcactctgtgtgatttcaaaaaagttggaaactaaatacctattaacaaaaaaatatattttttaaacaactgtgtgttattcttactgtgaaatacagtcatcctttggtatctggggggattggttctggaatgtccctcagatgctcaagtacctgatacaaaatgacatagtgtttgtgtataacctacacacatgctctcccatgtgctttcagcatctctacatgacttctaataccttatagtatgtaagtgctatataaatagttgttatactgtagttttttaatatttatatttttgatccgtggttggttaaattgcatgtagttggtgcggaacctgtggatacagagggccgaatgtattatatagcaatcaaaatgctgtgtgtataaacccctaatacataaattatattgaaaaaatatgtactgatgataaaacttgtaaaattctaaaacatgccgaatagtactatgcagtgtttatagatatgtgtgtttatatcgtgaaaatgttaaatatatagatggaaagattatgcacaccagctccaggatggtggctacttctgggggaagttctccctcccagggtagggggaaaaaggagaatgaagtgggatgactttaactctttaacgtccccctcctacctcccagttcattgaggtatagcttaagtacaaaaacttcacatacatacatatacataatttgataagcttttatgtaaatatatcagtatatccaggaaaccaccacaatcaaggtaatgaacatactcattacccccaaaagtttgctctctctattatccagcctttctccacccacatcccggggaaccactgatctgttttctgtcactccagattatttcacactttccagaattttatgtaagtggaataaaaaatatggttttctttccttcactcagcataatgattttgagattcattaatgttatgattataaagctggctctttatttctgagtaatagttctttatatagctacaccacagtttgtttatccagcttcccattgatggacgtttagattgttttggtatctgtcgacatatatttttatttatttttgggctgatagctgagagaaccagttggatatggtaaacatgtacttaatttttttttttcctttttttttttttttttttttgagacagagtctcgctctgtcgcccaggctggagtacaggtggcacggtctcggctcactgcaacctctgcctcccaggttcaagttattctcctgcctcagcctcctgggtagctgggattacaggcgcgtaccaccacacctggctagtttttgtatttttagtagagacagggtttcaccatgttggtcaggctagtatcaaattcctgacctcgtgatccacccgccttggcctcccaaagtgctgagattataggtgtgagccaccacgcccggccacttaactttttttttttttttttttgagacagagtctcgctctgtcgcccaggctggagtgcagtggcgcgatctcagctcactgcaagctccgcctcccgggttcatgccattctcctgcctcagcctcccaagtagctgggactacaggcgcccactaccatgcccggctaattttttgtatttttagtagagacggggtttcaccgtgttagccaggatggtctcgatctcctgacctcgtgatccgcccgcctcggcttcccaaagtgctgggattacaggtgtgagccactgcgcccggccttttttaagaaatattcaagctgttacctaaaggggctgtacccttttcactcccaccatggtgtgtgagaattccaggtgctctgtatcctcagcaacacttgctgtggtcagtcttaatagtggtcattctaactggtgtaaggtgttttgaaggaaaaaatcacattaaacttgtgctctcccaattttatctggggaaagaaataagaaagccagaatccgcaacattgggcgaatgttttcttgcatgacagcagctggctagagcagaggagtctcagcattgctgcagaccctgtttcaaagccacatagagatgcctgcctacttctcctggagctccaacacactatagtccccaaacattaaggcccagtgccagttgtcatttatcattgtgcttgtattattgtttttctgagactagtgggatatttctctatattcatgtcttttaagaaactttttcactaaaaggctagttttttgttttagtattactttatatataacatgtacaaaaacagatacaaatcacaagttgtacaactctttgaattaccacaaagtggacacttctttgtaactacaactcaggtcaagaaatgaaacataatgaaactcccatcatgccccttcctaatcagtaatgtaccctcccacctcctacagttaactactatcctgatctccattgccacattagtttggaccatatgatgttgctgtttttgtgatcggaaatgataaaatagtggcagtttcagatggttcagcctttttttcatttatatgaaaattcaatatacatttttgtatgtgacttctttagttcagccttatttttgtgagctttatctcatagtacatagtagtagtttattgctgtataattgtcagttctatgaattgatgtacatgtaaccatttactgttaatgaatcttgtggttgtttttaagtttttgaattttataaacagtgttgccatgaacatttttgtgggtgtcttagttacatgtgcacacattttgttattgtgtgtacctagaggtaggatggctggctcataggctgtggcagtgttcagctttcactccagccagcagtgtatgatatgtacttccatccacacttgctttgtcagcctttaatattttggcaattctaaaaggtacgtagaagcatctttttgtggcttaatttgcgtttcctagatgacgaatgaaattaaacatcttttcgtgtgtttatttgccctttgggtatcttcttttataaaatgctttttcaaatgtttgaaggggggattctccctttttttattgtgaatttgaaagatttttatatattctggatataaagctctttgtcagctatacatgttgcaaatactttcctttgtgacttgagtttttgctctccatgaacagggtagcagagtaatgtgtattctttttatcatgattaataatatgcaaattgaattgaataaactttcagtccatgagaatgttttgtcatttccccacctttgtgtctctaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctgtgagtgtttgtgagttgttgattcagaagattaatgattaatgatcttggatatttttaggtttataagtgctcctagtttaccaagaatacattgaactatatatagtgtacaggacttttaacaaagcaaaaatatttactaatttatttttaaattatttttattaaatattattaggatttggcctaacctttgtgaaaaaattacttacttcatactcgtcatttctagcaaatctcctaacaagcaattttgagatacttaaaaagaaagacctcttagccagctttctccatcagcctaagaggaatttaaaacctcagctaacattctgtacatcattttaacgtaggaaagtatatttaattttagtgattttttaacctaggaaggaccattccattccctctacctctgtccccctctaaccccactcttttctagaaatgctagttttttgtttttttttttaatgactacttttttatgtgtctcctcctacctttttgtgtttatgtgcttatatgtccaggtatatggtgatatgcctggaggtaacttataaattagaatatgattggctaagaaactataggattatatatatgcccttattttactggctaatctgtttctgtaaattgctgcctaaactagagtcttaatctctttaatagatgatagaagttataaatcataagtgtgatcttgtcaactacagttacggagaagcaactcactggccaaattctgggtgagtgttccttgacagttgtttagccatagaaccttagccagtgaagagtatgagatgtttttcataagtggattgagtgtcacggtggaagaaagaacagttgcagtggttagatgataactgtgttcaagaggactttcatcctcttgaagtcctgtttggctcgtaggccgcacacccccgttcctgtgttcacatctgtgacgatgttaatgctgttcactgcaccatgcctgaagtctcaactctgagcatgcctgtgctgtcctttgtggctcttccttggttaggtctccctcacagttcttctgagatatgcaacccacagactctggtgttttttcactgtcagatgcactgcatcctcacttctcttcccaggcaatttagatctgacaatctgtctatcattataattactagttccacaagcactctgaagccatcctcagttgtatatacatacccgacagacgcccagacttgctgaaattttgctattctctttagtgacttgcatctcatctgcaaaacttactgttggttgcgtatgttcactaactcggtcagttttcacatctcctcaatccattctagtgtgtctaggatgcacccccactcccctccttcctcgttggcttcattgtctttctgctgccaaatccagtgtcatggccttgacctaatgttaccttcctttttttcttcatagtagtagctatttgaaattacctcgagtatttacttgttgatcatctctcccccattcccatcaccaagctatcatctggtttttgagacatcactttacggtcctcgtaacatgcaccctgttatcatgagtcatttcattcttccctcttctctcacttctttattttacttaactgtatttctttctctactttaactttcatcctcttgaagccctcttttgctaatattcttccctttctcagatactcacacttacaactttgaagggtcctgtgcatggctctgtacctttttaatgttaacttcattttcttcttcatggtataacctcatctcctctacttaatgtcagtatatttttcttgtttgctgtcaagctctaagcaggtttcttacactttaaaatcttgctcttaagttcttcctagtgccttagttaccttttccacaaaagatactggttcttttggtcaatttctactcataattgtatgtacgaatcttctgaggtgtgtcttcaggactatgttaactgggggatggaaatagaaccacctattgcccgagtcactactaatattttactaccttgtagtatattttcccatatatattgttttgcacctagcattttccccacatttaatttggccttataactgcttccctaccctaaagcccaagtagggtatatcacttagaatggctgtatcatgttccaccaagggtggatgtaccaaaatttatgtagccatatatttaaacaaggttttggtactatatacactttgggaatagaggctgattatatgttcaaaggaattctctctttttcaggagaatttgtgaagtaattaatgaagcagtatggaagcataatataatttatgtttcaagtgctggaaataatggtccatgcctgtctacagttggttgtccaggtggaactacatcaagtgtgataggttagtttcctgttttagaaatagatttgtttagaaacaagcaaacaaaaaacaatagttaatgaaatgttacctgtatctctgctacacgtaagacactgtacaccttaagtgtgtcctcaggaaacttatagtctggtaggggaaccagcacatctagaactgaccgtaatttaaagtggactgaaataagtggtttcatagaaatacacatgcatgcttttaggtgcattagcatatttagtctaaaatatcctgggataaataatcctgggagataggtattttgtatccaaaagcaaagttcttagtaaaatgtctggtacatagtagactttcgttgtttccttattaaattttattcttccatcgtattagagagaggactggtgttgagagattaggcagtttactcaagtgaacagtggatttggaatcaggatccccgtttgttttcttttcttaatgattaaatccatcccacaggtgttggtgcttatgtttctcctgatatgatggttgctgagtattcactgagagagaaattacctgcaaatcaatatacttggtcttctagaggacctaggtaggtgcaggtagaacgcggaaccattacgtatattcggttaaactttacactgttgagaagggcagagttttagataagtttgctagtttttttctgttggtttttacttttttttcagtattttcattttgattaacagtctcatctcagggacagataaataaaataaatgaaatagtttcattgttacatggagaacatcactattctgagtataaattcttattcctatatccataattcttcatttataagaatctaaagaaaaagtagggacttggatatctttatatagtagtgatggccttgttttaaatagtttttgatatttgaactttggtgaaatgaaagccctaagcttttataaagcatcacagtcatagggcccacgtacctgtggctcatgtctttgaagttataacttactttgagcaattttgggtgagatccaaaagtaaacaagttctgactgagaaatgaagtctatctcttttggttccctgaagccctctgaactacatttatctgattctgtgaactgattttctgaagaggtatattaagtcctaatttatgtaattcttcgttatatcatcagcgggtacatgcaccttctgaaaaataaagcctattttaattcatctgtttggagttaatttataaaaagaatagactttgaatttagttcagcaaataccttagtgcctacagtgggcaaggcataaacgaacagtttgtgatctgagtttcaaatgccattttagtatgatgggactccagaggtgggagcaatcacttgagcccttcatggagaagacggtattgaagttgaccttaaaggatggataggatgttgagagacagaagaaaggagttctatatgccaagaataacatgaacccaaagatgagcaggtttcagtgtaaagttttttgaggacataactagtaactgagtatgtttgaagtataagattagtggggaatattggaagataagattagaaaaattgattgtgctcaggtgagatgcaataatgttatattctttgagttacagatatcttcctcattttctctaggtggtttcctctttaaaaaataaacttatcttagtagcttattataaagtgtcattgaaaacaaccaggccgtggatatccacatggatcagaaagctttgctttgcgctgtcattgtagactgcccctgccagcccagctaaagacactcaataagagtggcttaggagaagagccaaaagtcagcaaagcttgatgtgtttttgttcagttaataaaagtgtaaaattattaaacttattctcttctaaaactgagtttggaattttaagttttatcttattgtcaatgtaaaaacaaagtattagagaatgtttaaaccagcctttgccgatactcgccatagagcatttaaagaattattttaagaaaacaccaaggagttcatgaattatgggggaagcttggattaaagtagatactgattcacaaagcagatgttctaagaattgaatttgtttcatttttcataaacatgaaataatattagaaataatttgctttaattattacattagatggtataaaatatgaaacattgattaatggtcactgaacagagcatgttctgtaatctttgaaaaacgctgcctctgcatcagcattgactgagacacacagcaactactgacttccaggcatttgcacgtgtggcatatttcttaaagacgtattaccaaatgtctgggccgggtgcagtggctcacgcctgtaatcccaccacaccacttttggaggccaaggtaggtgaatcacttgaggtcaggagttcaagaccagcctggccaacgtggtgaaatcccatctctactaaaaatataaaatttagctgggcatggtggtgggtgcatgtaatcacagctacataaacaggtcgtgaaattttattatatattgtaattgagaagaaaaatattaactggctttttttgaattttaaggaaacatttctgtttcatgagacttttttttttttctttcctgaaacagagtcttgctctgtcacccaggctggagtgcagtggcatgatctcggctcactacaacctccacctctcaggttcaaccaattctgcctcagcctcccaagtagctggaattacaggcgctcaccaccacaccgggttaatttttgtatttttagtagagatggggtttcaccatgttggccaggctggtcttgaactcctgacctcgtgatctgcccgcctcggcctccgaaagtgctggaattacaggtgtgagccactgagcccagctgagactcatttttagaatactgatttaaacatctagaaatgctttatcatttaccactttaacaagctagtggaaaattaataaagagcaataagtagtcagaattcatgactctttccagttattttttccaatgctatcaaataccaatgctcattctgaacaccattaggcaatacagtgcaaacaagaaggtagaaaatcaccctaaaccttgttatctgtgatatgtgcaggtgacatattgatgaacatccttttagtcattcttccatgaattagtgggagatgacactgttcaggcacttttgtagcctacttgttattcagtattacattgtgagcatctttacaggtcaacagatatttacctagtagtaattgttctaagatggttcctaaaagaggtgctgtcagcccatttcaagaggaatatatatgtattgctttcagttctctataaaaaatgtaaagccaaattgctctagtgtttctacccaagagtaaaaatagttcactcagttgggagatggtataaggagagtctggcagcctctgtggggaatgtatggccacttagccagggaggcggaagtgtgctattctgtgccattccttctttacttggggcagaggacagagctttgttggatgataatgtggttatgaattctgagggttttaattcatcagactttgcttgtttgaagccctcagctggacagtcctgttagacttcagctgtccagtatggcagcagtcagggacgtgaggttagtctgcgttaagatgtgctgtaagtatagaatgtacaccaaatttcaaagacttggtacaaaaaaaacaatgtaaactaattcatttttctttgtatctattaattacatgttgaaatgctaatatttttgctatgtctagttaaacatactaaaattaattgcattaatgtcttgttagctttttttaagtgtggcttatagaaaatgttaatttatatggcccacattatatttctattgtacagtgctatattagaccttaaacagaaggaaagtttcttattacagataagagagatgtacactcatcaaagagtcagaacagtgacatttattttctctctctaaatatacctgacactgtggcctgtcacacatgcccagatatgtatatacacacagacatttctgtacacttacaaggaaaaaataaatgctgcctatgggaaaatggctctgctgggtgttttcccccattgattcttcatagtagtatctgtgtcactatttgtaatgagtgcagttagtacatagtgttatactattggatttaaccagtggtcgtcttaaaaatgcccatgtatgtttagctttcaccatcctaagcaaacttcaatggctttccatttagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtaagcgtgttctttattgtccttacattattgcagaccaatatttttgttttctgaagctctcatggtaagaacatgtggtagaattgataattccctgggcacaaagtagagtttaaggtaacgaataacttatgtgataatgataatttgaatgtgtgtttattcagcagtatatttgttggctgtccgctgttaacgactgtcaagcagtattttagctctggggctaaattagtgaacaaagcatcaaaaatagctgcctatgtggaggttacatcattatatatattatagttgggataaacagactctgaacaaaataaaaaactgtagatgttgcatgttagaggttaatggatgccgtgagcaaaatgaggtagaaagagaaggagggatttctagagtggtgcacaggattaaatagagtggcactgggcttagccaggactcagatttagggtagccaggctgctgtgaagctccctcctcagaaacgtccctctttaagttgtctctcctctgcctcctttcttccccgcttttctcacccacaccacagtttcttctgctcaccacatctcctcagcatggcctgtccacactggtgctatcagcataagcctgtgatgatgtaccacttcaagtgctacatccttctctaggttgagcccacactcttaggatggatcctaacatgaccctctttctagttctcttcagcctcaccaggtatttcaaggcctcttggcctccatctttgggtgtactgcactctgcctcgaagtcctgtctgccatgttgtggccttgcagactcctgtacattctctaagaggcggcttatctgtcagttcctctgatgtctgacaatatcatcaatgtttatgtgtttaatgagctctggagaggacaagaatgatacagcactcatcttatgaattggtggcctccatattcttcccataaaacagtaattcccaacctggctgtaccctagaatcatctgagagttgtttaataaataacaatctctgggacagtcctcagagattctgatttaattggtctgtcatgagacctcagcatcttttttgcttgagttcccctggggtttataacatacagttgggttgaacaccacagccaacagccatcttgtttaacccagcagtgtttgaaagaaaatgtcattcacatgcttttagatatctgctttgtacgtttatattacgccacaaagcccacaccagtctctctgcccaccacataatgagaacacagtgatttttgtggaatgaagccttcatgtaatgcaagcagtttgagtcagactgtttagttcaggtcttcaaaaaagattttaaaatgagtgttagaacacaagacattaacaccagagggtctacaggtgatcgatcatactggtgggcggctaaggtttcagatagtgagtgctacactacttgtttttgtttcttaattttaggtctgaaagctaataacattgactacacagttcattcagtcagaagagctctagaaaacactgcagtgaaggctgacaatatagaagtatttgctcaaggacatggtattattcaggtattgttgcctatatgaaaaatgggttgtaaagcatcattgagataatatcttagatattattgggtaatattttgttttataacagtgattcagtatatctgaattatggattatatggccatagaactacaagcaaaaaggatacacaaacaaattttgtagttaagacaaatctgttgcactaagatcaagaaatgtaatagatggaggccatgtagaggttagaaattcaaagaaatcgaggtcaaaaactggccaatcataacggcatagggattagttcctaaatttggtcacttgagaataacagtgtgaatagagtggagtggaagatgtgactggtgttgtttctaaaaatgtagaattgtcctcttagttggggtactaggtagttttgagaggtgaatatagacactaactttttgttttacaactgaaatcaaattgattggtaatttgcaacaaaatattttttgacccaaccatttatatcttaccatgtatattattttcactaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacaggtcagtaataggctggcagtaagctgacgtattcacatttgctgtttgaatgagtggtatcataataaagaattgctgtttgggccagtgttgtgaagagaatacatgaattgacagtatgattattttaaatcttagtcataagagaaaatattagagcaatttggggtccttgtacaatggcaatttagttagcatcttaaactaccagggaaaacagtagaatgagcctcagtgacccacagctttattaaattgtggataataaaatatcaaatttcttttccactttacctacttaggtataagacagagctttctgttgaagaatgaaaagtagaagcagtctaggagaactgcagctcgattaggtgtgaacaaaaataatcatcgctattatctggctgtcttcatttcagttgaatactatgacctgtgtgcagtaatgaaaacattcacttaaactctttattttaaggtcataccagtgcttggtgaaagtataaatgaatcatgagtaatctaaattgtaaggaagattatttgactgttttatttaagctgtgttttggatgcattttacagccaaccaaaccaagtcgctaaatttttttggaaagatgtaacatttttaaatggaaaaaaggaaaaaaatactcatctttaatttttggtctttttcgtgccagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtattgatgtatcttcatttttactttcttcactctttaaaatgtttaaaaggttaaaaaaaaatccaaagtatatttgcaatatattgctttcttgctaagaaataactagacctatccatctgccaggttattcagttcttctggtgtgtctatattcatttaagcagtgagtttctaaagaatcatattttgtccttgtatgaataagtaaaaggaaagaagaggtacagcagaacctttcaattagatctccctctaactggtgttttcttttgtcagctaaacaaagctgcagttgcttgttgttgttgttgttgttgttgttgttgttgttttaagagacagagtcttgctctgttgcccaggctggagtacagtggtgtgatcgtggttcactgcagccttgaactcttgggctcaagtgatattcacaccttagcctcctgagtagctaggactagtggcgtgcaccaccaagcctggctaaatttttttatttttgtagagacaggatctctctatgttgctcagtcttgtcttgaactcttggcctcaagtgatcctcctgccttggcctcccagggctttgggattacaggtgtgaaccaccacacccagccagttataccttttagtactcagatgaagaaagcatctgttaaacaaatagttgtaaaccaggcatagaatagtatcacaacagtatctccacatctaaagttgtctgtagtactagtttgagctaatttttcagttgggagtaattaaaatgcacttattttgtacctgacgtctcattttcccatttcaactggtcaaatgttgctatacatttgtttgggctgtttgctattaattatgtgacctagtgtcaggaaattggtgtcaacctctggttaagaccttgattaaaagtagattgatttattctgtcagtagtttagaccttccccccctcttttaaacatttgtttatggatattgacacttaccaattcttttttcaaggtatgtggctatgatatagcatcccctaacgcaggtccgctcttcagagttccgatcactgcagttatagcagcaaagtaagtaacaggttactcacagcttactggtacatctaagattttaatgactattcatggagtcttgtggacttttaatgatcactaatacagaaccaggtaatggggattttgtcttagttctgctcccagctagcatttttaggtgtcatgtagtcagccatactgactcttgtgtgctctgagagtaactgatggcacctggcatctgccctacctctgcatcaaaactatttccaccacagtcactctgagctctgcattgcccagttcagaggataactcaggcttcgtctgacccgatcccactgcagtatttgacaatattacttcactcccctccattcctgccctttttgtctctgtcgtttttgggatttactctcttctcttaatgcttccacttttctagttatctactgtagaagcagaagttaagaaactcgtaacttcccatcttattcctctggaaaaatcagcagattatattacttcctgcttaaagtatatcagtggcacctccaaaggtcaagttcaagctccttaaaatagcaaacaatgctccctcacaattatagccctagccagtgtttcctgtcattccgtacaccaaattacacattttggccaactcactgattttggcacttgaggattctcaggatttgtgcatgtgcacagctgataacttggtttcaatttcctgtctcttcagttaatgaccaggtgcattcctggtcatccctgggtgaagggagtcccttctttctgcttcgtggcacattttacgtgcccctggacagactttagccaatatattgtaattttttatttaacttacactctttcactgtgagcccaccgaaggcacagagactactgttatacaggatgtataaaataaattatctagtggatgaaggtgagattgggattgtgagagtactggaaaccaagtggaaattctaaactaacagttctgttactctggtaaatattaagtatgcaatagatctcagcccatgagaaacacaggatgaaattgaggagaataaatttaaaaagtggtatacatgtggaaaaattgtgcaacagttaaattctcagccgtatattccctcgaagtccagtagtaatttagaccaggtaatgtgtaagaccttcaggagtcagctgccacgccatctccttcaggaagcttcccaggctccgtaactcttcttgtctatctggagcatcttatgttaaatgtctctgatgatgattctctccatgctagattgtctaggttaaagaatcatattttcttctttgttacgtttctagctcctaataacggcctcatgtagtaggcactcatttaaccgtttgtcctactgacaagaatttgtctctagcataaaatttgtttccgtggtgggtagttatgcatttgaactttatttcattgatttcttacaaaaatgctttgaaagtagtttgcctttctttactgttttacatcatgggagtgttttgaagctacaggaggagcttaatttaacacaagtctcatagctataataccagtgacataaaactttatcattgattttaatatctaggactcactgtagtttggaatctggtaattggaaaattctgtgaatgttgtagaatgcctttaacaaaaaagagaatgcttttttaatagtgtgtgtgaatgtatcttacaaatcataaaataggcaaaaagtagaatcatctatactctgctattcagaggttatctctgctaacctactgcaaaaattgaacaatatcgtacctactgttttgtaaccagcttctaagtccctgtgtttatttccaatgaattgttattttgcgtttatccaatgaaatctagagtatctgtggtcttataataaatatatacatttaattacttttattaattttcagagtaaatgaatcatcacattatgatctagcctttacagatgtacactttaaacctggtcaaattcgaaggcattttattgaggttcctgagggtgcaacatgggctggtaggtaaaattaaaatctgtgtgaccgcttatctctgtttacgttctaatgactatagctgtatgaggttcgtttatctgtaacatgtatttccctggtactaatatatgtatttgggtaccttagactttctgtaaagttcaaaacgtttttaagatctagtacaattttgcattggcccatacaggaaattaagccatcttaagatgtttttaatatttaaggtttgagcttagtttagaataatgccttacctggtaataattttttttttttttttttttttttttttgagacagagtctcactctgtcgccaggctggagtgcagtggcatgatctcggctcactgcaacctccacctccccagttcaaacgattctccttcctcagcctcccgagtagcttggactagcaggcgtgtgctaccacgccaggctattttttgtatttttagtagacacgaggtttcaccatgttggctaggatggtctcgatctcttgacctcgtgatacactcgcctcgtcctcccaaagtgctgggattacaggcatgagcaactgtgcccggcctaatttttaaaatactacaaatcagtttaaacaatgcagctgttgcttaaacctcaaactgttaaactctcagaattttagaaatagagctttaatctttgaagctctgtttatagaagattttcacttcagtgtctctgaaattttgagagtaaatgattgcctaacacaaagctcttgaattaacatgttatagtcctgtgagagtgctcatgtcattcttttttacaagagctgtgggtgtaccatattttccttcacaagttgtgtgtcctaaatttacaatttagcagtcagtatagaagggtatgtcagttgtcagagctcactcccattgatagaaggaagcaaatacgggcagtcaagaaagtgtcacccaatttaaattagtagccagcattgttgatacttcttggatttggcccctctgctaagcactttacagagattatcttgtctagtcccgtcagaaccctataaggtagataggtgtcattagtaaaaatggcttgtattttacttaggagtgtgttttttgtacttgtatgaaagtacagatatatttacatctgagactttattgaaaatgaaatattgaaatcacacatgtatgacctggtttgggaataactggttgtatttggttccccataccattttctggtcatctatctgtatgctgtccatctgtttgtcacctggtatcacaggaaataccagacttttcttgttttttgtaattaggtaaaggcaaaataatagcaaaagctgagagctaaagcagtgaattgaacagcacccaatatagcctgttaatttgcacactgggttataatggagctattgcagcagtgagaggcttctgaggataatcgggttgtactacactcattcattaagcatatttttctgtaccatctgtgccaggcccttttcagtgggctaaggtggtgagctacttagacaaggaccctgcttccagaggccttaagagcatctagtccaagatattgcagttaagagaactggattagggggaggcagcacagagtagcggcaaggccacgggctttggaaattgagaagtctgggtttggatccacactctgccatacactaatggttacctgggggcaggtttctaaattttctggacttctgtttcaactgtaaatatagttgttagtctgttgtaaggattagggattttatagtacttggtacatagcttgtcttcgttgggattacgctcacacttgacagtacttctagagggtggagtcagagttgctgtgttcagcattcctggggtcccattctcatagggcccctgggacttgtagagctccaggctctggtaaaatgtgcactggtaaattaaagaatacaaatctatggttaattaatactgaattgggtacttgtttagtgataaatggcactgatttatgattggtttaggttggtattgaaaataatttgtttttttaaataaaaattatcaaatgatctagaatgcaagtagttaagagaatttaacagtcttagttttatttcaaataattagaaatattgtcataacactagattttgtgttcttagcaactgactaggttctgagagctctctgcacacctggttttatgagccacggcattgcgccttgcttcagttcccttgaattagcttgggtgttctttagaaaagctgccaatctggcattgcggtgatcttggcttacctccagcgctggctcagagtaaagttaagcataagtagtcgtgccaggctttgtagacgcacacagtacacaagtagaccaagaagagagattaggaaaagttatcaatgaggaattgaggcatgataacaaatagaggtttccaaaaatataaccttccttactttatctggaattgactggttttcagctaaaacaaggagggattttaaaaggtacccgattaatgtaattgtgtatgcatctatggacagcttgctgtttccaggtgtttgcagcctcatggtggtggttcattttaataccagtttctttcgttcccatagaaaatcttctagtcttctacctttattaatattttgttgattctttgtttttatggaaatatgcagatttgagtgtacattttatttttgatccctattatgtccctacatgggaattattccctaagtgggcattattaaagccactttatgtcaattttaggtcttataagtttaaagctttgcttctttcttttattttagaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctagtaagtttaattatagtttataatcctaacacaatttatttgcctttttggtatgggctaagactaagtatttgcatttgattttatagtttgtatttagcatgttgggattatatatttttttaatgccaaaaaaatgaagtagaaaaatagaaaatctaatcagggtacttgaaatcaagttggaggtaattatggctgtaattcttgaatagcatagtcaaagaaacatactagtctggtagattctcgtgccttgtagttaggaccctgatttagattattctttgttgtactatagattaatttctttaagacctgtttgcttgtcacttaacttattttactaatgctgtgttgttaagctatgaggctaatttgcattataggaaaactgctactgcttcatgtctaagttatctcagatgatggcagactgcattcttatctgtggtgttggaaatgatgactagtctttcttccatagaaggtgaaagtactgatgttcttccttcagtgcgctcctttgtgttttcagttggttctgggattttcccagtatctcttggtttctggttactttcatttgtgttcttccatggatcagtgttgcttcatctttttaaacttttaaatcactgattactagaaaacttactttaaaactcagtgctaagagcaggtgtttttttttccttttccttatctttattttttaatagggagaaagatgtaaatgaccataatgtcattttgttttggttgccaggtagctgtgagcccaaactcaattgtgcctattgagtatgccttacaaagttgaagtatctttattgtgtcgttatacttgattatttttcttttggtcctaattttttatttcgcttcgaaataataaaatcacatttgctttattatatgtgctttcagaagctgcctaggatcttttatgacaagaagcatagggttatgagtaaataactatgtatatttaaatacaccatatctctgcaaatgatttgtctaactcttacttagcatagctgttaaaatttttgagttttcttgctacaaacaggaaaagtttgaaaacatagaattgctctgaaacagctagtatttatattctgtaatttgagaaaaataagaaaagagatatattttatttacttttatttgcagggtggaaaagcaattgaattttgcattgctcgttggtgggcaagtctcagtgatgtcaacattgattataccatttctttccatgggatagtgtgtactgctcctcagttaaacattgtaagttccacaacattttcatgatttttaatgtcagttacttgtgttactggagagtaacttcattggttagatttaaactttaatgaggggaaattacctgtggttctgaagatagcagtaggctttgtgtgtgggtacttataaactttatattggacacatttattttaggtacaaaatattgcttatttttagtaaagtttgagaaagtaatttgagaaatcctttgtagcatgcatcggaaggaatcaaccgctttgatgttcagtcctccttgaaatacgaagatctggctccctgcataactttgaagaactgggtccaaacactgcggtatcattcaatgttttaggaactacagatattgaatatagattggggggatctcttacactcttaaaaaagggcctttttttttttaatccacctgcatgctagaggtgagaattttatccttgccagcagatctctgcaaggcagccccagtatcagcttctagcttcactgtcccacctgaccagcaaagtcaaggatggtggatagccgatcccagtcatgactagttaggatcaatggacattaacctttttatttcttgctgtaaaatagcaagttaacattctctctgatattattttgtgaatcctaatgcagtcatttttagaaactgcaataccattagaaactgtttattaaatggtagaaacttaagtactgtagcctgctgtttgtgcctcagcagctccccttacaaaagcagggcaccttgacctgtgttcacatactcactgtgttataaagatacctggtttcttttgtttaatctgaccttaactcatcggcatgaagcctagtcttaagtgtattaaaataaccaattagggacaatagtcagtgacacggtgatgtctaaagatatactgcttcctagaattatcaataaaaattaaaacatccagcttttgaagatatatccaacttatatcatcctgatgttttcttcctaaatctaaaaaattggagctaaatttagagtagattatgtttcactgacattttaaactatatttaaaacttactcttcagtgtcagttttctcctttataaaatctgtacattagcaacttccttcagaggactactaaaaatatgaaataacattccctcggccaggaggagggctgagtgtggcccctgccatctggtgagcagcaggggtctggggaggtctgtgctgcacacaacacagtactgtcaacagtttgcacaaggggtacaaatcagaacctgtcttgcaacacttttagtcaccctagtgttaggatttggttgtattgagagctgtttgttcacatttgaaaatgtttttgccatgaaaagattgcctttgtcatatttattgcaaaatctaaactgtatgtattgatatgattcaatcaaataattatgtaagttagtgattaaaatattgtagagtatactgaaaaggatagctctcaggaaggttcatctgcactttttgcaatatgttacagattttgttgcatatggttttatttgtctcattcaatgaactcttgaatcaaaccagttatgtagtttcctcattacagcccagtgagtgcaaaaacaaaacctttaggatcaagagatgttttgccaaataaccgtcaactttatgagatggtcctgacatataactttcatcaagtaagtgtttgcctagtaaagtgtacccttaggatgaacttttgtgttttatttatgattcatagaatcaaaaatggaaggacagtgtatatggtatatataaaaaacagaatcaagtgattaacagttaatttggaattactctttaggaaattataatttgtaattaaataccattcagttgtaaagtcacaaaatgtaattgagtggtgacctagccttaagccttagtttataaaatcactgatcactgtccattggtgccatctgacccaggggtgattagatggctcagaaataccatctgccttctggtgatggtgctgggcctgattgctttctgcgaagaaggcactggaacagggaaaggtcagagtagctcccaggtgggatgggtggcaaaagtaatggaggccagtgtaaatgctggaccaaagaattgttgtaagatcaatgagatttcaataaaactgttactgaaacacacatcaatttggttataatgttagggaaatggattggtttcagtgaattttcacatttcagttttataaagtaattagaggtcctgaagtatgtatatgttgctttattaatgaatacacatagccaggtgtgtatttttaaaagtttgtaagagagcagtgacttttataagtgctaaaatactgtgtgttctatattttcaaaattttttaccacaagtatttttaatgttttttaaatgaaaaagtctcatgtcaataacaatattaaaaatttgtatcagaaattatatgcaaatcatgccaagtaatcttttttgttttttaatagcccaagagtggggaagtaactccaagctgcccactactttgtgaactattatatgaatctgaatttgacagccaactgtggattatttttgaccagaacaaaagacagatgggttcaggcgatgcctatccacatcaggtataaaattgatggtgatttttagaattaacggaagctgtttcctgaactaacaaaatcctggtttcttgttatggtaatgttcatactttaaaaaaaacaaaaattatagctttgtgtttagtacttttgcaaactgtgagagcctgtttgttgtagtcggtgaagaacagatggtgtcaactatttcaccatgtagttgtgctgaattagagggggacaagggtgaaccttgcccacactggccagcataacttttggtgtgtggtgtttctccttcctatacactgattctacctatctgaaggtagaatcatcaaagcatgcatcaaagagatgcgagcctcttgaaatgatcctaagtctgagggggctaaagagagcactgcagcagtggccgcatgtcttcagttcatttgtacttttaaatttactacctcgttggacaactctgtaatgagcacttactacataccaggcactatgctttgtgctgttttattgaagggaaaaatcacataatttatagacattttatcccttagatattactgcaaagaaatgagatatttcctgtaatatgtataattttatgttgacaaatgaaaataatttatggagatttttttcaattagttgttaaaggaatggtatcgattttcctcaaagcaagtagcagtcacatctcattacagactggcctactgcagtgctattactttggttactttttaaatctcagaaaaagtggctgacacaggatacagcatctcttcctcttgaacctgttaagtggataatagatttgtatcccttgatctctattggtttcctgtttttttcctgtctgtaataaaggagtgacattttggttgtaatttgaagatcaactgggcatggtggcacatgcctgtgatcccgtctactcaggaagctgaggtgggaggatcgcttgagccctggagctctaggctatggtgcactatgattgcaccagttaacagccactgcacttcagcctgggcaacatagtgagtccccctctctaaaaggaaataaggattaccagtagtcataagttacacgtgtgtgtgtgtgtgtgtgtgtgtgtgtgtgtgtgtgtgtgtatttgtcctagatattctatggtgcctcaattttgctcatttttttggtagtgtttcttatatgtctctgagggacccatgaactagaaaatcactgcttttgtcattctcaagcagacactgagttttgctaaaagtgtgggagtattctgtcgttctggaaagaatgagggctttgaagtcagacctgactccagctctcttatactttactctgtgtgatgttaggcaagtcacttgatgtccctgatcctgtctgctcaccagcgtactagggactttatgtgttatatgaacgtctggatagttagtgccttgcactgtacctcacatattatgaacaagtctgtgaatggtaactttcactttatcctctttcagtgatttccgttgacttggttaaacttaacttttcccaaatgttgtttttctttttcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataagtaagtgataacattgcttatacttactgcccatcttatacactgtagtccttttaatgtcagtttatgacatctaggctaaatttagaggatgtagtcattttttttttggctgaagttatttcttcctttgatttttgaagtcttagctatgggaatgaattcagtgtggaattgttttcatgtttttccccttacttgtctttgtgaaactttctcttttgttgctttttttctctttgaattctcttgtttagaatacctaaaggggcaggacctggatgctatcttgcaggatccttaacattgtcaaagactgaactaggaaagaaagctgtaagtattagttttttaaacactgaaattacctattaaaaaatttcatttctttaaagataagaattaattccacatttcagaatggataaaagagaagatatactcttggggaaaaaaatttaatccttttttcccaggttactagtgaaagtcagttaatatttagttgtcttttaaaatgtatcctacttttgaaatatttaggcttctttttcacaagcctacagtactcaggccctgaacctgtcttacctcctacggctaatacacttgaacttcctgtgaaacatgtaaatacaaatcaaacttggcttaaatacatgtgatatttaagattagaacatgttatagaaatttaaccaataagattggttgtccatataagattatggacataggaataaatcagattatcttggggtgcttttaaaaagtagtcagaacaattaccctaaaacatgtttcttcacacttctacagacctatctcattggaatttcacatggttaagtaggaaaatatgagatgtttcttttggtattgccttttaatttcaaaatgatgctttttttagaaatatgtttctggttgttgtactttagacatatatgttacagttttataagtacctacctgtttttgttttttccttctatgttttcattacaaatttattatgagaatgatgtttatatagatctatcaccttttgtcataataatcattttagctcaatgccagtaaaagttgtcattcttaacagttttgcatttctctgtactattacttcttacagagctaagtaagcctgctacataaatgctgttatcaaaatgagtagttctcatacatcttaagaattatatttattttttgccactattgaaccaaaggccatttatttactgtcattgaagcataattggggaaacttgtgcttagaaagttgcctaccctgacatttcttgggtctcatttcagtttatactgtttatacatacgtactttagtataatttgaagtaaatcaatagttaatggtttgtaattaatacatgcactgatttaagaaaccctggtagttttttttgtagatttcatttcacaggaagcatagctgcttcagctattgggcgtcagctgtgaattttcgttcagatgacagatgacactttgaagagtctgcttacttgtgaagagtataacagaaaagcattattagtaaaagtgggcttttagcaattcagaaatagttactacttcccagttacattgttttaggagacaattgtgaaattaaattataaatatgtggtgttaactatggtagctatttatcaagggagaccttcctgggagaaagcagtaacttaaagctgttgagttcattataacttccatcacattgtttatgtaatcttttctcagtggtttagcgttttcttgttttttggtagttgggaaggtaactttcacttcactttgactttcacagtaactttgttgctttttataagaatgcataggcaatggggttgttgtggtaccctttaatcagactagaccatcaactaaatttactattttaagaaatgcttttataagtaatagattttgatctactaaatttttcaataagaagttgacatgtactcttagtaataacatatttgagtactttttcttatgtaaggaatgaaagtggcaatgttgctttctttaaaagcatgccatcttaatcacagacctgagccttctaagtggtgtaacacaggtggaacataaactgaaagacaattagacagaggttctgtctccatcctgtgtagattatgcatgttttcttacagaatgtcgttctaactcccaggggcagtctgcagcaaaacgacaaggaaaatttaaaaaggtactgattgtcagttcttaaaaaagatgtcttaaagccttatttgcatattaaacttttttctgtcactattataaaccttttttttaataagtctcccttagtttcctttctttgcattctaaagtatagtgctcttagctgtacttagaagcattgttgacatactgcttttctaaaggttttttttttttccccaccataaattcctggatgactcattttctctgtgtatacaaaaattttaatgctattcatttcttgctacagatatgataacaagtagcaatatttgaaatttttcatatttacaattttatagagagatggatgtgataatttttttttttttagccatataagctaaagcacttatttttaaagtctaaaagcacttttaaattgggtgatttgattaataaaatgttgcagctttttaaagcgaactttattccctgctcttgtatccattctggttctgaaagaagagaaacaataaagatcaatggatgtagcaggaacagcaaataaggactgttcactgacaattaaagcttatgctaagaacacagattttaagcccatcgctactaagtggtctgatcagcctctctgcagcatattaagcaatctttgatttactgctggggccagatttaactcagaaaagaaaatgtctgctataaatatattttagggccaggcgcagtgactcatgcctgtaatcccggcactttgggagggcaagttgggcagatcccttgagctcagcggtttgaaaccagcctgggcagcatggtgaaaccctgtctctacaaaaaaatgcaaaaattagccaggcgtggtagcacacacttatagtcccagctactctattggaggctgaggtggaaagatcgcttgagcctgggaggtggaggctgcagtaagctgagatcacaccactgcactccagtctgggtgacagagtgagaccctgtctcaaaacaaaacatacatacatacatatatatatatataaaagggaccacatatttaataagctttctggtgaagacgtgctacgtcattcaacattttcatgatttctttttaaacagaaagaattacagtgggaaaatcagtaatgtcctaatgtatacttgttaattagtagtgatatggaactggggaatcaccattctataacagcttaaattcctttattaaaatgtcttctgaaatgtccatattattacataatagtaaataatttgtccaaacaaaatacagatactaggaatcatctttctggagaaagatctaaagatcagtatttctcaactgggtgtcttgaccgtttgggggccacgtaatgggataaaaacagcattttttaaaaataggaaatgtcagttcatcagactcataaaattgtaatttcattttatgtattaatgtgtatatctttgggacattgtaaaaatagtttgcaagttactgctttagagaacaaggaataggtattctaggaatctattaaaaatagaaggcacttatcacgaaggccatagccaattatttttcttcttatttttgttgaccttttgcaagtttgggtagattttgtttgaattaggttgtatagttaggaaaacactgaatgaataggaaggcatttacttggtgattagtaaagcttcatttgaagaacttggcagctagagttatctctgctcgttcctttctgtcttcaatgcaagtacacaataaagctcttattttagaaataattagtattacagttttatagtcacattacaaagaaaaaaatacatgtataatttccggttgtttaagataaatagcattttgtatataattcttaatagattttttcctctgggtttcagtgacttgatttgaaaaggtatgtcaccctttttaaaattccttgtaaaatgcaataatatattttttgtttgtttgtatgtttttttaagagacagtctcactcaacactccaggctagagtacagtggcatgatcgtagctcactgttgcctccagctcctgggctcaagtgatcctcccacctcagcctccctagagtggctgggactacaggcgtgtgccactatgcctggctaatttttactttttatagagagaggtcttactacgtatgttgcccaaggtggtctaaaactcccggcctcggacgatcctcctggctcagcctcccaaaatgctgaaattacagacatgagccactgcacccagcctgaatattgtcacttttaacagatcataaatagcattcaaatatgatataaattttaaaaatagtttatgtgaagcttttaaatttttgagtattcagttactaacaattttaagaactaaagaaattgccattttgaaccacaatttaacttatagtgcgttgtgttgcccaaagagtagttattggtttggcaggtgagtttgactttctgaataacactgttcagtttgaacactgttgaaatacttcatgaatagctggaatgccttttttctaaacttaacattaaatatatactgtagagaaatcttcatagcatttctgctctgaagattcttcttgactgtctttttaaaccataatcaagatttctcaagaataaaggtacaaaattatttctattaaattggtactatgttaaccccttgagaattgtcataaaaatattaatatttattggcacaaagaagaaattattgtgatacagcaagtgaaaatagcgccatttttcttttgattagaaattaaaactaccaggtttataatttttactaataaaaaattccctgtcctgaaacatcttgtaggattacactaacatttataattgttaatttgatatatttaatatgtaaaatgctgattacaaaaccttgatttttgtttcactaagataattcatcataaactttctttgtctctttttttgcttttaatgatagtctaaggttactaggatatcttttttcccacttttgataggtctttgttagaattaattgtaaatcctaaattaattttaatagattgttcattttaaattcaattctcttttctcttctgtactaaaacaatagcaaatacctctgagtctgaggaggaagtgcctcacaacacataggctgcctgcctaagagcagcatacctctctccctgatatggtgaggaggtgtgggaagctcagggagaaagactggagaccactcttctagcacactgggtggcagagaagctcaattccatggagaatggagctatattaacagaaagtaaatattggaggccacttagcccctttaattcctagatgtgttgtctttgctgtacagatgacactgatgcagtctgtttccataagaacttggtggtagaagatcagctcagattttgtgcttaccttggctttgctcagggcagtgcctacccagagagtgaacctcaagaaggagaggagcaggacaggcagctgggtcctgaaagagctagcccaagcagtagacctgtttccttttcccagtctcatgtttcacgtaaggcctttgtttacaggttctggccccctgacctcagagggagaatgacagccagtggctacaaatggatttatatggttatctgacatcaaagtggttttctgtgctttaaatgagtcagtatggagataggattattattttgtgttggaatactattagaactacaaccatagttcctgttgtttactgttacatcattttataccccgaaattgtgttggtgaaaatatttaaaatgggaatatttgtgtcgtatatgctcctaaaaatcctatttgcgggaggtgaggacttgcagtattatttttttactcaaccagagtaaagctttttcagtgaatgtctttttgggaacatttgtttcagttttacaaactttgttaattaaaatgaatatagtattttaatttagcaccattttaaatgcaaacctgaagatagaatttgaggaactgacttaataaataacgacttaattaaggacacccagttactgtgccaaaaacaaatctagcaggtatagcatgtgatttcatttcccaaataatgctttacctttcacaagtcaagacttatctgtgaataaaataaatacagttactctccatttctctgctgctgtcttcaaagcaaaacttctcaaaagaatcacagacatgttgacttccattctcttttcatctctgtctcctccagcctggactgctccactgtcccctgacactgttcttgtccgggggggtcagtaggctctgtgctgccaggttttcagttccttccttcttcgtcgtacactgcctctcagctaaatgggcagttgatcattttctctttcttcttggtggtttttcctcaaggcttccgtgatcccaggtgctttttgctttccttttctcactcacagagctgctttttccattcaccatccctaactgaccttattcatccacatatttttcaacattgtcagcaacacattggttctacctttaaagaagatctcaaatctattcattttctcccatttctgcgacccatttttagtctaaggcagtgtagggtttcctaggtttgtttcctaacttgttgtcttcttgcctccacctttaccctctataatctattttccaaatagaatacaaaccaaaattttaatccatacaggaaccagagtcattaaacaaaaagcagaaatctttaatcatgtcactgtcttttgtaaaactcttctggtatgcttcttagtgcacttggaatacaatatatagtattttttcttttcttttttaaaccatattctgtcaagccctacttaagttggctgctgcctgctttctcagaagatacagctgtgcttgctttatacccagctcaggtctttacacttgctcatctgctccttgttcattgagggtcgtttgcgtaagatattacctcttcagagtggctttctataaccactttgtgtccatcggctccccctcgttacctgacagtcattctatccttttctgttttgttttcttcctatcagatgtcagcatctggtctgttctttacctattctagcattacctggcacatcgcggggactcagtaagtcctgttggttggactcagtaagtcctgttggttgaatgaaggcataagcgtccccttaaatttacttagagaatcttttcttagtttgaacttatttcatccccttctcagatttaaaatgtgaaaggtcagtgtacttttgtcatctgtctgccaagtaaagccaagaataccaaatatactcaaatggagaaaagtatgttcttatctcttttattttaaaggagatatttgaagtatcagtactcagcatcagtttgtgagaaaattgctgtgaccagagattggaatttttggtgtattgtgacccttagaatctagaatacagtgtagtacaacttaggtgcagcccatgttacatgacatgtagctgttgaagatgattttgatgtatgtaaaattaagcatattaatctaagaatctctctccacattcgtaggatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagtaggtttttaaatgtattttaattctttaaatgtttagttctattttcccaactataacaatattgtgtatatatacatagaccgtatttaaaattattaacagcagttggtaggattataggtgcttttaaattttcctctttttatataaatgtgtaatttatttaaattataaatatataattttgtgattaaatgttttaatttttattttaatcactctaatttgttcttggaagataattttattggaaagtataaaaaagaaaaatcacttttgcccacaattcataaatagtcattgtcctcttattattatttttttcctctgtgtttgtacatgtagcagtgtgaataaaattagtttccatttttcagttacttttttattatgatttaacagccgtataaaatactatttttaatgtctgtgttgtatatggttctatggatgcaacataatctatttaaacgttttattttgcatatatatgtttatagcttttcttcatgatgctgcgataaacatttttatacataaaggtgattttttaaaatttccatcatattgcatcttaaaagtaaaaatcgtcttgctatgttttgccaaattgctttctgagatgagtataataatttacactccatctagctgtgtatgtgtgctactacacaatgcaaaaaccagccattactgctgtcttaaattacgtctctagttattattaaaggagagctttttagatgttatcattcgttattagtatagcttctgacagttgagcatattcttcacctttttttctattcagacattaggtgtttctggtcgattaaaactttttacataaaagatattaatgcttttctgtacttgccacagattttactctagtgtactctttgactttgggcttgctttttacttgaaatttattttatgtagtcaagtcagttgctttttccatctgttatgcaatatttcttttactgctgatattctatgggaatcctcttcagctgattatgtatgcatccttgcagttatatggttttagagggaatagaagtcatcatgatgtgaaaatatttcccagagattgaaccattgtaatgtcagttcacttgcaaatatacctttcccacttaaaactaaattgtatctccactggaagtcaaagtcttcaggtctgtctctgcctgattttaggatgtcataaacagttgacaatataatataaattcttcaaaagtaaaattgcagagattgtcttctggcatgacagcctgaggagacccatgatgctggtccccagtaaaactagtgaaaattatttaaaaacaaaacaaaacaactttttaaagcctctggaaatggtccaaaggacatagagcaaatgaagaagcatctattcaaaaatacctacaagaattggataagaaaagcaagagtctgtgatatttgaaccaagaccactgcctccctttcctctcccagttaatgagccagaaattttacttcagatcttgccttcaagagctccagctcctgggggagggaaggctttcctccttggaggaggaggacgtcatcatttctcatcctgacctactgccagttgcagcggctcagttccagctgagtgctctcaagaggtgggggctctcttgtaaagtactgttgggaacactggggccccaatgcccaggaggctgtggttccataccacacgaggcaagctgagaagaccacaggagagtgctaagctccttaagtgggggtgtcactcaaagaaaaacatgccattcttccactccctgttccagagcttgggcttagtgattttgccagtgtggcctaaggagttcataaaactgatagctcctaatttcttgctgaaggaattgacttcatttgcaacagaagatggagaagtccgtgtgccttaagggctctctcaaaaacagtggagaaaaaaggaatgaaaaaaatgaacagagcagagcctcagagaaatgtgggacaccattagtgcaccaaagtccatggaacaggagtaccaggagaacagagagaaagcaaaaatatattcagtgaaataatggctggaaacaccccatatttattgaaagacattaacctacatatccagggaactcaatgaactcaaagtaaatgcaaagaaatccacaaatagacacagcatgttaaaaatactgaaagtcaaagataaggagaagatcttgagaggagcaagacaaaaactcctcatcacttacaaggaaatgctagtaaggttaacaactgacttctgagcagaaacattagaggtcagaaagcagtgggataatatattcagagtgctcaaaaatctcaaccaataatcctatatccagcaaaactgtcctttaaaaatgaaaatgaaataattcccaggtaaacaaaaacagagaatttgttgctagcaaacccaccttataagaagtactaaaagaagttattcagcctgaaagcaggtgatctctggcagtaatttgaatccacattggtgagagtggggaaagaaacactggtaaagttaattattatggaattataaaagacagcataaagttctcatttttttcctgttaactaatttaaaaagcagttctgtaaatattgtgtatatattaggcctatgtaatatttaaatgtaatattctgtaatatgtatttgcttatagcacaaaggagcaaaactgtattgggctaaaaaaatgactgcagatagtaattattataacagttaattaatggtgtattacagtaatagatacaacagatagaatactactacagaaggaaggagaggggaatagagctataaagggataacatttctgtatctcactgaaattaagctaggaaaaatctgaagctgattcttataagttaagatgtatatggtaagccttagagcaaccactaaaaaaaaactaaaaatgaacttgaaaaaaatcattaaataaatttaaatgttcatttaaaaatattcacttaatacaaaagaaagctgtataggaggaacagtggaacaaaaaaacaggatacatcaaaaacaaaaaataaaatcgaagacctaagtccaaatatatcaataatttaaagtttacaggaaattaagagaatcccatttacagtaacattgaaaaaaataaaatgtgtaggaacatgtttaacaaaagagatgtaagaattatacgtcaaaactacaaaacaattgttgaaagaaatttaaaagacctgagtaaatggaaaaggtattctttgtctgtggaccagaagacttaatatcattacactattcttcatattgatcgaatgattcagttgaatccccatcaggatccttttatagaaattaacaagctgattctaaaagtcatatgtgattccctgagactcagaatagccagacagtcttgaaaatgaagagcaaagtagggctcacacttcctgattccaaaacttaaatagaaagcaacagtaaacaagacagtgttatactggcacaagggtaagacatatatagatcagtggaatagaattaagagtccagaaataaaaccatgtgactatggtcagctaatttttagttttggcaagggtgctgatgcaaagaccatttaatgaggaaaggatagtatttgcagcaaagggtgctgggactggatagccatatagaaaaagaatgaagttggacccttgcctcacatcatatatacaagttaactcaaaatgtatcaaagagctgaaactacaaaactcaatgagacgtagtggtaaactttcatgaccttacatttggcaaaagatttttaaagataccaaaagcataagtaacataagaaaaaaaatagataatttggacttaatcaagattaaaagcttttgtgcttttagcatagcatcaagaaagtgaaaagaacggcctatttgcaagttacatatttttaaggagcttgtatgcaaaatatataaagaacgctaaccttttttttttttttttttttgagacagggtctctctctgtcacccaggctggactgcagtggcacgatcatagctcactgcagccttgaacccctgggctcaagggatcttcccacttcagcctcccaagtagctaggactacaagtgcacgccaccacccccagcttatttttttaagggatgggatctcactatgttgcccaggctagtctggaacccccggcctcaattaatcctcctgcttcagcttcccatagtgttgggattacaggcatgagccacctccacacccagcccccagaatatataaataattcctacaatttcataatacaaaggcaaatggctcaattttttaaatgggtgagtaatctgaatagatatttctataaagatgtacaaatgaccagtaagtgcatgaaaaaatgctcaaaatcgttagtcttcagggaaatgcacatcaaaatcacaatgaaatacaacttcacacttactaggatgactggaatcataaagtcagatgatgagttttggcaagtatgtggacaaagcagaatcctcagacactgatggtaagaatacaaaaatgatgcagactttttggaaaacaatcttgactgctcttcaaatgattaaacttagtttccatatggcccagcagttccactcccaggtatatacccaagaaaaataaaaacctgtattcacacaaaaacatgttgatgacagtttatagcagcattattcataatggccaaaaggtggaatgtccatcagctgatgaatggacaaacaaaatgtggtgtatccatacagcggattccttttcagccatgaatgggattaatacatgctccaacatgaatgcaccttgaaaatagtatgttaagtggtagtagccagtcacaaaaagaccatgtattatatgattctattcatattaaatgtccagaatgaggaaatctatagagacagaaagtagattagtggttgcttagtgctggggaggctggggagatctgatagcaaaagggtatggcggtttctttttgtattgatgaaaaatgttttaaagttgactgttgtgatagttacatatatctgttactatgctagaaagcattgaaattcacacttaaaatgggaaaattgtatggagaaaaaattgaaaaggttgtttacctaataggtgttttagaagaaaacagcaaaaaattattagcattccctagcaaaactttaaaaaccttagaacattttttggaaaaaaaaatttataattaaggttcagtagttttaaaatgtaaaacgaaagtgttgattttgcccttggataattgttagcgaaaagagaaaaacaggacttaattttttttgtactaagaattagtgtaaattttgttgtctacaagttaaatttattttcatagaaagttagttatagtatcaaaatcccggtcaaccttatttttatactactgtgcagttttgttaatatattaagtgactttaatgtaagttacccacttctggtgctagtttgtatgttaatttgtttttatcctgatacatataatcaggtagaattgggaattttattcagcctccgcatcggggaacatagaataactctttattgactcaagactggaattttcagaaaagtttaaatttttattttttctagaattttcagaaaagtttaatagatctgagacatttttaaatcttttaatctttctagctatttgtgaatatgcttttcttccttttaaataaatataatagctggtatgtaagaaagctattgatgcatatttttatttggatatcttattgaactcttaattggaataattttcagtttgatttatttatttatttatttatttattttttaattaattaattaatttattttttgagatggagtctcactctgtcacccggctggagtgcagtggtttgatctcggctcactgcaacctccgcctcccaggttcaagtgattctcctgcctcagcctcccgagtatctgggactacaggcatgtgccaccacccccagctaatttttgtagttttagtagagacggggtttcaccatgttggccaggatggtcttgatctcttgcccttgtgatccgcctgccttggcctcccaaagtgctgggattacaggggtgagccaccatgcccagcccagtttgatttatttttgttttctagttaatcatttatactacttgccaataatgataatccttgtcaatgactatacttatatttcaaattaatgtcttattttattggcttaaacttccaaacaatgttaaataatagagaagacaaatactctttttaaaagaaaaaagtaaatatttctctccttcttacatacataggctggattctagtgacatttataacgaattgaaagaaacatatcctaattatcttcctctgtacgttgcacgacttcatcaattggatgctgaaaaggttagacatgttcattctaatatatcttattttgtttgtaattatataagtttgtgttttgaggaaaagtgcattatctttctcttctgttcttgctaactaaaacatgttttctcaaattgaatgttgtgttaagctgttttcatgaaggttattataagacctagccactactgtgagtttagtttaggattcttgctcatgcttggtcaatgagattagtaatagagaagataccttaacgattgttttcatgaccttaacctaaagggcaaggggcagaacgtagtaatcctggccagatggaaatctgaacgccttcactgaaagaattcctactttgcattaactttgttaatgattctcatttgtgagagttggccatagttctagtctgtcatgacatggaccagttctcattattcatcaaagcagtgggaaagtgctgtcctaatcagttgaaaatcatcaagggtttagagtgaaccagagggtatttaaaggagatttcttaaaagactttaacaagagagaagcaaattgttgggaacatcatggtaatcacagttagactgttgattataatgtttactctcatctttgtgtttttcatgatggatcagaaagaaatggtttcatcagctagggctttctttttttttcctgtgttcaggtagtgtgcaactagagtaatgacaatagccaatcacatttctagaatcttaagaaatacagaaaaggagttacctttgttaaaaaaaaaactttacatttttatgaagtttatattttgcttactctcaccattgtactccagcagggaatgtaaataaggtatttttattatacatctgagctcaagttttatagagataccagcaattagaaaaatcacagtaggagatagcagagagcccctgggctacaagtcaattacatagtttactcacactgcagttgtaggtctcatggttgagacagcagaagtgaaattgctttcgtatactgattgatatacctattttttattatttcttttttcctctccaggaacgaatgaaaagacttaatgaaattgttgatgcggcaaatgctgttatttctcatatagatcaaacagccctagcagtttatattgcaatgaagactgatcccaggcctgatgcagctactataaaaaagtacctaaccagtaaataatctttcttgcatctcatttcctagttaacttgtttaaaaagtagggactaatattatagaggatattgcttttctgatgtttgttatatccttataatgggaattatcactatttggatactcccctccttagaaattttaaaataattttgtccaatctttttaagagtaagcccaagaaaagtagtttgccttctctactgttaagtgctgtcaaggtagagggatttgaatatctgtgatcaagcagtccaaccacttgagggtttatgtgaattggaccatatcaggaagacaaaaattaacaatctataaaataatttttaaaatgtttattgtccagtaacatgaaaaacctaatatttggtttgtaataattacatgacaaacctaatacgtggtttgtagtgaaataaatgataataaaattaggttaaaactatctggcaacttttatgaaactggttttatagtattagggagaataagaggagagaatttatagttttgcctttataaaacctaatgctgtgtgtaaatagagaagcttccctgggtttatgagtggttggtatggttccttccatgcaagtgtgatttccgtatgttggtgtaattaatggtccagtgactctgaaccaagctgccatttggtcactttcacccttccatgaactcttaaaccatcacctcatggtagctctcccagtgtcagttacttgtttatcacttttgtttatttttgacttacaggatcattaactaggtagaaatatcctgattcttttgtggttattataactaataaaccaaaactattcaggctgcctgaaaatactaaattttccttaaaaattttctcagtttcagtcagtatttttttctacataaaatacttggattccaaactgctagaattctttccattatatcatttatattgatactataggatcttatgaatcttacaagcaataattttcaagtgggatagaatatatttaaaattgcttctttggccactattattaccttttcatatttttcaaaagaatagtctcaaaacattgccattttgttgttgttgttaataataacagaaaatacagccaccatttattaagtgccgattatgtataagggactattgagggcattttaaatacattgttttatttaaatttagtcttccaaacaacatggaaggcaggggcctttgtatcccccttttaaggaagagaaaactgaagttcagagagtttagatgacttggcccaggtgccactgctaggaagttggaaagcacatagtcaaatcaggatctgcctccacagccaatgccctttcttttctctgtatattcttctcccttcttgagaaggttaacataactcagtattatctcacagaaaaaggagcatcgtctgcctcccacccatcctcattgtgttcctttctgtctcagggtgatcattgttaatcttattgcaagaggaggctggccttggtcactttaaaactgtcttccacagatcaccagtgataaccagttgctaaaaagaatggcccattttgagtcttctttgagctctctgcagcccccgacattaactatcccatatactttctagcttttgttattttttacattttgtgaaaataatatgattttctcaaactcgggtgttacatgaaataacacatatggttttctcagttttaccatccacagaggaaactcaatctcagcttacagtgagccataaactaatacgatattagttttgttttcttattggtctttttttatcactgtttttaatctctttttttttttttttttttttttttttagtttctactctttggagattactagacattgactatcatggttattgaaataagctgggataaaactagaaaagaagccataaaactttgtaaaaacgctaagagtggagctgctttaagtttttagcgacactgggtcaacttgtttatccttgtaattaaagaatttctatttctctccaggcctttgctttggcctgactgaaatagactctgaccaggttgtgtttggacagaagacagtattcagagttgaaatattatacaagatgctatcaggaaatacttagcatttcttacagatgtcatctatgggcaagtagcagccaacttaagcattaatttctcatttccatgcaaaattgctttctcttaaatcactaacatcaaaaattgtaaaatgccattttctaatcttaaaagtgatattaacttttagttaatatcatgttttagttaaatttaaactgcacttatttaggcattaaaatactgattccaattaagttgcttcctaaaatgtagctattatcttgatggatacctaactagatttgatttcaaggtccttattgagcaaatacttcatgtaaggcatcactgacaaggacttaaaacatgagcaagatagtctctactcttaggaaacttatcatctaatatagaagatgaaattgccagataggaaattattaagagataatgaaatacaagtatttttaaataaatatttcaaattgtaaaagcctgtagaaagaaaagctgactttcacctgagtggaaaaagcctcatgtactataaaggtattcagtctcagccagtcagtacaaaacctaaggagaggaaaggaatactccagatatgtagaatttagattacgtgataagaggatgctaaaatagaaagggatcttacagctaatttaacccaggtctgacaaatgcagattacctgtgtcacccccaggttgccttctgatttctgcatcattccagcccttctctgggcagccaggatccatcaggcagcatttgccgagtctgccctgcagactctggccgagcgacggatgaaaggagtgctcagacacaggtatccagtgaaagagtgggctaggggactgccagcactaagggccaaagagagttagcagtccccctgagccagcgacgctcacatttatttagtagagatttaatgacaaaggcttggagcaaacacaatttgtgggtaataaacattgtcgacccccaagtagagagcagtcctgcacatgaatgatcaaaggttggtttttggagacaggagtagacaaatttatctagcgcaaatgatcaaaggttggtttttggagacaggagtaaacaaatttatctagataagttcctttacattcccttgttatctgccttttgctccctggctccagataagagaatttggctgccttcagccagatcctctttcaaagcttttgcaaaacctcccagccttccaagaaggtttgcatctttccctctaacttttacctaccaccctgaccaatctcctacatctccccattttctgtttttttgcatcaggttttgttgattgaagagtacagatgtgtgcagcaactggtttgtctggcgtagtggttactgcttgtattccagctttgcatcctagaattagtaaataacataagacaaaatgagtataatcagtaacattcttttccaatcaaggagtgacatgtagtgtttcttggcacctcagtccaatgtgtgctgttactaaggaaccccactgagggtatgttacccccttccagccaagcagttactttattggaggctgggaaggtggtgtctgcccaggtaacagggcagaagaaaggcaaatctaaatgatgatcccaatagcgtgtagcaggtatgggttgcaggcagagtgagagaataagaagggttaatacccaaaagagttgcagtgtacaacggaaagcatagcaaggaacaaattatctggagtgaatggtgtctatgtccagagcaggattcattcagccttctgagttttcttcagcatctcccaggtaatgtctggggtttgtgtcgtctgaagaagctgcatcatccagggctatgggttccacagggtcattttcttcatttctggtaccgggttgggtcctagccacgctatggtatggtttgatgcctcgtgctggaatccaaagaggacctgagggggtgtgaacacaagcatgtcttcttcccagtgttaacaattcagttgaaccgcaccatacattactgtttatatctttccataaaactgcaggtttatgtcttgagaggttttagcaaaatgctcttctatagctgattgaaatttatcgtttagattttaaaaagtaagggtaaataaggcttctgccagtagtgttgcagggtccttactcatattcacttttttgttgttttctgagcatatttttaagggtggattggacacgttctactgtggcctgtccttgggggttgtgagggatgcctatggattgttggatgttccacatgtgacaaaattgctgaaattttgagctggcataagctggaccaatatcagttttaatttttgtgggccgctccataaatgcaaaagttaaaagaagatgtttaataacatattgagcagactttccaggaagagcatgtatgctaattaggtgagaattggtatcaacggatgcatgtacatatcctagttttccaaatttagggatgtgtgtaacatctgtttgccataactgattaggttctagttctctagggttaacacctgttgaaggaggggacatgcctgtgagctggcaatttgggcattgcaggataatttgtttagtctttgggtaagttgaaatcgtttagataaatttctccaattttggtggaaacattgatgcgaatgggtggcttggtcaagcagtgatgtcataacctgcaggtctgcttgatcattgccataagctagggggccaggcagtgagctgtgggcccaaatgtatgtaataaaaataggatgtgtacattgatccaccgattgctgaaatcaaagaaaaactgcacacagggtgggcttgagagtggacttaataagggctgtttcaaggttctgcaataaataaacagagtaagcagagtcactaaccatattgattggctgagcaggaaaggtctctagggccagtattaaggctccaacctcagctttcttgagtgttagtaaatccagaacaagtgagggaattgtgcagtctccaccaaataactacttttccatttttaccagagccgtcaataaaaagcattaaagaattaggtattgtgggtggggggggtgtggcggtgaaccacttttgtaggcataactacaggagtactagataataactgaagtagtttatcggcaggaagggcatgttctatatggcctgtgtaatcagagagtgctatttgcaggtctagagataaaggcaagactgctttgaattgctttttacttaaaggacttccgatgacatcatggtcataacctagaaactgattgcatcatctgcggcctaaatagatgattttactaactagctgggtacagggagatagagttttagttctggtatgtgagcaaaaaactcattttaggaagcatagccctggggacatctgtcctattaatcctgttggggaatgcttagtaggaaaaacaaacaattgaactgaatattgaatatcgtgggtctgtgcaatcctgttgcctctgaaaaatagcatgctctatttcctcaatttccctttttgctgcaggagttaaatacctgggagagtctagggctgtattgccctttaggatagaaacaggttttgtaatgtatcagttatgcccaaggtggggtgaagccagttaatatctcctagtaatttctgataatcatttaatgtgtgtaagttgctagtatttaactttttaaggtcttactgaccggtaagttagaatgtatccaagatatttctaaggagaagacaattgtactttttcaggtgctatgattaaacctcttaactgtgtattctttacgacagaggcatatagacttacaagtcctggctccgttggagctgctagtaaaatatcatccataaaatgaataatcttgcaattaggaaagtcttttctaatggggagcaaagcctgatttacatgatactgacacagtattccttgagggagtactttccaatgaaattggcgagctggcctttattgataactggtattttaaacacaaatttttctctgtcctgttctgcaaggggaatagtataaaagcagtcatttaagtcaataagactataggtcaaactacaggaattgccgctggggaagggaggccctgttgtaggggcctcataggttgcaaattagcattgatagcccataagtcatgcaaaagtctccatttgccagactttttgggaatgaggaaaatgggcaaattccaagggctgtttgacagttgtatatggctggcttttaattgttcctcagctaattcatgggctctttgtaatttctctccctttaaaggtcactgttctacctaaataagattttgagagagcctcatcaggggtaggggagaaataacagtggccattattagaaagagatctgcagagtgacctcaaccctcttgtaaatgggctagcggctccgttttctttaatgcttttccttatctctttataagcgttaaaagtaacgggttcatacacctgattgtgttgtcaattttgcgttaccaggcaggccaagagctccccttctaatgccgcttgcctaagacagggtcccatagctgtagcatattccttgtcttttctccaatttattggaggacggggctcaggcaaaacctccgtttcctctttgttatctttgcccggtaacagcggggctgagggagaagggggaggaaccatgggttatgggaaacaacagtttgcattaggtcccttaattgagcctgcgaaaccgagcctccactagctttaagcagctgtttcattacttttatatactgttgctgttgagctgataactgttgtcccatgatgaaaccctagcctgaacaattccctcgaacttggaaatcccaagcgggcaccagtgacttactgactgcgcagtctcttcaccttcattttcgagggttccattgtgatccattgcagcgttcctctcatggggcaccacctgccaagtctgtccctcagactatggccgagtgacagatgaaaggaaaggagtactcagacacaggtatccagtgaaacagcaggctagggactgccggcactaggggccgaagagagttagcagtccccctaagccagtgatgctcgcatttatttagtacagatttaatgacaaaagcttggagcaaacacaatttgtgggtaacaaacattgtcgaccccccaaatagaaagcagtcctgcttgtgaatgatcagaagttgggttttggggacaggaggaaaccaatttatctagataagtttctttacattccattgttatctgccgtttgctctcaggctccggataagagaatttgactgccttcagccaaatcctctttcgaagcttttgcaaaacctcgcggccttccaagaaggtttgcatctttccctctaacttttacccaccaccctgaccaatctacaagtatcagcctgggtgtggaaacctgccttgtcaacccattgctgttccaagcccctttctccttcacaaaatcaggatagtagttgtgcccgacaccttggattgttggaaggcataagcaaaggactgctgagaagacatttaaggatggcacctggcatctaagaggagggggaaggagggtggatcaggcaatggcaagccatgcagatgccccacagcttggaagtcccaaaagtctacttgtaaatccttttcttcttaattccagtgtaaacaagcagtacccagaaacatctctacaaaaaggcagtgaaagttggttcttcaagctttgaggcactgtgctgagaagcactgagggatcttttaggcatagtttcatttacgttgcaaatgtattgggattggtaattgccctctttgatgaactctgccagtgtgaaggaatttctctactacccacattgcctccctgcccactttcaaggtacaggatcaaatgggctttgaacctctgagaataccccggtcttgggcaatgtttcagcagcggcattttctatggtacttagcgttcatgttccctgccatgcggcctcttagattaacaggactccttggtgcgcaggattaatgtgggtgagcccttgagccttcaagttgttgggttgatggctgtctttcctactgcggatccttgttgatggtacagtcccggcagttttcacatgctacacatttcactctgagtctttcagagtcactcttagctgttagtttgttccacagctaagtgcctcaatcatcatcattttctcagtacttttagtcctcattgttttcacgtgtatctgacataagttggacagaatgcctcaaataagcacacattctagagactaacacttttccctggagtgtaggtggtggttgtatttcattcagcaatgatttattgagtttccattctgtgccgggcattgtcctaggcacatggaatgcattgaagaaaacaaagatgtctgccctggatcaaggcaatgtgccgtagtgattaagagcacagattacagatttatactgctaagcttagaatcctggatctgccacttcctaactggcggaccttgaacaaattgcatagtctctttgggccacagtttcttcctttgcaacatggcagtaattaatagtctcttactcagaattgttttgaatgtgaatgaattaacatgttaaaatgctgagacagttgctggcacattcagagtaaagcattacatttatttgtcctagtcatgaactgaaagttttaagacataacctctgggtatacacatagacaaatgtgtaatgattactatttataagaaaactgaaaactcaaaagtcatttacctgattaagagttatatagctaaaaaaatttagaatagtgattaacctttcaactctgttgcttctggcattccgtttcaaccaggtgcagctaccctaactcatttaatctatatgtgtaatatagtagctcatttgatgtttattaataaggcatcatatttgatgtacaatacaattgtacgtacctggatatacagtatttctgcattataaatcttaggcaaaagaatacatgaatttaaattcagataagaatttacttttaaagacattttactgatatctgaaatattttttaatttgctgtacagtgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggtaacgtttctgcttcttgtttcagcaaagttcttggggttacctcacagacctctcttgtgccccattgctggttaaaagaggaagaagataaatggaaagaatctacactgggctctgaatatgacatgtttagcctagtacttcatgtttgtctcacctttttttaaaaaacattattttatggtactgcaaactggctgttaaaccacaataattttaaaaacagtttgagaatatgtgtagtaggcttttagttaaaccagttatgtatgtagctaaattaagaaagtcttctagaaaatgccttcaggcccacccttctctagttatatgctaatttgttggtggtaggagattgggggcaggttgaggagacatactggttagttgttacttattttcctcaaaactcttgaatttctaagtaattatcatcttgatttgtagctaatcagttttaaaacccaattcataaaagcatcgttgatgaacttttttggattttggttacaaaaacattttaaatctcttttagctctctactataattcttgcaatagcgtttatacaagttattaatcttcttttcctgtggaaataaaataaagtaaatggagtcagtaggattcccctcgcgtatcacagaccatcattttgttttagtagacaggtgcttgttctcagaattaactggtaatttgcagtaaagaaccctggaagtgggaagaaaattcttatatggttcagatttttccaacacagtacagtggtgcatttaaagaaggtactcagttactcagttatatttgggaaactgaaggagccagtattgcagcagaggtcaggaatttgaatctgaaattagagcccttgagtttggctcctgcctctaccacttttatgtatgaccttaggcaacttacaaaattttgataccttagtttcttatctacacgacctgccttaggctgtgatgaatgagtattaagtacatgcaaagtccccaacaatatttgctgttattgcaaacaattattgaaggcctatgtgccagacactacttactactggaaacataaagatgaataagaacctgctttctgtctttgaggaatgtaacagagattgacaaacacttgatgaacatataatgaaattgttatagatcattctatttttgcaatactactactatattaggggctatgcattctattacctgtttactgtgtttactgtgtccatggcaacaattgttaaatactttagttgcctttacaatacaaatcagtgtcaggattttctttgagtacattctccacattccaaagtagagaccaaaaatatatataaatgattataagtatatttgacagatgcagtaattacaggtaaaaacttgtaccaaagaaaccatgtttatataatctaatacttgtttttttacttctatcctcatttgcaattttggcattttttatttctatcctgatttgcatctttgtaattatttatgttagctctggtttcttgtgcatgaagaggtatttttaagtggatttccacggctaataatttctcatattagttttcttcccaaaaaacagatggttcattctgtggaatactcagctcttttgaagacaccaactttctttttcaaagtttttaaaaatgtactctatgtaccatattcatttcaaaagctacacttctgttaaagccttaattttattgttaaagctaatgccttaaaatgtaaattattttataaaaaagctttatcatgttttacattgtaggttttgacatttgcatataaacatgcattagtaaataaaatgtatgggagaggccttaaatttgcaactaaacttgtggaagaaaaaccaacaaaagaaaactggaaaaattgtattcaagtaagtgatatttaaaatgtcactgttaagcatcactttgatattgcatagtgacaagataactagaaaggattaggactgtgatatagcaatactggttttattgtgaccagttattacagtaattagcgtaatatgaactatagaataaatatatgagagacagtcaataagctatttaaattttaaaaacacttttcactgctatccaaaaaactgatactagcctcaaatgttttcaacaagggcaaatgcattttgaattttgtaaccgtagaagccagtttttctttatgaaggaaacaaatccttttaaaggcatgttgcctcaactctaaaatggttcaacttctggagtttatatttgattttattcttcatttgagatggtaggcatttttaaaattatcttaccatatacaatattatgtgcagagaaattttatagttgaggtttctgcacaagttagttgtcaagtaaaaaaatttagctgatttctacagaagttactttagtctgacctcgtctttgaacatgcttaattggtttatgcctaaaggatacgtgaaggcaggggagtttggtggtgccagattcagctaaagggcaagtccaggttaattatactttatatgtaaggtaccctttggatgtaaaactgatcagtaggttcctctgaaaatgtttgataattagagtaagctatattcatatttactcttagagctttttgtttaccttcaccagtcagtccaaattgtaagacattttaaattagctcctccagatctttgactagattaagagaactctttctggagccaggtgttgatatgtctaatgtggttctcatcatgtggaatctgatccgtgagcacttaggtttgtaaagccagtgatccctgccgacgttcacatcagggagtgtttcttaacttgtctgccctccactctgcccccccgctgcctgttctccacacagcagctggaaaagatgccttttgacacctgctgatgaatctccatcacatttggaataaaatccaaactctccccagtggtccataaggcccctgcctacctctccagacttatttcatatcacacttgcccatacaaactctgcttctgccacaccagcatctctgcttagcacaaacagccacaccttttcctaccaaaggaccttagcactaactactctggctggatggaatgtctttcccagattttcgcacagatttcttgtcattcaaactcaactggagtatcacctccatagagatcctttcttaaccatctaactccccagttagtttatattgtgtcaaatattatttctactgtacacctgataaatatcttattacttgtttattcatttattaatttgcttattatttgcttttcctgaaagtgggaggtgaatttgttcagtgctgttttcccagtgtttgacatgatagttactcagaaaaaatgaatgaaaggaacttaggttggtaggaaggaaaggaacaagtaagttggaaggaagaagggaggaacacaggttaataggaaagagggaaaaggacagttggtagggataatgatgagaacaataggttggttggtaggaaagttggttgatagtaagaaaagttggttggtgggaaggaggatcaatgggtgggtgacggttggtggaaggaaggttctatatgctactaccttactgttactatttaatacagaatttattctaaatactgagcttaaaaatctgtcacttcctttataataatatattattgtattttgttgtagctgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaattttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaagttggtcttaatttttcataaataaaatttggggttataacagaaataatacattaaatacatagacaaaaaaagttaaacataagataatctattttacagtgtttcttataggcttacaattatttgaatgtatttccagttcttgtatgattaacttttgtgcatatctaactttttattatttttatctttggctactgcacgtgcatctctcgtcattcctccaccaaataaacagacaaaagtagtattgaaaagtttacagtcccttatctaatggcaaattgtgtgtatgtatgatttttttatcttgttctcttaagatttactgctgcttaaaattactaccagtaatccttagtcactcccaactgtttctgctgtatctcatgaagtgttagagcatttatgagaaacataaatacatgtataagcatattggtcacaccttctgggccagctagagtccaaagtctatccatgaaagctacatgcatgttctctctcacacactcatggactttcacctgcacacacatacaggtccccatttgtataggtttagtccagtaagagaatggagaagctcagtaaaggtaggatgacttcccaaggttatacggctgatcaactgttggaaattaattacagaccttgctttacaacccaggttttgctatttcaggtaagtactacctacagcaggaatcagtaacgtttggccctttaacccaaactggactgctgcctgtttttgtaaataaagttttattggaacagagccatgcctattcatttgtgactcctgtaactggaggcagttatacaaagctgccatgttagctcctgtttcctgtctggttcattctgcatttctgtggtgacaagtggacccaagtaagctctagaagatgttctcagtaaaatcattactgtttctatgtgattacattaaaaataatacaaacagtaggatggtacttcaaaaagtcaagcagttttcctgtttctggtcacagtagccaatgtttgcacacccactgaaaacaattgaaaaaactaggtaaaaataactttttaaagaaccattagagacagtacagggtatgtgctcaatactggttctgtggcccctttccaataataagaggcagttctcaattgttactgggaggagttttgccatctcatgggatttctttccttcctcatgttagcatgctttctgggagaacttctctttaccccagaagagccccacctgcttctcttcttaggcaccacaaatctcaaaccctttctccctccacccccagctctaatgaaatgtgcagggactggatgactggaagccccagcctgggtctctgctgtctaatcctggctcaagtactgacaagtcaaatcacttgacccccatgaatctccttaagaaaatcgtggtgttgaatcagtgtgtctattccaactaaaaaaattatttcatttgaattaactgagtctttgcctccactgtgtttcgttctccgtcctcccaacaacccagcattcagaatacatgtgtctttgtctttccctttaggatctaagtcagagaagccttcatagggagatagataatagggattcttgctatctcccctaaaggggaaggggaggaaaccttgaatggagagaattttttgaggaataaagaagtgagaaactgaatttcaagagtctcagtctgaacatagcaaaccaaggggtgaagaatttatcagtagtcatgggtggtaaactgaaaaagggaagctgactaagtaaaatcccggaaaccagaagaggaagatgtaagtgacgctctaacatgaagggtttttgggcatcccaatcagcagaatttctacctgccttctgataccctgagacagccaggtcaggatgtgatggtgcagtacctgctagcactttgctgcagaatgcctctgcactcagttctgcaaatgtactgtt

SEQ ID NO: 15609 - DNA, 21920 bp, Human
  misc_feature (1)...(21920): n = A,T,C or G
cacttgccccgagtgtcaggtctggggacgcggttccggagaggggagaggggcccgggaatgcggcgggaggggcctcgaggggcagcgggccgggccgggccggggcggaggtggcgggccccggcggggcgggccctcgcgggcggcggtgagagctcccgcacagtcggctgcgagctctgggagcaggaggcgcggtgcgcatcccatcccgggacggagccgggcgccgtgcgatcctcgggagggttcgcggggcgcatgggcggggtcggggccagcggaccatgccgcgccacccgcccccgcccccgccccgccgcgcccgggctccggcgcccgcggagctgagactgagcgcgccagccctccggggccgaggctctgggacagacaccgcgagggaggcggccggcgcgggctctcgtcgcgggcgcagcgccccttcccctcggtaagtggcgagcggcgggcgaggggcaccaacttcgccgccaacttggggctgggttcccgcggcgcgcgagcaaggacggcggagacagaggcgggacacccggggggttggacccacgcaggactctcggggctcaaggagggggcggctggaggacccggaccctcaagaacctggccttgggttttgacccgggcggccggagagaaggcgaagaagaggccgagcagacaggcgcgcggcggacgcgagagaaggacgcgggcgaagcgtccaagacgttcgtccccagggtcgccgagccctcctcctccttcgcttggcgcggcagcaccgcgggaccaggggagtctgggctgccgcggacccaaactgttgctgctggaagccgccggggcggagagcggggaacagggccgggagtgggggccggggctgggatccaccagagcgaggggttggaaaggagtcgagaaggtgaaagggggctgtgcggctccccagcccagtgccccagtttccctaggtctgctgggcacctgctgcgcactcgcctcggcgcccagaccccttcccccgccgcgagtcccgcttcttccccttccagctctgccccatctcctttgccccagcctagctctctccttcctgcgacctgggagaatcggagtgggcttccagagtagtggcatcttgcagatgctggcccgtgcccggctcccgggcttccagagcgcaaagggaagggtaggcagagagggcactgggcgagcaagacctggcgctgggccctggctgcgcaccagccgcctgcgccggtctctgggggcttcgcccaggatccccgacggcggggaggggaagccccgagtctcctgtttcctgcctacgcgggcagggcggggacacgcggagcaaaggcacccggcaacctgaacccccaggtgcgtcccgcgaccctgcaaggagctgctgggtgagcaagacgggaattcccgccaggccctgatgcccaccccattcgtccactcggtttcccagccctggtcgtccaaggggacttctggctcggtcccccagccctcggatggtggcgttatcttagttcagtccctgaccccgggccacaggaaaatcgaggaaagacacttatttggggagggtaccattccgctggctgtatttcagagcccgtccaggtcttggcggtgctagtgactttgagcctgtttctaaactcccgaagaataagagcgtgccaggggcaggtaggcaggtccgggacacctgggttcgcccagggcccccgggcgggcctgggatggtactggggccgcctgccaggctggcttggtccccccactgcgggactcggggtcacgacccagcttgggggagtgggggtgggggccccggagccgcggacgccggcggggggcagcgtggggcggggggccccgggtgcgtggtgctcagcttggccgccaggaggcgtggcgcgggtccccgcccggagccgccgccgccgccgccgccgccgcatcgcgagtgtccttgagccgcgggtgacggtggctctcgctgctcgcgccccctcctcccgcggggggagcctgatgccacgttccctatgaattatttatcgccggcctaaaaataccccgaacttcacagcccgagtgtaagagattgctgcggaggggagggggcggggcgtcccggtggccagggggagtccgggcggggtccgcggagacgggggccgtagccttggaggagcaagaactccgtgcccccagcagtggggcaagctagaacggcggtcctctcccctggcgcctgggttcgggttttggctgggcaaaagggagggagggaaacccgacggcaaaggaggggcggctcaccggaagggcagggggtccgggggttctgctggtgggtggggaggactcctgcgacagagtttcctagcctgggagagggagagccatcggtatctcagatgtgagcgggtatgagtgcgggagtgtgcatgtgtgtgcaggtccgtgccagggggtctggctgagctgtgaggacccgggaaggagaaggcccccagcctgggaaggtgctcagacccttctagatgctgctgtgtcctgcaggactgaccactgccatcctctctggggctctttggggatctctgtgtttgtcaaacattagtttaagggctgtttgtggaaggggtgagaccctgagtgggtgggtgggcagaggtctctgagacaatgtgtctgccctcaaggagcccgcagtccagtgtggggcagggtgttaatgagtgcacacacacctgccgcagggcagaatggaggggtggaggggaccactacacagagctccccacccaggaggggaagccagggcagggggaagaagggcaggtgccccagcctggccgcagtccctgcgcctagagcctgaggcatcaaggcaggtgcctgtgggagagggatttcagctgggccctgaaggagagtagacttctgttgggatgaggacattccagcctggggaatgctggaacgaggcctggagatgagggcagaatggggctgtttggccagcagactggcagagctgtgggttccagggatgggaggacggttggttgcggtcagggtgcagagggctctgtctatgggactaagctgtctggacttcatttgtgggcaccagggtgtagctgtcctgtgtgaggagggagcagtggctggaggaaggcttcagcagtgcagtggggctggcgggggtgggtaggtgggaggtggggagggggaggcaagggaggagattgtggcgggggaaagtggagtttgtccctcctacctctgtagggtggctgggttagacggggtgatgagacagaattcggaagctccttgagtctgccccttgctatttggagcccagggacttacctagttttggcccctggctctggaggtattctgggatccctcccccattttaggccccttgattagaggtacaacctgcctcaaatcccccaccccccgacccccaacccccaacccagcaggacaccttccctttggagagagtctctggtgtccccagcccatgaggatgtcttcctattggagagagtgggaatgagaacattttcagctattaccagacccttattccttcatgtgaatgagctctaggtccttggctaagaaaaggtcttgactggggagggtggaagcttgaggggagtagggagttggaaagagaaatacatttagaaaaaggaggttggagatgctaatggcagactgcttattctgcccctttgcagttgagggagagcctgggcccttcatccagggtcacactgtccaaagaaataaaatgggagccacaagtacaatttaaaattttctagtaaccacattaaaacaaatagaaacaggtgacgttaattttaatagtatattttctttgactaaacataccccaaatgttattatttcaacatgtaatcaagatacaagtgtttacgagattttttacattctttttccctgttgtcttcaatgtgcagtgtggcatgaaattttacactgatagcaaactccgtttgggtgagagatgtttctggtacccaatagtcgtgtatgactggcggctcctatactgggcagcacagatctagagctcattactgggaggcaggggtagtaggaggtttggggctccccagagggcaaggaacctctaggacctggaggtgtgggcagaggtgagcagacagaggccgtgcaaggggagcgacaagcatgtcagtgtcctttgtggttgagatctgacatccctgattggtggtggcagctgaggcatggcatggcatggctaggatcgatcccttgccagactcaaacatgtctctgggctgtcagttctgtcacttctgtcacttctgtgtcactgtactagggaaccgtacacatgggaagatttcaagggcgccaccatgagagcaatattcccttccttgccaaaactcttgtcttcttggcctgaaattctaccacctggcactttagcttaaggctctgactgtggttaaactacatctctcttgggaatgagaaccctttcagctatgatcagtccctcataccttcctgtgaatgagctctagatgcttagctaagagaagatcttgacggggaggctggggagtttgagggaagtagggagagaaggttggaaagagaaatatatttagaaaaaaggaggttggaggtgctaacagcagcatgctcattctgcagatttgactctaagttcctggagggcagggaccatgtctcacccatagggacattccaccatccagcgcctgctgcagggaaggggctcagcacacacgggccaattgatgtttctacactaaagttggtttagtgggttccctggagggatcctttcagtgccaccctggggagaagaggaactttcctgaatgttcctggtagcctcttgcacttccccgctctctggattccttagagagaactagagatacaagaaggcccatatgtctgtaagacattaggctttggattaaaaaaaaagagagagatagctgggtgtggtggctgacgcctgtaatcccagcactttgggaggccgaggtgggcagatcatgaggtcaggagatcgagaccatcctggctaacacggtgaaaccctatctgtactaaaaaatacaaaaaattagccgggcatggtggtgggcgcctgtagtcccagctacttgggaggccgaggcaggaggatggcatgaacccgggaggtggagcttgcagtgagccgagatcgcaccactgcactccagtctgggtgacagagcaagactctgtctcaaaaaaaaaaaaaaaaagagagagagagaaatttggtggcaggcaaaaggaaggccctgtgagaaagctggagcctgcccagcagttgtctcgggccccatccctgaagggcatctgtctttcggaggcgtggtttctggcaactgcttgattttcgtgagcatttctgtagcagagatgtgcagatcctgggggaggcgggagggctggagtggcaggctcaccctgtccaccctttagctcttccctgctcagaagttttgctggggatgtgatgaagatgggagagatggcagtgccatggccgatggccagctgggagggagagtgacatccgtgggcaccactccactcaggctttgtgttaccctcactgctgtggctcttggtcccaatccaaaataatgacatttagcaaggatacgtgtcaggcccctgggttgggttcaaaagatcctgcatgccagtgatggcccgagaggccagctcaccagctcatgtgtaacaagaccaaaccccagctcaccagcttgggttttccggtacccctgagctctgaacaagtcagtgctgttgcaccctgctgcggaagagctgctactagctgaggccacagaaggaagggctgtagtgacgtccagtgcccaggaggagggggctctgtgccaggcagaaccatgcagaggagggcccttggggctggccccatggcaagcagggcacactgaccagtagcacaggccctggtgagagacagatggaagatccggtttagactatgaggaggactggccggtgggggtgggggttgggggtgatgcaagagctgtcttccttcacctggctgggggcctgtcacctgcgggatgaggtcactaatcccagcaaatagcctgttagctcatctaagtcctcacactgctgtgattatttcaggcaagaaaacatggctcagagaggctaagtgacttccctaagatcacacagccagttagtggcagaactgggacacgaactcagatctgtctgactcaaatccatgcacttgaaccccagactagcattttcagtatgacttcctagggcagaacccactggctgagttttggaaggcatcagtagactggagggctgggtcccggtcatggctcctgttcttccccagcccttgctcttctgggatgcccttgggatgctcaactaacctctatctctttctctttgtccgtgtctgtctgtctccctctctctctgcctctcttcggggagggaggttttcccctcttctctttcatcttccgtatgtgtgtccctctgtccctcctgtctgtccatctgcctctctccaaacctctgtctctctccctgtgcttgttctggtctctccgcaggaccctccggtggacatgggtggggccctggggccggccctgttgctcacctcgctcttcggtgcctgggcagggctgggtccggggcagggcgagcagggcatgacggtggctgtggtgtttagcagctcagggccgccccaggcccagttccgtgcccgcctcaccccccagagcttcctggacctacccctggagatccagccgctcacagttggggtcaacaccaccaaccccagcagcctcctcacccagatctgcggcctcctgggtgctgcccacgtccacggcattgtctttgaggacaacgtggacaccgaggcggtggcccagatccttgacttcatctcctcccagacccatgtgcccatcctcagcatcagcggaggctctgctgtggtcctcacccccaaggtgcatgtccaaactcatgtcccctcgtgcctcaggcctggaaccaggctggggtcgggggtgctttggttctgggaagctgggattagacgggatgggcagggaggtgggggctgagggcatgatgtgggtgatggggagatggttatgggaatgacatcccatgttctagaggagagatattctgggctgacctcacattgtgtctggatgaggggtgggcagggtgcaggcccaccctctggctgtggggctcaggccccagccctcctcctctctgcttccctcagcttcctaggtcagggtgaagacccagagggccagccgggcatggaggtggtgccatgccctctgggcagtggtagttgacctgtagggtgagcaccagggaaccctgggagccctgggggaggcagaaacggccctgcccttgcagggctcaggggagaacgttccaaacacacattcatcagcagttacaactaggacaagcgttctgaaggaaagacacaggatgctgtgagggagctcactcatggctcatgcatagggtgttggccagggaaagtctctggagaaatgatgtctaggctgagggcctaagggcgagccggtggggagggggagaggcccaggcagagaagcaggtgggatgaaggtcccaaggcgaggaaggagctcagagctttggaggaatagagggaaaagcctggagaaggaggcgggggcctggccacctgggaagacatttgggcttttccctaagcaagtgagcagacagggcagcgcaagccggctgtgacagtggccgtggtctgtgcctgccttagccctgtgagcttcctggccctgcccctgttgatctagccactcagggaagagcggaggagagttgagggaagagactgatctgattcgcctttgtttcattaatttttatatgaagaattttgagtatacattaaaaagtataaggaagactcatatatcccccattcgccctggccatccaccccagcctcaccagcacccccttccccttcttctgtgttaatttgaatcaaagcccaggcatcctcttattccatccataaatatttcagtatgtatccctggcagataagggcttaagaacgtaaaaccaccatacattatcacgtctaaaaaataataaaaactccttcaaatatccaggcagtgttcaaatttccccattgtttcataactgtcataagtgtttattttgcagcctgtttgctcgaattaagagccaaatcgggtccacacgtgccggttggttggtgtggcttctgagtttctctcaacctctgggcccctcctctgtctgtctctcttttttccttgcaatttgtttattgaagaaactgcgttgcttggcctctgaattttcccttatttgcttttttaaaagattgggacagtggcagcagtgagaccagttacgaggggactgcggtggccccggtgccagccggcagtgccttgggtttttgtggtggcagaggggtggagaggaggagctttcccaccctcagggcttcaaccagggtggcgtttccccgtcctcttggggccccggcataagatctcaggacattggctctcaaccctcatcgtgctcttaggaaatacggacgcctggctttgcacctctggaattcagattcagttggtctggggcagcgcttctcagtctagcgggctcaaggatcggctgaagagcttgtgagaatacagatgccaggcggcatacccagcgactccgatccagtcggtgtggggtgcgacctgagaatctgcatttctgacaaactccccagtggtgctgatgctgcgggtctgcgggccagcgtggtgggctgggggccgggcatgaccatgctactaggcagcggggaaccacattggggcgggagggaggcgcaggccagagggctcccggaatgcggagcatccgccggcgcaagggcgcctgggagctgatggaggggccgaggtcggggaaggggcgggaggaggggnnnnnnnnnnnnnnnnnnnnnnnnnnnnnnnnnnnnnnnnnnnnnnnnnnnnnnnnnnnnnnnnnnnnnncggctcaggccccgcccccgcccccaggagccgggctccgccttcctgcagctgggcgtgtccctggagcagcagctgcaggtgctgttcaaggtgctggaagagtacgactggagcgccttcgccgtcatcaccagcctgcacccgggccacgcgctcttcctggagggcgtgcgcgccgtcgccgacgccagccacgtgagttggcggctgctggacgtggtcacgctggagctgggcccgggagggccgcgcgcgcgcacgcagcgcctgctgcgccagctcgacgcgcccgtgtttgtggcctactgctcgcgcgaggaggccgaggtgctcttcgccgaggcggcgcaggccggtctggtggggcccggccacgtgtggctggtgcccaacctggcgctgggcagcaccgatgcgccccccgccaccttccccgtgggcctcatcagcgtcgtcaccgagagctggcgcctcagcctgcgccagaaggtgcgcgacggcgtggccattctggccctgggcgcccacagctactggcgccagcatggaaccctgccagccccggccggggactgccgtgttcaccctgggcccgtcagccctgcccgggaggccttctacaggtgggcacctgcccggggcataggggtagggaggtggggagcgcttcgggggagctggctggcagtgagtttgggctggccagccacacctcccactagctgcgtgcctggggccacattaccccacctgtctgggccttagtgtcctcatctgaacaaacagcaggtgtcagggtgtggcaaggatcgtggggccaatatagggaagcactttgaacaataaacacaatcaatgccacctgctgtcggtggcggcggtgaggcagaggcagggggtgcctggtccttggcagggctgcaggcatctctcccctctggcaggcacctactgaatgtcacctgggagggccgagacttctccttcagccctggtgggtacctggtccagcccaccatggtggtgatcgccctcaaccggcaccgcctctgggagatggtgagaagggggtgagcccaggggccctcagtgtcctcttattttgtccccgcctcctcttgtgcccacagctgagcagagagtccctctgtcccttatccaacccctcatcttccaggtctcagctgaaacaaacatctcctccactgggaagcctccaggtgccccggggtgggtgaggtgccctgctctgggctcccataacaccccggcttccctctactatagaacatttcaagcgctcctatctcctggtcctgcccctgcaggagtaacccatgaccatgctggccagacaggcttgtaaacaatatgcagggacaagtgcttgagtagacgtgtgcaaaagattgtgggattggagatgaggaacaggaattagttctgccttcaaaggaggaaactgggaaagaggtcccagaagatgggatatttgagctgggctgtggaggtttgagtaggagcccaccaggaagaggtgctagcctggaagagacagaggggcagaagggtttggagcatgaagggccttgagtgctcagctaaggacgttctgtcaaagtcaggggggaccagtacagtgagtgagacagggtcaggtctgggctttaggaagatgctgtgggtcagtgtggagctgtatgaacacagggacccgaggctgggggaggctgttgggagcagccctactctgacctgccccagcatccctaggtgagagagggagattcttggccctggcaggctccacctagagggtgggggctgtagggctggaggccccaggctgaggctgtcaccctccacaggtggggcgctgggagcatggcgtcctatacatgaagtaccccgtgtggcctcgctacagtgcctctctgcagcctgtggtggacagtcggcacctgacggtggccacgctggaagagcggccctttgtcatcgtggagagccctgaccctggcacaggaggctgtgtccccaacaccgtgccctgccgcaggcagagcaaccacaccttcaggtctgtggagggccctgggaggctagtgtgagctgggtgctgccgtgtgatggtcaggtgtcgtgtatgtcccatgcttgggtgtggggcaggggtccacgtgccaggctggaggagtggctggggcggggctgggccacgacatactctgactcccggtggtctcatggcggcatggctgcagcagcggggacgtggccccctacaccaagctctgctgtaagggattctgcatcgacatcctcaagaagctggccagagtggtcaaattctcctacgacctgtacctggtgaccaacggcaagcatggcaagcgggtgcgcggcgtatggaacggcatgattggggaggtaggccccaccccactccctcctcacctgccctgcctgcccacctgctgcccaggccccatgtggctctcagatgccctctagaggggggcatgggctgtcaccaatgatgactcctggggtggtcagtactgaaagctgagctctgagggccccagagggaatgattgactcagctggtgggtgctagaaggggtgtctggaggtgcctgtgcagcgtgtccaccccacgggagcccctttttcaaacctccgtggcgtccggcccccaggtgtactacaagcgggcagacatggccatcggctccctcaccatcaatgaggaacgctccgagatcgtagacttctctgtaccctttgtggagacgggcatcagtgtgatggtggctcgcagcaatggcaccgtctccccctcggccttcttgggtgaggcccagggtgggcagagacggctccgggggcagaggggcccacgaggagggtgtgtacagcttgggtggggatggggagttgggtgggctctcacaggccaagcacagcagccttgggtcttggaggttggctggaggtgagtggaaaggagacaggagaagtgaagtcagtgttcggttctaggtatggctgccaggtgagggtggggttgggggtgtgggatgggtcgtggtgccactgtgagtggcaggaaaatccagcaggcaggctcgcctcaggatgggccatggcccaggactgtggaacgagtgggggaggcccgtggggagttgaggagcgagtgtagtgtgcgaagaggtgtgttgcttcctgggtgaggagtccggcattggttgggcagccaggtcccatgctgggtgctggggctacagcgtagtctttgccttcccaaagttccctgtcagaggccacgtgggacatgaagtgtgaggtggcagagagctgtgaagacaggcgaggggcaggggaagagctgaggctggccagacaggagtggaaaccccggctctgccctgtcctgctgtgtggcctcgggcaagtcacagaacctctctgagcaggctcctcagccacggaagagaggaaaaaaaaaaccacttcatagcatagcaagtgctcatggcaggattgatttccctccctccctccctctctccttcccactcttcctttcttctttccttcctttttttttttgagacagggtgttcctctgtcacccaggctggactgcagtggtgccatcttggctcactacagcctggaaactcctgggctcaagtgatcctcccacctcagcctcttgagtagctgggaccacaggtgcatgccgccacacctggctaatttttgtattttgtgtagagacaggttttcactatgttgcccaggctggtctccaaactcctggactcaagcagtccacctgcctcagccgcccaaaatgctgggattacaggtgtgagctactgcacctggccaatagtagtgatttcttttctttcctttttttttgagaatgagtcttgctctgtcatccaggctggagtgcagtggtgcactctcagctcactgcaactgccgcctcctgggttcaactgattctcttgcctcaggctcctgagtagctgggactacaggcatgtgtcaccatgcctggctaatttttgtatttttagtagagacagggtttcgccatgttggccaggctggtctcgaacgatccgcccgtctcgtcctcccaaagtgctgggattacaggcgagagccaccaagcccagccagcagtagtgatttcttactctaggagacagaaacagtcttgtctgaggcctggggtggatgtctccagttccctgggtgtgggtttccatgttggtaggatgaggagtaagacttggcctcaggggctctgattccaggcagaaccaccagatcatccacgtggggccaggcaggggttgtgaagtcaaaggaacgtttcttggggtgggtgacttgtacctgtcccagggaagtggggggcggggggagaccaaggatgctggagagcctgacctcttttgggggcctctcctggggctctgctgctctgagtcagaggcccccttggctgggtccgcagagctggtgggcccctactttgatcacgtggacctacctgtctccacccagtgcttctgggcctggggcagggaacatgccgaggcctctgagctgcctccctctgtccccagagccatatagccctgcagtgtgggtgatgatgtttgtcatgtgcctcactgtggtggccatcaccgtcttcatgttcgagtacttcagccctgtcagctacaaccagaacctcaccagaggcaagagtaagccttgcctgggcccggcaggaggggtgggcctgggcaccctgagggctgggctcaggggcaacgggtccttcagagaatacctttgggaggtcccttgcttttggatggcacatgctgggggccagtcagatgacacacacacacagaaacacacacgtgagctcacttcacctggcgagggaatggccaggacgcgtcccccccaaggccaggctgagaccggagctgtgcagtcgggtgggctgagccctgagccctttcatggtgggcaggaggagctccagcatccccccgcctcttgcccccagagtccgggggcccagctttcactatcggcaagtccgtgtggctgctgtgggcgctggtcttcaacaactcagtgcccatcgagaacccgcggggcaccaccagcaagatcatggttctggtctgggccttctttgctgtcatcttcctcgccagctacacggccaacctggccgccttcatgatccaagagcaatacatcgacactgtgtcgggcctcagtgacaagaaggttgtggggccatagctgctgggggtgggggggggcactgagggtggggacaggccgtgagtgggcaggccctggacagtcgagtctggggaatttgacctggaggctggggcaggaagaagcttcagggcctgctgagaaggggttgggggctggggcaagagatggctcagggccaccggctgagaggccttgggtaagtctctccctgtcttgggcctcagagtctccatttggaaaacacaggagtggcctggacagcctttaagaccttctgctctgactatgcaagtccacactggggctgggctctggggtgggtttggggctttggtgcctggaaggctggaggaagggttgtgactggctgctgccctccgcctgcagtttcagcggcctcaagatcagtacccacctttccgcttcggcacggtgcccaacggcagcacggagcggaacatccgcagtaactaccgtgacatgcacacccacatggtcaagttcaaccagcgctcggtggaggacgcgctcaccagcctcaagatggggtgggtccccagccctgcacccgctgtcttcatccgtgtgtctccccagtgaccagccttagctctcaatgtggggacagtgggactgggctgtcctgcaggactcctgtggggtggagggaagaggtcttggggcagagtggagcttgaggcaaaaatggaaggccaccatgtgtctcagaacacagctgtggtgccaatcaaagttcagcctcagcctgaggtggtggttgggaccttctctgagtcttaggagcacggagagggtgggcagaaagggtggtgtgtcttctgggaacagacagtcccctggccactctgcagaggagggtgggaggggtcctcaccccatccaggacccaagagaaccagacaagtctctgcccattggtccctcccgggggtgcccagcaggctcatgtggtttagacccctgtcacgccccagtttcggtgtcccctcccctcccatatggtccctagctctgaggctcagcctgtccccaggaagctggatgccttcatctatgatgctgctgtcctcaactacatggcaggcaaggacgagggctgcaagctggtcaccattgggtctggcaaggtctttgctaccactggctacggcatcgccatgcagaaggactcccactggaagcgggccatagacctggcgctcttgcagttcctgggggacggtgggtactgccattgctgggatgcccagggtgggctgtggagcccaaggttgtcagcatttccaccaccactcaagttcccaaggcctgtgagcagggagaggtctctggggggtgagaggttggggcagctgaggtgggcaggtactaggagcaactggagagagacttgaggaagggataggtgtgcagggcgggagcaggaactgggctagagagtccctgaagggcaggaagacaggaaggggctcaggcctcatggtgggggtggggatgggtggagtggctgaactcctttcttcttccctaagacccctcccaagatctctcccagatgagcacctcctttgctcagtatagtatctccatggccatcttgagattacggatctgcccagtcccacatgtgtgagtggtccagcccagcctgcccccaaacccagagagagctttgtgtttggaggagttccattcttgttagataagacatggtctagactgggtgtggtggctcatggctataaccccagcactttgggaggctgaggtgggaggatcacttgaagtcaagagtttgagaccagcctgggcaacacagcaagatcctgtctctataaataaagtttttaaaaaattagccaggcatggtggcacacacctataatcccagctacttgggaggctgaggcaggaggatcccttgagtccaggagtttgaggctgcagtgagccatgattgtgccactgcactccagcctgggtgacagagtgagaccctgtctcaaaaaaaaaaaaaaaaaaaaatctgatttctcaaaccatataataatgagagcggccaggtgaggtggctcatacctgtaatcccagcactttgggaggccaaggtgtgaggattgcttaagtctaggagatcgggatcagcttggacaacatggggataccctatctctacaaaagatacaaaaattagccaggtgtggtggtgtgcctgtagtcccagctactcagggggctgaggtggaaggatcgcttgaacctaggagatccaggctgcagtgagccatgatcacaccactgcaccccagcctgggtgacagagcacgactgtctcaatataataataataacaataataataataagagcaatcacaatgtgtgtctcttaggagcctaggccttttgtctctgtgtgcccagctccgtgagtggcatgtagatggttaataagtatatgaagaggagtgaatgaatgaatgctaacatttacccaatcacaagcctttactgggggtgcacagggggaggacccaaaggccagcattgcccactccagcctccaccctgctttcctatttccttgctcactgaccctccactccccgccccaccatcctgctccagccaggctggatccccatgtggtctgcttgaggaagaagtgggtggcaccctgccccagatcccttcttactccaggtttgtggtgagctttgtgagggggttgcttataggggggtttcctgagccagatgtgtacaccccccaactccaggagagacacagaaactggagacagtgtggctctcagggatctgccagaatgagaagaacgaggtgatgagcagcaagctggacatcgacaacatggcaggcgtcttctacatgctgctggtggccatggggctggccctgctggtcttcgcctgggagcacctggtctactggaagctgcgccactcggtgcccaactcatcccagctggacttcctgctggctttcagcagggtgggtgcccacccctccccacacaggccaaagttttaagggcacctacccagataagtccgggctggccatggcccatttccagaggtaaaaccaaggttctggcccggctcatggctcacacctgtaatctcaacactttgagaggcttaggccagtggatcccttgagtccagaagtttgagaccagcctgggcaacatggcgaaaacccatctctacagaaaataaaagaattagctgggcgtggtggtgcgcgcctgcagtcccagctactcaggaggctgaattgggaggatcgcttgagccaagaaggcagaggttgcagtgagccgagatggcaccactgcactccagcctgggcagcagagtgagatcctgtttctaaaaaaaaaaaaaaaagccaacgtcctgagaagtggcatggctcaccagggtggcagggttgaagagggtcagagtcccccccacaggtgtgcccaggttggaaccttcatgtgccaggtgctagctagagtgattaggagaatgagtcaacctgggcgctcagaccactcattcatctgcaaagcacagtgcctggcgcatgggagatgcttcacagttagctacttcctgagacttatagaagactgatgatgccttgggaccaggcagggacaatcgtggcgggtccctgagcggagggcgctgcttacggcctgtcgtctccctactgcccagggcatctacagctgcttcagcggggtgcagagcctcgccagcccaccgcggcaggccagcccggacctcacggccagctcggcccaggccagcgtgctcaagatgctgcaggcagcccgcgacatggtgaccacggcgggcgtaagcagctcccctggaccgcgccactcgcaccatcgagaattggggtggcggccgccgtgcgcccccaccgtccccctgcccgaccccgcggtctggccccagcccatgcctgcccacccccgacccgcccccagagccgagccccacgggctggggaccgccagacgggggtcgcgcggcgcttgtgcgcagggctccgcagcccccgggccgccccccgacgccggggccgcccctgtccgacgtctcccgagtgtcgcgccgcccagcctgggaggcgcggtggccggtgcggaccgggcactgcgggaggcacctctcggcctccgagcggcccctgtcgcccgcgcgctgtcactacagctcctttcctcgagccgaccgatccggccgccccttcctcccgctcttcccggagctggaggacctgccgctgctcggtccggagcagctggcccggcgggaggccctgctgcacgcggcctgggcccggggctcgcgcccgcgtcacgcttccctgcccagctccgtggccgaggccttcgctcggcccagctcgctgcccgctgggtgcaccggccccgcctgcgcccgccccgacggccactcggcctgcaggcgcttggcgcaggcgcagtcgatgtgcttgccgatctaccgggaggcctgccaggagggcgagcaggcaggggcccccggcctggcagcacagacagcacgtctgcctgcacgcccacgcccacctgccattttgatggggggctgtctgtcctcaccttccaccctgtgccagccacggctcctggctctccggggcctgggggcctctggggcacaggggcaggactctggggctgggcacaggctacagagacagtgggggactggacgagatcagcagggtagcccgtgggacgcaaggcttcccgggaccctgcacctggagacggatctccagtctggagtcagaagtgtgagttatcagccactcaggctccgagccagctggattctctgcctgccactgtcagggttaagcggcaggcaggattgggcttttctggcttctaccatgaaatcctggccatgggaccccagtgacagatgatgtcttccatggtcatcagtgacctcagtagcctcaaatcatggtgagggctgggcttttgctgtcctcttctcacgcagagttctgccaggagggtgtgctgtgggggtcagactcctgaggctctcccttccctggggctagccagttactggtcatggctgctgtgggcatggaggctggaacttgtggttgaggcagggccatcccgatccttgctctacctggctagagtttcttctcatcagagcactgggacattaaaccaaccttttacaacacactggtcctggctgcttcattctgcattctggaaggggcacagcacaggccatagacaacagggcatcatgagagtatcccaggtgggatgtttgcctaaagcaggtaggcaggtccctcttggggaggcggagccttgggagtgtctgggagggatgtgggaaggaggtgaggctgagagggggctctgggcagcagaagccacttggtattcagggccagctcccacccatcctggcactggatgtaacacgtgtgctcagcacgggggctctggtgatgatggatggcgttcatccctcagtctccttgaaaagggaggcttgtgtcaggggtagtggctgtcctgtcctgccctgccagggacgccctggggagcctgacagtgccatggtggcagaggcagaggcagagaaaggtgtggagcttgtaggcttgctaaaccctggctggccgcattctctccgtggctgacacacgaggctcggaactgcctgggctctggaatcctggggcaggtggctgccagggtcaggcacagcttggcctcgctggtgccaggactcctgtggtgggagaatctgcctgcggtctcatcctcttctccctctggggcttctagcccacttcctttttctatcacacatctttgcctctggcccatctgaaaagatggcttgtgcttaccattttcaatgttttcacatctgcaatcacacttatcccccctacaatgactgtggagcaagcaggcattccttctatccgttccacaaacagtgagcactattgattctgtcagacccttttctaacggctgaagatgtaaaggccaagccctggctgtcctgacaagttgggtggaggcaggccagaggctaattccacgtgacagagaggaagctgcgaggggcggtgctggctgtctctgccagtgccctcccccgtagctccttgctggttcccaggaagccaggctgcctctttagtctctgaagaccccactgtttgggttggggccatgagaactggactttttttgggttagttttaggggtgaaggcagctgaaacggtagggggagatacacctccattcttggtaggagagtaccccaagagtgggtggccctgtccacacaatttcacgctctctaccctatgggtttttatgggctggatccaggttcaggacagcaggctgggagtgtgtctaggtgagtgctggaggccagcactctggaagggagcttgaccttggttgcagccactagtagtgagagggttaactgttggccaccagcccctggaaccgagcccctcctcctcccagagtcagggtctgcctttggccctgggaggaaggctgtggcaggtgaggcatcctggaggagctgtgaggacagggctgctctgctctctgcccaagatcattaataaccaagaactggaaagatcattaagagctgagcctccaatgtgaagccgagcctgctgctggctctgaggagggccgctcctgctcctgggccaggcactggctgccttgttccttctctaggcatatatttgtggcgggggggnnnnnnnnnnnnnnnnnnnnctgcatcctgagttcagaactagcttggcctggcttcctgcaccaccaagggaaggaaagaaagcgtggcaggggagaggagagagaagtaaggctatagatgtgaaagcatcataaacaagggcctggcgacccacatgctcaaataccattgtttttctttgggtgaggtacagaaagagggaggcccttgtggctggcctcagagcaggaaaatcttactaactggggtcccttctgttgctgctgtagctgtttttccttgtgtctagctgagcggcttgtggtccaagccagctttctgcagggagccaggtgtgtgtgggggaggagggcagagcttgcaaaagggcaggctgatgtcttcagccaggaccctccagcctagcctgtc

SEQ ID NO: 15610 - DNA, 24721 bp, Human
tttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagcacatcctgtccactgtttctttgaagtgagtggggggggggggtcttgttgaaggaattgtcattcactgccaaaatcattccatcctccttcctcagtgtctgtcctcagatggtcagctccccgctcaacagactgtctcccgcctctgtgaccagcctctctttggcaagagggagctagaaggctttacagtcctaatcatttttctgttggaaaaaaaaaaaaaaaaccaaggctcctttccctgtggcgtgtacccagaggttgattacctgagtctgtcctgcctctccccaccccacctccctagccaaacgctgctgccaaagcccacgctattgccctagatggcctgtcttcagcgggctgcccctcgaggtcccaggctctccgcggagccctcaccttcccagcagggatcagaacctgcactcctctatgcgagtcctgggacagcacaaagtggattagggttagggttcccacaaacggaaaaatgttattcaaacaactctgtagggtccgaggaggccctccgtcttaattctcgagactgaccggccctcgctgccccgagcgggagcagttgccccggcaacagccgctccctctcaactggagctgcacccaggctttggctaaaggctgttaaaacgttggccaggtgcggtggctcacgtctgtaatcccagggcggatcacctgaggtcaggagtttgaaaccatcctggccaacatggcgaaatttcgtctctactaaaaatacaaaaattagcggggcgtggtggtgcgcgcctgtaaccccagctgctcgggaggctgaggcaggggaatcgcttgaacccgggaggcggaggttgcagtgatccgagatcgcgccacggcagtccagcctgggcgacagagcgagactccgtctcaaaaaaaaaaaaaaaagttagggtcctttacccgagggccggctttcctcactccccgccacaggtaggggaaaccaggccggagccggcgggcccacccgcccagaaccgggaattcggcgagccccgcccctgccaccccagcgccggccgctcggtaacaaacacttccacttcctgagcgctagtcttcgcccgccgcggggcgccgcgccgagcgcaggccccgccccgcgcgttcccaatggccggcgccgttcacccggccggagcgcccaggcctgcagccccctattggcccgcggaggtccccaccctcagcgcggccccgcccccggggtaaggagccggggcggactctgggacgctcagacgccgcgcggggcggggattggtctgtggtcctctctcggctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagatgagcgcggacgcagcggccggggcgcccctgccccggctctgctgcctggagaagggtccgaacggctacggcttccacctgcacggggagaagggcaagttgggccagtacatccggctggtggagcccggctcgccggccgagaaggcggggctgctggcgggggaccggctggtggaggtgaacggcgaaaacgtggagaaggagacccaccagcaggtggtgagccgcatccgcgccgcactcaacgccgtgcgcctgctggtggtcgaccccgagacggacgagcagctgcagaagctcggcgtccaggtccgagaggagctgctgcgcgcccaggaagcgccggggcaggccgagccgccggccgccgccgaggtgcagggggctggcaacgaaaatgagcctcgcgaggccgacaagagccacccggagcaggtaagcggggcccgagccgcgcaggctggcatggagtgggaggaggatccggagagacccaggtgccccggccgtccagccccgcgcccgccgtcgtttttctgaaactcgagctgcgagggggagaccgcttccgcccgccgaccaggcgccctgacacatcctaggcaggcctggggctgcgtcccgcgacctcctctccttcccaggctgtgctgggagcttgagcgcctttgccgcctgcacctcttgttccctggcctttgggagggcggcgcaggggaacccagcccccttccctcgggtctgtgggtgtctgctcccgttcctcggaatcccccaatcctgctccttccctggtgccctctcctcgttcaccccagtccgcagatgggccggggagaaagggctctccgccccagaggtgccagcttcgcccgccactcctacttcaaaagctagaggaatagcattactcctcctgtgtggagccccggcgcgaggaggccctctccgcagcccgccggtgtgtgtcctgaacttcagtcctgctggacttcatcctcccggagtcctgtgtgacttctaagggagaggaagccccaccatctcagggcggtgtgggggttgcctggcagggaggaggagccaaggcatctcggagtggtggttctgccacctcagaggatttacgattctcaggaatgtgaagagtaagcgcctagaactgtatctgggagggaaggggaaagaccttggaagaagaaaaagatggccatggggaggagagagagctcctggggctcacggccctgtgtgcgccagcggagctcacggtgagccggtggtcttgccctggccttgccatggtcactctggtgcccacacagccagcaggccggttgctttttgcccatgtttggtgtttgcccatgggatcccagtttggatcagctgcaagaggggcagctggcaaaataggagttgtgctgagcctcctgtccccagagagtggagtggtgcattgtgtagggcagggcgtgagcctcccaggaccccttcagcttgcaccaccagctctccctggtggcagtgtctgatgggagtgtccgtggggctacgaggagcctcctggacagagaaagggcacagttcggcattaaggtagaaggcaaagccctagaggatcaactggtttggtggaagtgaggtcaccagaagccctgtccagccagagctgggtgctgggaatgccagggccaccaggctcccacttcctgcccctgccaagctggcattggcaaggggagggggaagggatctgagcacccggagcaaggaggttgatgccagggagttggggccgatgatctccagtcccaggcagaaatccagtgtgaactttgtgctgagtccatcgatcgatttgacattcttttttttttttttttttggactttggcacccacacaaatacccacccacccccaccccccacaagttgcagtctcgttcagctcctccctttgcccttttggttatgctgctgggtgccagagggcctgggaggcgaacgtggaggcctggcatagcacacgtgcgcaaaggcagcagctttgagcttcctgggtgagcacagactcagattcctgcatgttttggagggacacctacatttgtgtgtactttgttaggccaggagatgagaggagagccaccagcaaatcctggggacaccatcaccagccaagtcccaggacttctgagttctggttctcccatctgtgagatggaggcattgggcgatgtgatgcctgccttctctagaattatagaaatgacgtgaagcacttgagccccttactaaatgctgaactgcactccttcatgcctggcgtttgaatcccagctcctctaaactgactcctagtcaacaccattgagtccttctagcagaaaatcctctcctctcaatcctgtgtgttgagcatacagacacccatgtggttattagaaaaaatgttaacagacattgtaagagttcgtttttctaaaacacacccgtttcctacataaagcatcaaatggaggtttgccaattcgttttagtctgaatttgtgtgcaaggtggggctgttcccttgtcttcattagccctccacttactaagtgatgatatcagtggaaaagtgtggcgcagagagtggttggctgggtggcctctggctgggaagaccagctgtgtccagaaccactcagggcagaggctgaggggtgcctgtaacactggccatccccgctggggagtctaggcctaaggaggtggaagtggctctccagctctgcccaccggctttgctttgtggatggccttccccgcctgccccgtggggagagaggagcagcaagacccgccctgctgttcccctgcttaaagccctcctccccccattcaccaccagtcacaggatgaggcctaaacccttgagtctgggttcagagtgccggccgggcagagccgagccagctcagctgtactagccaggctgtgcgaagccaagttacctcacctctgtaagcctccatttcctcttgtgtaagttgggggttatggcagctacctcggaattgcatgaggctgtgtgtaaagcacgtagctcagtgcctggcactgagtccaggctcagccagcctttgcagttggtattggaatgaatacatatttcatagtgatcattgcacacctatcatggggcagctagcgctgggtcagcctgcctagttgggcaaatgccactgtggccaagcctggcacacagtcagtgcctgatcgatggtcactgtgggttaagaatgatacgttgtggccaggtgtggtggctcacacctgtaatcccagcactttgggaggccaaagtgggaggatcgcctgagcccaggagtttgagaccagcctaggcaacatgacaagaccctgtctctattaaattttttcttttttttttttaagagttatatgctgttccatggcccttctccatctggcagcctgttctcaccactgcctccctacccccaaaaccacacccagggtccgaattcccctctagcctctaagccttcacaccctgacacttctgtcccctcccagggagcctgtccttaatccagtaggcagagttagcatttcctttccttcactttttttgtttttgtttttgtttttgttttttttgagacagattccacccaggctggagtggtgtcgcaacctcgcctcgctgcagcctcgacctccagggctcaatcgatcctcccacctcattctccctagtagctgggactacaggcatgcaccactattcccagctaatttttaaattctttgtagagatggagtttcaccgtgttgcccaggctggtcttgaactcctgggctgaggtgatctgccagcctcggcctccgcctcctctttgtccttacatcttttatcgctctaaacacacaatattttaatcatctgtttgtgacctttttctccactacgtggtaagcccaagggcatcaactgtggcctatttgtgtttctatccccagcgctgtccttggcacatggtagggaggctctcaaaaacagtttttgaattaatgaatgaatatataacaacagtcagggacctttgtcctcattcagctcatcccgccccgcccagagattggaattccagatagaacctacccactcttctttcttgcctgctagcagcttctatttgaaaactagaaagccaaaagtccaggctttggggtcagccagatcagtgtttgaatcccagctctgccgtgtgctggttctgggatcctgggagttcatttttccctgcaaccctcagcctccacctctgtgaaaggcactgcctgcagggttattgggaagatttggtggcatgacaggtttgtaaatgaaagtgctagtttggggtgtttcctgccagccctgaccctgatcccagagtcagagtgcaggcaccccagggagcaaggtgggtggtggggcacagttagctggagggccatcaacctctttcccagggcgggcgggccattttacaccaaccaagttggagctctggtagggcagaacagagcttgagctgctgggtgtttggatttgaaatggacagggtatgtgattgtttgtgtgttgggatctctttctttgctggcaaaacagtgtagcccctggttcttaccttcaagctcctgttaactcagtaattctggagatgattctcttggagatagatgggggcttcctggccgggcgcagtgacttgtgcctgtaatcccatcacttcgggaggctgaggcgggaggatcgcttaagcccaggagtttgagaccagcctgggcaacatagtgagacctcgtctctaccaaaaaaacagggggaggggggtgaatgggggcttccttctcaaggaactccatatgtctagatggggtccttctcccctttcccagatgtcccatctcaatggtccctgggaaagtggggtgggaaattaataagaaactcaggccaggcacggtggctcacgcctgtaatcccagcactttgggaggccgaggcgggtggatcagttgaggtcaggagttgaggtcaggagttcaagaccagcctggccaacatggtaaaaacccatctctactaaaaatacaaaaattagcgaggcgtggtggcaggtgcctgtaatcccagctactcgggagtctgaggcaggagaatggcttgaacctgggaggtggaggtttcagtgagccgagatcgcgccactgcactccagcccgagcagcagagtgagactcatctccaaaataaaaaaaaaagaaagaagaagctcagccgaggtcttgttggtgctgcaggactctttacagggagaaaccagagctctagaccccaataacaaatgttcctctgttttcgttgctctaagatagagtggccctacctggaaggaaacaggtttgtacagtgcctttaggcactctacctatgacataaagatgttgacatgcatttctttctttctttctttctttctttcttttttttttttttttttttcctgagacagtcttgctctgttgcccaggctggagtgcagtggtgtgatctcggctcactgcaacctccgtctctcaagttcaagcaattgtcctgcctcagccttccatgtagctaggattacaaacacccgccaccacaccctgctaatttttgtatttttagtagagacggagtttcaccacggtggccaggctgggtggcacctgtcacaacaccctgctaatttttgtatttttagtagagatggggtttcaccacattggccaggctggtttcaaactcctgacctcaggtaatccacctgcctcggtctcccaaagtgctgggattataggcatgagccaccacacccagccaatatgcatttcattgtcccccagacaaattagctattgttttctctattttgtaggttgacagtaagtgttcaatacatgatagctactatttgtgtctagcactgtgctaagtactaaccttgcctgtctcatttaatccacatgaccaccagtgaggcagatattggccccattctctgcctatggaggctgaggcttgatcagttaaggtggccatggcgggtcccaggactctgagctagcgactcctcccacacagcgcaggggtgtgtcttggaacccaaccctctgactctagtgcctgcacagccatttggccacatgagtaggctgtgcttgaagcctgactctgccaggtgtttctgcccatcatattctgagccacagctggaccatcacagtggtataaattcaggctgcttgaactggcttcctgtaaggatccagggcttccaggtgctcctgtccctagcagggcatccttgcagtgcctcagcccataagtggcaggctcctgtccccatcccttctcacgtgatgtgataggtcaatctggaatctggtaaccaagtatctacccccgccctcactccccagaacctgcacagagagcccccctcaagggtggtcttcactgttgaccgaagccttcccctcatggtaggacaactcaccatgtccccagactcctaggcaatgtttaggtccctaggccctagaaaaggacaagagttacagattccctgaggtccaggtcacctcggggtggtgtgggaacacacagagaatgctggccaggttcaagtcccactcactgctgggtgctgagagctctgaattctccgagacaggctgcagcctctccctgtgctaaggtcaggggaacagcaatggccaggggtatttagaggagtgtgtttggggcagtctcaggcagcacaggtctgtgctgtccgggcagcagccaccagcttcgcgaggctcccgggcactcgagatgtgctggtccacatgcagacgtgctgtgtgtgcaaaatgcacaccagattttgaagccattgtacaaataaaaggatgtacaatagctcaattgttaaaaatggattacacattgaaatgataatattttgggtacattatgttaaataaaatattcaattctactatttttcctgttttttttttttttggaggcagagtctcgctctgttgcccaggctggagtgcagtggtgcgatctcggctcactgcaagctccacctcccaggttcaagcgattctcctgcctcagcctcccaagtagctgtgcaccaccacgcccagctgatttttgtatttttcttttttagtagagatagggtttcaccatgttgaccaggctggtctcaaactcctgtgctcaagtgatccacttgcctcgtcctcccaaaatgctgggattacaggcatgagccaccacacctggcctatttttcttttctttctttctttctttttttttttttttttttttttgagacggagccttgctctatcacccaggctggagtgcagtggcgtgatctcggctcactgcaacctccgcctcctgggttcaagcggttctcgtgcctcagcctctggagtagctgggaccacaggtgtgcaccaccacatatgtctaattttcatatttttagttgagacagggtttcaccatgttggccatgctggtcttgaactcccgacctcaggtgatccacctgccttggcctcccaaaatgctgggattacaagtgtgagccactgcacccggcctatttttcctttttcaaatgtgatgactagaaaatcttacattccacacatggctggcattatatatctactggacagtgctgctctggatctgagctcaaatcctgcctttgcccgtcagccatgtgtacttgagcaactgactccagctttttgaagctgggtttccttttctgtgaaatgctggcaataatactttccttttaggactataattggctcttaagaagaaaacacatgtaaagagctcggtgcctaacacatagtaggtgttcagtaaatagcagctgctatttgttacttcagtgttgagccccaatttcacaagctccttgaaggttcttaatagccccttgggacaacccctgggggttaaatctagagacttctgggaggagggtgagggatgaggaaggatgcagcagggaaggcatggggcggccagccctggatggtgtccagccgggctgcagcccaggtaccagcctgctccatcccaggcttgcccagccctgcagagacctgagccagactctgccccctcttgcccccgtgggtctccatggctggcacagggagaagaggttactagccagaaggagaacctgtttcagacctctgagtcctgggggtgtctgtcagaccagcagacctcactttagtttgtgtctccctcctggttcccaccctaccagactccagggaaagctcttcccactgagaaataggaaggaagagatcaagggctaggagcagtgagtgactttttttaaaatggacacatccaacattcccctgccgcccgcacagacctggagggatgtggagggtggaagggggtcccatagagtaaaatgaggtgacatcagggccactacgcagggggccagtgacagccaagccccctgtacctcacctagggtaaggagaagacaccttctgcctagaggtgtggacactggctgagtgcctggagcccctggtcacttcccagtgcccccaggctgcccgtcacacagcactccaggcagggccagctgtctccatcctggcttccttgaagagctggcaccaggcccagccctgtctccagaatctggggaacaaactgagctgtctcccagagcaaatatggctcttacacccaacatactcctgacacacacaccccagcccctgagaacagccagggttccttcctgcccccgccgtcctgcccccttccatcctcttgttggggctgattttcctgtattgggcatggggcactggtcttctttgcataaacaagagccctgggctgggggaggggcagtcttgagaggtggggttacctctgttgttcccctggacacccaagtggtcttcctactcctccagcccctttcctctggggtcctgagctagctggctcgaaggaagcgggctgggctgtttctgtagggcccatcaccatggcatcagccagggaggggctgggcccaatggggcgttggcccccaggctcccacagccttccctgaagggaggaaggaggagcagggagcggccctgggcctgttccccagagacggtcactgggattagggtatcgactttccccagctttccaggtgactgctggtggcgcctattgaattccgtgcccgccatccgctccctggactgcgtgggtggaggtgatggggcggccacttagggcgcggtgaagctccctgggggaaaggacagatgaagggaggaagcctgagggtggaggaggccccgggagaagggtgtgggggcagctctccgggcagggtcttttctggaaagccagccagcattttgtgaaagtgagagtctccagcctgtccagccctgggtcaccccggcccagctgcgctgcccatcggctgcatggcctcatgttccctcctgttgattctggctctctgccagtctcctctctgagcagatcctgattttgtcttgaacttgggtctcccaggctgtcgtcgtcactggaggtcccactttgccctccggaactcactggggctatgttccttttgagtctcctcctcccaccatgcttcggacccctctgtagctggctcctcctaagatcctgggggccacacaccaagcccaacatgcctggacgtcactcccatttatcccctttccccagaggcagaacccagccctgccccagcttggcggtgagggtccaagagcaatggtggctgagctcggccaggtaccccacacctccccatcttctcctctcagtgctgggcctggagaccacaggccaggccccacagatccccaggggggctgccccaagggactcccctgccagccccagcctccacccaggctgggatgggctggcttgatgggctgactcagcaactggcactgacacctcctggagacagctgggaggctcctgctagggaggggtgaggaggaacaaggctggtctcccttgaagagtgggaaccccccttcccatgtgaggggaggaagtctctagggacttgggaaggaggctctgcaggtgcatcggagctgtctaaatgctggtggggtctaccgggggcttcccatctccttgtccagccaccccctcaggtcctggagccgccacagagccacatctagacagaacagtggagcaggtcccagtgcaggggaaggaaacagagggcacctgagcccctcaggctgggtaccctgtttccccttgaactgcacgacttggtgctggcagagcggagcaaggctcaaagcaggccctggagctttggcaccatatgtcactaggcgaggggcactgggctgaagatcagtaagggaagcccacagcacagagaccagggccagaggatgggcatcccaaaggcagctagcacagccctgccctgccagccggggggggcgcccagagccacctgcccccagtccagccatgcccctgccctgtcacccacaccaggcttcatcccccagctcaggctgcagctccagctgcgagaggccctgagcgcccggaaggaaggctgtggtaggttgtggtttcttcagctcccagcctacctccagcagaggctgcagccgatgccctggagagagcccctgtctgccctctgctgcctgactcctgttgggtcctcacctcccaatgggttgccccattctggacttggatccttaaggagcaccctgcagtgtggtggaaggaggacaggttccaagtcagagaccagggttggagttctggctgtgtgatgtcaggcagtgggctccacatctctgagcctcagtttccccatctcaaaaacagctgacaagccccagtcaggttgttatgggaaggtttttgggagcgcagggacggtggagggaggttggaggaggtcactagagctgccccctgcctgtcctgagatttcaccctccccactttctcagggtgtctggctgaagcagaaagctgcgcctgtcctggtgacggcgactggtcagacttgtttctgctcacctaggcggcccgggggagggcctggctgggagctttgtggagggattagctctaggggagaagagcctcacttactcccggaacaagatcccacagggctgtgggagtgccggggggtgagcctggggcaggtgacagccgaactagctgggagtgggccctgcagtgaggcagggggtgggccagggagaacaaggcaagaggagcttcattcagggttcctgagcctttgtgagccactcacgtttttaccactcacttaaccgtctttgttgttggggtgaggggtcctcgagcctggatttgggtatgaaaacccaggcaagaaagacctgcccaagcctttaaaggaatgcaaagtcatcctctagccacccccagagatcgaaaggctggggattgagtctcctgcagatggtggcggcctcctggggctggcaagttgggacagaggcccataagccctcctgggcgcgccttcccacccctctcggccctctccactcccagctggggatttgggtttcagagcagcctggcacacacacccccaccccaccagaatctcactcccagcttcctatgactattcattagtattcacaacaatgggaaagtctgggtgtgcacagggattttttacagttagaaagtgtttaagtcaatgacctcactgggcctcagcaaccctgggaggcagatggcagtcagaatgatccataaatgacctgccccaggtcacacagctcctaaacaggggagctggaacctggctgggagccttgactatccactgctcattgtctgatgtgctgagtgataacacagggccagcaggctggacagcagccagtggccctgcaccaggcctggaggagggggagagggacagggactcaggcgtagtccttgggcacaggcttcggctgcctacacccatattccctccatcatactgtgtgtccaggcctgcagcttctaagctgagctgcttactttggaccaagcatgttggaaactgttttcagctgagtccaagcactcgaaatctgcgtgtgcccttttagtaggtcacaccctccaggccacagccacactgggctccctttagcccagccctgcttttcccagtcccctccccattcaggctcctctgtttctggggtctctgtgcttccgttgccacctctgcccttgggcagcggtgtcgggggaggaggtcctggaacgcctgaggatggccccgtcttgtccaggtccccttgctgtgctgaacaataagtttttggttatctgctccttctggctcccttttggctgggccattcggcttggtgggggtgagagagagttcgagtatatggaggaaggctttactgtaaacacactgaccagctttcagtaaacacctgcctcttcctcccctgctgcagagaacggggtacaaaggggctgggggtcctcagtcatatgccccaggtccccagccaggctgacgggtgccacactctgccccctctccaggagggccagactgagccaccaatggggagggatagaggcccgatcaacacagcatgtgattcaccttagactgtcagaagggacaggcatgtgagagctaacctggtcctacccctcatttggcagaagaggaaactgaggcttggacagagcagtgttttatccacatcacctaagcagttagctgcggtgctgggtatccacacaagtcttttgagtcctgggccagaaccctctcaaattgctgtgtagggatctaggcaaatttgcatcctcccaaaccttccttggttggggagatggggacaggcagaggacagggaaggcagaacctggggcactgtggaatagccatggaccctcccctgtccctgcagcgcgagcttcggcctcggctctgtaccatgaagaagggccccagtggctatggcttcaacctgcacagcgacaagtccaagccaggccagttcatccggtcagtggacccagactccccggctgaggcttcagggctccgggcccaggatcgcattgtggaggtgatgcttctcgctctcttcctatctgactgcccccaccccctgcagatcagcagcacctggggcagccatcataccatcatgggcttgattagcccacgggcatagccaacctggagctgctggatggatgggtggatgggagggagggagggaagggtggtggatggatagacggaaggacagatggactgactgatggactcttctcttacctccactcccctggactcctccttgccaagcagatacagtgggcagcctgtgattcacccatcgatcagggagatgtctggggccatctccagagcttccctgctgccaggcacacagagtggggtggcagtaacaaaacccctctcctgagttaggcctttatttatttagtttttttttttttaaatggagtctcgctttgttgcccaggctgggggagtgcagtggcacaatcccagctcactgcaacctccgcctcctgggttcaagcgattctcctgcctcagcctcctgagtagctgggattacaggtgcccaccaccacgcctggctaatgtttgcatttttagtagagacaggatttcaccatgttggccaggctggtctcaaactcctgacctcaagtgatctgcccgcctcggcctcccaaagtgctgggattccaggcgtgagccacctcacccggccccgagttaggcttttagactcgtgcattcagggctctggtgctgtgctcctgggagaggaaacgtgaaccaaatgctcaggcaggtcccagaatcacagtcttagaaccttagagctagagatcagctctcccaagacttctcattttacacgtgagaaaaccaaggcccagagaaggaagtcggacagcaagtccttacccaggctgggccccaccccggcctcccagctcgctcccatcccatctctcccagctgtgtttgtttagtctcgtctggatattttcgttggcccttcccatgtatcctgcctccccagctgactgtcaatgggaggacccccagcctagttcaggactctgcagaaatggcgggggtcagtatccccaggttgtgaactgcaaactggctgagaaccaaggtggtcacccctgcccccaacccccctccacttacctgccccagaaccaaggcctgtgtccgtaacgcctccccgaccctgccctgcaggtgaacggggtctgcatggaggggaagcagcatggggacgtggtgtccgccatcagggctggcggggacgagaccaagctgctggtggtggacagggaaactgacgagttcttcaagaaatgcagagtgatcccatctcaggagcacctgaatggtaagccaggtggggccactggccgtcctggggctggagccccccaagtcagggatgtgagccagggctaagactgctgggtcccaggcgaggggtgggcagcttcccggcatgggtgctccctcctcctccttcatgggaggcccagaggtgtgggctgggggagcgggggcctagtgtagggagtggcagtgggtttctgaggacggcttgtgatggggtcagctggcatgaggtcggtgagagagatggacagatcttcttattcccggccaaagctgcagccccaaaggaggcccaagcccccagtcctgtccccaccagcagactttcagggcagtgtcaatgtgaggaaagggttaactccggggaggcctccagcctttgcttggtcagatcagagtccagtgacgggggccggtgcctccccctccctcctctcaggttgtcttggaaactcagccttgctggctctagagagtagtgggtcccccttcaatccctgggcccctgccctccccatcccccaccatcaccctgccaagcctggcgcctccccctgcccaggcccgagccaaacagggcagggctgctgcaccggggcagggaggggttaagcatgctctgctccttggtctggactttctccctgggaagatggctccctggagcgggcaggggtgctcactgggccatactgagggtggaacctcttgggactttgcagtgggtggggcctcctggagactcaaggttgtatgtgtaaaaggagattcacacaaaggtcctgcgactcccatcgccagctgcaagggcccactggggaggccctgtccccttctggcgcaatccaaggcctgaggctcctagaagaggggatggcccctggaagtccctagctggctctgggcatgggaggtggggtaccgccttacccttatctcccaagttcatggaaaccaggtaactcagataatccccttctccactgagggggagactaaggcccagagaagccccagccttcctcctagggatctgatacgaggaagacacagctggaatctggattccactcagctcctgggatactgtcccctgcttcccccaccccttcaccctgcaggtaattggccccctcagacattcctccctcttctgcctgtctctcgggctagaggggctgcagcctctggccaaaggacctgaagagggagaggcctggggacagtcccctccccgcagtccctccaggatggcatcctcaccctttccatagggaggaatgcccccctctccggctgccagggtttcaccctgaccactgtgagctgatggggaggggacagtgagtgaccctgtgtcccagcagcctgtccttgcccggggaaggctgtgggtgtcaaaagggaggagaagatgagagtcaggtatctctggctgtgtcctggactggggacagggaaaagataaccaggaattttaagctaagagttcagaagaagccctacactgaccagtccctggagatggaacagccacccctgaagccatgtgggacccctaccctgagtgagcccagtgaaggtgaccccagacctgtcttctctccctctgacccctccaggtttcccactggctgggggaggggatacccaggacacaccccttgagccttctcgtcccccctcatttcctgattggcaaataggagttgggattattttctctttttttctttttctttttcttttttttgagatggagtcctgctctgtcacccaggctggagtgcagtggtgcgatctcggctcacagcaacatctgcccctagattcaagtgattcttctgcctcagtctcctgagtagccgggactacagccatgcgccaccacgcccagcaaatttttatatttttagtagagatggggtttcactatgttggccaggatggtctcgatctcttgaccttgtgatccgcccacctcggcctcccaaagtactgcgattacaagtgtgagccaccgcgcctggcctttttttttttttttccggacacagtctctgtcacccaggctagagtgcaatggcacaatcttggctcactgcaacctccacctcctgggttcaagcaattctcctgcctcagcctcctgagtagctgggattacaggcgcctgccaccatgcccggctaatttttgtatttttagtagggatagggtttcgccatgttggccaggctggtcttgaactcctgacctcaggtgatccgcctgccacagtctcccaaagtgctggggtcccagtcatgagccaccgagcccagactattttctctttcagttgaggcaggtactaactatagtctggggtgtggttccaattttggtgtcatcatcatcacctgggaagcgtttggaaaatgttgattcttaggcctgcccactaaaccagaatctgtgctgccaaggtccaggaatctgtactttaacaagcttcccacgtaggagttcccaggtaggaattcccaggtaggaattaggcagccatcctcgaatttcatccccatctgagacaatacattttttaaacaccttgtgacccatcagtgcctcataagatcaatttagtagatagagaccagcaggttttttggtttgttttttttgttttgttttgttttgttttgttttgccagagtcttgctgtgttgcccaggctggagtgtagtggcgtgatctcggctcactgcaacctccaccttctgggttcaaacaattttcccacctcagcctcccaagtagctaggattacaggcgtgtgccaccatgcccagctaattttctttttgtcttttttagtagagacggggtttcaccatgttggccaggctggtctcaaactcctaacctcaagtgatccaggtgcctcggcctcccaaagtgctgggattactggtgtgagccactatgcctggcccagacatttttttgttttttttaatgaaatgaaattaaaaatatcaaagaacactgtagtaagggtgttgctttgtgaaacttttatcacacaaaatctttgtgtgtgctgagtcatcaaaatggcaaacgtaggccagacatttgctcacacctgtaatcccaacactttgggaggccaaggtggaaggattgcttggggctaggagtttgagaccatcctgcatgacatggcaaggccccatctctataaaaaaaaaattttttttaaataaataaggcaaatgtattcatggtgggtggtagtcaaaaaagtttgagatgttgacccagggaacaagatctaataatctgcccaaacccaactcctacctcctctccacgctctattccatccccgttctggactcacctctgctctgtcctttgcctaggtcccctgcctgtgcccttcaccaatggggagatacagaaggtaagggcgggtcccctgtctctttggatttcaatccttggggtgcatgagacagatcagaaggtgctgtggttggtaggatagccatctgactaaggccaaaaccccagggtccccagttccagctccttcttcagctccaagctatagaactgccagaaccctcttggcctctgcctggggccaaagctgtcaggagggagcgggctggctgggcccctctgcagcccgccatcctgggtgacaagcccccgcctccaactccccaccatacagaaggggccattcttccccccaagaacagagcttcagtgtctggccacgggcagccgggcccctgctacttctagtctgggttggaagaacaaagcccctcctccccccttccctgggcagaagggaaagggggtgaggcccggggaagagatggtggggctgggcgccagctgaagccatggaggaacccaggaaggggctgggtgccaagctgacgccccagccaaagccttcgctctgggacaggccgactcagtcaggccacagagcaggaactctgcagggtctgcttaaaggttccccttccctaggagctcctgccagggtacttggcaagggggagggcccttggacccagccctcaaccttctttcacctcatctttggatctagaactttccatccaccttcttctttcaaggccctcctttgctgcttcagggttagggtttcaggattcctggggtcaaatcctggcaaacagtcaggtggaccacatgagattcagggagcaccacatgggctccccatgcccccatgtgtccccacattccaagaagcccctccctggtcactggcccaaaaggcaagccagtacctaaaagccacattggagtggcccagggagagggagcggttcagctaatcccatgatggtctgttcccatcccatccctccagcctgagcagtagaaccagcctgccctctgatccccaaaggaatgtaaaaaggagccccagcaggctcaggaggtgggaaccaggggtgggtggccagggcatcagtgctacctcttctcagtctgaggcccctacttccccaggagctccctccctcctcaggaccccctcaccccatcctctgacaacccacaaccctctcctctctgccaggagaacagtcgtgaagccctggcagaggcagccttggagagccccaggccagccctggtgagatccgcctccagtgacaccagcgaggaggtaggccagccatgcggggggtggcaactgggttacaggaagccgattcccaggccccacttgttcctggcacaccagcctgcctttgaggtcacatgctgagccgcattctgttcttgtgacctggcttccctgggcacggccccaacggagccacctcaccaaggctgaggaccagggagcctaatgagggactgactcccaacttcctgcccccacttctctttacagctgaattcccaagacagccccccaaaacaggactccacagcgccctcgtctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctccccaattactcccctgaatcaatgtacaaatcagcacccacatcccctttcttgacaaatgatttttctagagaactatgttcttccctgactttagggaaggtgaatgtgttcccgtcctcccgcagtcagaaaggagactctgcctccctcctcctcactgagtgcctcatcctaccgggtgtccctttgccaccctgcctgggacatcgctggaacctgcaccatgccaggatcatgggaccaggcgagagggcaccctcccttcctcccccatgtgataaatgggtccagggctgatcaaagaactctgactgcagaactgccgctctcagtggacagggcatctgttaccctgagacctgtggcagacacgtcttgttttcatttgatttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcagaaattcagctggttcctccaaacccttcagcctccgtgtgttccttggaagttttgtcctctggccttggaccccttataggtagaaattgagaaatggtaagccaaggtggtctttggctgggagggtggggtacactggagggagggccatcaagggctccctgtgaccccaagcctgggtagctttagctagagggcctagctgcagtcctgtaggaaggaagatgcatgcacccagccgggtattcagcttggtgtggtcagtgtgcctgtgtgctgggctgcaagcaccgattgtgggctggggaccccttgtctaacggggatatttacaaggggaagtgggagctcagaccaacgttctcagaggactctgggaggttcctttaattccagaagcgtggaaagtgtgtcccaggatggagctgggtttggaatgtgaggacttggctttactctttctgcctatagccagtggggtgcagaattcccaggggcaggctgggctggtgccagatcctctatcttatctggccattgtgacctgattggagggcaagtgtccagtgccaggggaaaacaaaccggtccactgagcccggggacatgctgtgtggctagctggggtggaagggactgttcaagggcaaggtgccctgcccccaacaaaagacccaggtccctgatacctttggcacctgaagcctgatctggaggtccaggaaggtggcttgcaagagctaggctgcagagccgggaggttccgggcaggtgctcaggaggaaggtgcccccaggctagtctccacccaacccaaagggacacctctcagaaaataggctcctgggctgaggggaatgagtaaagcaggtagatctggaatcagggagtggacagtgtcccccaggccagtcactatctggccatctcctgctccttgtcagaggaaccatccaaaacccttaccacagcagtgccctgctcagctgacctgcccccaccccacccttgcttctaccctttggcccctgacagattcccctccacaggggtcgtggagggcccctccctatctcacctgctgggtggggaagccctgggggacctttgactcttcattaacctgaagactggtggaaggaatgggtggccccaagggaactctcattgctgaggtacacatggtacgaagggagccacggcaagcaacgcgttcgttttataatgtttgttttatactgaggcatgttttcggttccagttgttcacatgcagtctgctgtgagactccaagatcaagggtgctgggaggccttaggcaagtcaccttacttatctaagactgtttccccacctggaagatgccctacaagcctcctgtggctgtgtttagaaagcatgcccggcctttcttgacagccagccaccccagatgatggcagggcaaggaagactgttaggagtcagagtgctcccctcaggtggaaggaaactgggccaactctactttgtaagccatagggtgccaggtagcccggccaccctgagcctgtgcctccactgcccccgcgtggccagtcaggtgcagctgctcccagagatggagggtgaggaacagacgtgggagcaccagagggacagagctgatggcctgacgctctcttcaggagggcacccccaaggggcctctgcttcctcagtgccccctgagctttatcagcagaggggtgttttccagccacaaggagctgtatctaacactaatgcctttaaactcaagactggctccaggagagaggaggacggacactaggttgaggggccaggccacactcactctggaccacctgttgttcccgggtcaagttcccagggtcacaccagcctgcctctgcaggacaagaggaccaagctgcccttgagtggacactgtgaggctggggcttgtggtagctcttcacacggaccaaacgggaaaatcaggaaagctggtagtgcctggagcttcactcccagccagggc

SEQ ID NO: 15611 - DNA, 14519 bp, Human
ctgggggtataagagctgagactgggtccccatcctcatggagcttatagtgtagtgcaggggtggtcaaactctgtaaaggaccagatagtaaatatctggggctttgcgaaccatatgatctctgttacaactactcaattgtgccatcaaagcacaaatatagccatagacaatatgtaaagaagtaagcatggatgtcttccaataaagttttattcaaactgaagtctgaatttcatgtaatttttacgtgtcacaaaatgttgttttttaccattaaaaatataaaaacaagctgggtgtggtggctcactcctgtaatcctggcactttggaaggccgaggtgggaggatcgctttgagttcaggagttcgagaccagcctgggtgacatggcaaaaccccatctccacaaaaaatgcaaaaatgaaccaggcgtggtggcaggcacctgtggtcccagctactccggaggctgaggcctgaggctcgcttgagccaagccaggaagcagaggttgcagtgagcaccactgcactccagcctgggtgacagagcaggaccctgtctcaaaaaacaaaatcaaaaccaaaaacaaaaaccccaaaacctccaaaaaaacaaaaacagtaaaagccattcttgttggtcatccaaaacatgctggtggacagtatttggcctgcaagctatagtttgcctactcctggtctagtgggacaggcataaaacacagtgacctattagaaagcagacagcatttacttaccagtgggagggaggggaagtgaccagtaagggcacagaggactcctgggatactggccatgttttatttcttgatctgggtggtggttatatggttacaccttgtgatatattgtcaagttgtacactcatgatttgtgcacttttctgtatgttattattgaatttaaaatctcattaaaaacgacaaccagtgtagtaagtcatgatgggataaggtcagatgctgtggaatgagaggcctttaactccttggaacttgggaggggacgggtcagagaaaaggcttctccaaggaagtaatatttgacaagagggcccatggggaaaaggaagaggggttaggcttattgggtcagctgtgactacggatcctgtccttatttttaaaaacattttgatcatagactttttgcattacttttgaccttttaaaacgttgcagtattatatttatcttgattactgagtgttttggagcccccttaaattctgaacccgaggggagtacctcaactctggtcccggctcggctggctgcacgggggtcggacgctctgtccttagtaccatacgtaagccactgccccgccccgcttttcttcacctatgtaatgggaaaggaggtgaggtgggacgagctttccagggtttaatattctccctggcccggcaaagacggggatttgaggggttacatcggcacaacacccggggtcgaagaaggaggctgctgggctccgggaaggagctccctcgccccagacttccgcactctggttatttcccaacggcgggaaggctcgcttggagccggactcgtgattggctaggacgaagtcacgtgggaggattcgcaatcaaatggcaagggcgtctgcgtcatcagtgagcgacgagagcctcccgagaggggcgcggctaagtaaaataagctcctttcttagtggctgtttccttggggagggactgaaacagcgatggggattcgctctcttccaaccctaggcttccgggatttggagggaaggtgaggcctggggagaaatgtattaaatcgcgtataccccggatgctccgaggggcggggcttcgacggtggggcgtagttaagggcgggtctctcttttgggggcgggattctctcgggagtcggggtggagccgcaaggctccgctttcccggagcgcagggggcggggtttggggcggggcctcgcttgtgggcgggcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagtaggagcagggcgcctttggggctggatgggagcgcggggaggcctgcgagcgctgagtaggggtcggagcagagctggggcagggctggagaagggtgagactgaaggggtgtcttcctgctggcgagatcccggtggtgtacgggggtgggcggagatctgtgcgtgagatgtgaggcttctagggttagagacggaggtcaacaaaggtgaaaaggagagactttgagatctacaggtgtgagacggggtgaatggaggatgatacggaggtctgtggggcgagaggaaagtctgagtcgaaacagggatctgtaggaataagacgggtctatatgggcaatatagcgttttgtggagagagagaggggttagaggagggacaccgtggggagacccacgggggcgagattgggatgatatggaggccgttggaaggatgtgggattctagccgattggatagggaatgaagtgttgttgggcaggccattggcagtggtgtagtaggttcatgggtgagatgtgggctctggatgaacccacagcctttgggggttcagatgaagtaagagaccctgcaaatgccaaagccttgaggaacaagagaaggaggatgcaggtgagggtgaagcttgggaagttccagcttctgttggatattcaggttggtttgggactggggagagaagttaattttgaccttttccctctcctctgcctggccccaggcttctgccaccatttctccacacaggagaagaccccccagatctgtgtggtgggcagtggcccagctggcttctacacggcccaacacctgctaaaggtaagccacttactcatagtccatcattcacctgctgctccagtcctaagggcaagcctcacccgctttgggttttaagagcactcctggttgccttatggggaaggggctcccagccatctggcctggacacttcccacttgcttcctcacctacacctgaggctcccctcccctcccgtcctcagtgtgacaggggtgtaaaacgcacattggtggtgagtggtcagtggcaggtggtcagctttgcctccctggccaagcactccagggggcttatgtagacctgcaaaatgactttgtcctccttcatcttccctcctctctcgtctatcttcactctatcccaaacatcctacatctcgaggctacccacctcctccgctttctgtaactttacctgccttgccatgccctcctcacccatagctccagtcctccgtgccattctgttctttcagcctgccctctgcccctcccccttcccctgtgaaggccaggatctcaaggctttcagtgtctgcctcggcaggaagggccccaagccaaggctacaggttctacttgagactccacatcagactttgggacagagtagagaggggatacccaggttaactgagacgtgagacagttgcctagctttggagaggcttggagtgtccgtggagagacaagagaaaggatgaatatcttaattatacacacacacacagatgcttgaaatgtagggtgaccaactggcctggactgcccaggacaaggggcttcagcgctaagctggaagttcttgggaaactgggatgagttgatcactctgctgaaaagtgacccgtgcatgcttcccaggcaacacgggtgaaagagctaattacaataatgtgggcagcgtgagccgaggcaggtggggtcaatcagaaactgtttcctgggccggaagcccaggtggctcatgtctgtaatcccagcactttgggaggccaaggcaggtggatcacttgaagtcaggagtttgagaccagcctggccaacgtggtgaaaccccatctctactaaaaatagaaaaatcagccacgtgtggtggcacaggtctgtagtcccaggtacttgggaggctgagtcgggaggatcgcttgaacccaggaggtggaggtagcactgagccaagatcaaatcactgtactccagcctgggcgacagagtgagaccctgtctcaaaaaaaaaaaaaaaaaaaaaaagagagacagtgcatttgagctgccttgaagcagaccaagggctttggtgagggcctcccacatgtggggagtcatcctggaatgcaaggccttgggcacgctgccatgtgggagggaggacagcctgggctctgggatggagatcagggagcacatgggggttggagaggccctgaagggctttgtataagggacagtttttttttagctgagcctgacattttggaagggaggagagtaagctttccaggcagtgttcttttttttttttttttttttttgagatggagtctggctctgtcgcccaggctggagtgcagtggcacagtctcagctcacttcaacctccatctcccaagttcaagcgattctcctgcctcagcctcctgagtaactgggattacaggcgcactccaccacatgcagctaatttttgtatttttggttgagacagggtttcaccatgttgatcaggctggttttgaactcctgacctcaagtgatctgcccacctcggcctcccaaagtcctgggattacaggcgtgagcccccgcgcccggccaggcagtgttcttagcacgactgtattcagctggcagacacgtgcacatgctttccttgtggaatgggatggggaggggctcaggccaggtacaatccttgttctgatccttgggctgatctttgcccacagggagctccaagctactggctgtgctcctaagacaggaccacatgcagcacgtttgggacagtggcccttagcttgagtcaggcactgagcacagcatctcgtagcatcctcatgacaacctgcaaagcaggtgtcgtgcctcttgcttcacaggtaaggatgctagggccaagtgaggttgtccaagcttccaccgtggagcagggatggcactgggatctgagcgaaggcagctccatgtgaggccatccatgttaatccattcagtaatcatttactggacgtaacatgttctgggcgcaggctttactgggaacatgggggtgaacaggacagacgtggtccctgtgctcgaggacctgacattcgaatgtggaggggacaggtggataatttacaaggtattttagggctctgacggctataagcacagagactggggtgcggggagggggtccatgcctagtctggagggagagatgtcccaattgcagtctgaaggacagtagatgtcaggttgggggacaatagcaggagtgtcccaggcacagagaactgcgtgaacaaagaggaagagaatggctctctggggaaagggcaagttctggaaggtgcctgtgtgcagtaaggcgtgaggaggtgagagccgaggctgagaggtaggtaggacccagatcctggggggcttggaagccattgaccaggctctggaggcaggtttcgctgggaggtgtccacagctgcctcctcttccccgatcagagtctcccggggcatcttatcaaaatgcacattcctgggcctaacttggacctaatcaaactctgtggctgggcccaagagtcagcaatgttaaacaccccgaaggattcttgtgcccacagctgtagatggttggcttcactggagagttttcgggctgctgttttccttcaggatgccccctctgcctgcagcgtaggtccaggcagggctggtggccagatggcagtggggagctgctggggttgtagtgaggaagaggactgggaggatgggggattgatgggatcaggtcgggggtcagggaggagccccaggttccagcttgggctctgagtggatggggtcgagggaacaggagcagaagtggggagcggtttggggcaaggggacttggcttgaaactggatggatttgagatgtctggggtgggacatccaagggtctcaggtttggagcttggggagatgtctgggcaggagagagagagtagaaagtcatcagcaagttcaggggaatttggggtcgcaggagggagtgggttaaatcctcagggaggagggaggggggccaatcggaagaacctcagagaatgtccttgttagcggggagcagctagagggacaggagggagggaaggaaggaaggaggaaacctggaagatgaggtcagccacgagagataaggggtaagaacatccggcagacttagcgttccggaggtggccctggagaggacatcgtgacccagagtgaaggatctgtcgcaggaaagaatggaagataaggacagagaggttggttgggtgaggtgttgacctctaggccgagcagtttgaactttatgctgtggcactgggccccagcgaagatttttgagcaaggcagtgacatacaacaacagaatagtaatgatagctctcttcttgattgaacactcagagtaggttgcaccccgggctgcctgattactcatttaaccttgagcaggacaccacagggctcttcttttggacagagaagaaactttccccagtgcacagagccagctagtgctggagctgggactggcatccaaggctacctgtttgactccaagcccagagcgctttgtgggtacaacatcgtggggcttgagggaggtggtttgggtagccccctgtggctggcctgggatggagagaggcaggaggtgggggagggtggacttgggtgcaggcaggggagtggaggggaaggggggatttgggcaaaggcgaagaggtgggtgggagcctttgttgggggtagggagactgatgggcaggggcttctttgccttgagtcccagtgaagctggaggtgtcatagcggggacctaagataggatggggggctgggtgtgtcagctgtgggacccctgactgctttactgctaaccggcctgtggcccagagtctcaccatcctgacctcctggtgctttccagcagccatgagagggagctgtcatccatcctagtgtgcagagggggagactgagacttggggaggccctgggacttgctgggatcatgtggctggttggtggcagagccataccagacttgcctgctggacccccgaccctgtgcctttcacacggcctctcaaggtgccctgggaaggcggtcatgcagaaccagtgcctgagactgtctttctaagagtgggagcaggcccatttccacctctctttcccgtgaattcccagccgtgccccctccctgtcctgctgctcccctttccccagagcatggtcctgggcactagagctaaggcacctgtgaattcagagggtggccctcaggtcctcagactggctgggacctgagggtcccaagtgtcgaagggttggaggccagggctgtgggttgtgcttgacctgagaagataaagaagccgccctgatataattccagtcgggggaagccacggccttgtcagctggccacatttctccccatctccgagggccggccgtcgtcgtctttttttttttttttttttttttttttgagacagagtcttgctctgtcacccaggctggagtgcaatggcgcgatcttcgctcactgcaacctctgcctcctgggttcaagcggttctcctgcctcagcctcccaagtagctgggattgcaggtgcctaccaccacgctcagctaatttttgtatttttagtagagacagggtttcaccatgttggtcaggctggtctcgaactcctgacctcaggttatccacctgcctcagcctcccaaagtgctgggctgacaggcgcgagccacccaaggagtgagtgctctttttccttgcagagggtggaagccttgtgttctcagcccagggtcctgaactctcctgctctgtctggggaaggggaggacctgggggcgtcccagcctctctctctcgaccccaccagctgccaccctgttccccagcagcacccccaggcccacgtggacatctacgagaaacagcctgtgccctttggcctggtgcgctttggtgtggcgcctgatcaccccgaggtgaaggtgggtgtctctgggcctggaggctggggtttggagactttggtcaagatgaggagggcagggaggctccctggctggatgacaggacttcatgccatctgtgcccatgccacccagcttccctcctggggacacagagtggtgagggtggtgcagacttggtccctggagctgccttaccctctaacccctcccattcctgggggacctggcagaatgtcatcaacacatttacccagacggcccattctggccgctgtgccttctggggcaacgtggaggtgggcagggacgtgacggtgccggagctgcgggaggcctaccacgctgtggtgctggtgagtgcagctaggccctggcttggggaggcaggggctgcagaaggaggccggtggctcggggtggaaggcagcaggggtgaggccaggatgcaagctgctgagaagctggaaggaggccgctgggagcctggggggctgcccggcctatcagtgctggtgctgaaggctgtgggtctcgggcctgccatctttcatcagagctacggggcagaggaccatcgggccctggaaattcctggtgaggagctgccaggtgtgtgctccgcccgggccttcgtgggctggtacaacgggcttcctgagaaccaggaggtgagtatggggagcacgcccgctgcctcttcctccccgcccctcagcccttggatgccagacctgggggaagagggagctgccatccagtggcgagatgtgacattgtgctgactgaggcgggaggccagctgtggagggcctcgggggagagctgggtccaggtgggggaggagggaccagagttgtggactttcccggtgtggggaagccccagggcacagtggggaccaggcatgaggcacctgcagactgagatgagctgagtggagcgaggccgggggaccctatcaagacctttcccctccagctggagccagacctgagctgtgacacagccgtgattctggggcaggggaacgtggctctggacgtggcccgcatcctactgaccccacctgagcacctggaggtgagtggtaggtcagggctggcggggttggaggtggggtcaccctgaggagagagtgcccttgtctgcagggttcaggccttacctctccaagctgggctcagtgcctctgtttccccgtggtgcccaggcagaggctctctgaagggcagtgccatgagcttcctcttctaccattttcccttcactttctgcactccagctaagtggcgtttttctcttactcttcagtaagccacatcccctgcttggatcatccccactcacctcccaccagttaacagttaaagttcatctttgagatcttggctcggttgtcccttcctccaggacttccctgaattggtccactcccccatcgtgcctcctcccatagacctgtctacttctgtttcaccgcatatcatcgccacggcaattttacacacattgatgagtatttgatgagtatttctctccccagcagatcacaagctctgagagggcctgctccttgtctcttttcctcaccattgaccaccccgcccctccaagctctttgcatgggggtgagcacatggtagaggcccactacatacttgttgaatgaaagtgtgggcctggtgtgctattagttggagccatttgcagagttggcagcaatgctccatctggccaccaggggggagcagtggcgcaattttgagccgccagccttctccaggcccacggtggggacatgaccaaatggagagtcccctttcctcggtcagtgtctgatgactccaaggccctccttttgtgccagagaacggacatcacgaaggcagccctgggtgtactgaggcagagtcgagtgaagacagtgtggctagtgggccggcgtggacccctgcaagtggccttcaccattaaggtgctggggccagagtgggaggagccagggttccaggtggagggggcctctccttaaggggttggggtggggcagagcccctgggagtagctgctgcctgggatggaagaaggggagcagtcagggccccgggggccctgtgcctttggggaggaggcgggtggtggtctctcctgcctgggctggaccctggggtgggctcaggtggactgtgttctgggcctgacctcctcccccattccctgctcccaccttcaaggagcttcgggagatgattcagttaccgggagcccggcccattttggatcctgtggatttcttgggtctccaggacaagatcaagggtgaggggccctggcctggccccccaactactagggagagggtggcctaggtcagagagggattggggaagggcatgcagggagagggccggggcccagggacagcctggagacattctacgttgctgacagaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggaggtgagtctcatgtttctcaaagacacccccttcccaggcctctgccacccgcctggtgttgcccacactctccccaacagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggtgagagggtgtgaggaggctgggtgctgaattatggtgagaggccgagaagctggtatctcctggggccatgcgttcattcatctagcaacatgtactgagaagcttctgcagggcaggccctctctaggacccagtgccgccctcctcttggccctgagagaagttccagtctggctaggacatatgtgacatacgtcgggtcattaagtcattcaacaaacgtttactgaggtcttttctgggttaggccctgtgcttagtgctgggattggagattaataaggcagcctgtgtcctcagggagcgtccagttttactaagtgcccacatacctatctagtgattaattcacttggtaaacatttaccaagggcctactgaaactgcaggggagcaagcctcagctcctaagcttagggatcccctcatctacagggaaactgaggtgtaagggggtcggcctggtaaaaacagggagagaagaatccagggcagtggaccagcggccacagcaggctcagccgacagtctgccaagaggcgtggggtgtctgtgtgcgtgcacgtgggtgtagattgtgggcacaggatggccagggtggtatccagccacctccctcccttccccttttgttaccccctctcaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggtctgggccccgatgctgaggtcctgggaggtggggtgggtggtccttctctgggcctcactctttgggagggggctgttctgggaggggtgaaggaggaggtgttgacaatctcccctttgcttcaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaagagccatggttgatgggggactttttttggaagggttggggtcgggggtcaccttctggccgtagctcccctaccatcaccaggtggcgctgcagagacggctccctgctcaggggcctcattggggcttgatggggctcggcagccaggcctggcatagccacccttcctttctccgctcggccctgctgtggctgcgggttgcctgtcttctgtccacactagggctgcccgggaccgggaccgggaccacccctccctggggagccctcagtacaatcaaaacagaaaagaaatgggagcgggggactgagaagcagcttgtcccctgtacctctgggtgccccaggcgagtctagcctggggcccattctttggctctcaaagccttcctgcttccgtttccagtcagacacactggcctttaaaaatagtgcctcagtctccctagggctttgcagtgtccagagagtggtcactcccttttatggcagccctcaagatgctgcctcgctgtataacctgaggggtcctcgaaattggcccaaggtcacacactcgtgagctgcgggctcaaacccaggctccgggcaggctggtgtgtcctccgaggcgcacttgccccgagtgtcaggtctggggacgcggttccggagaggggagaggggcccgggaatgcggcgggaggggcctcgaggggcagcgggccgggccgggccggggcggaggtggcgggccccggcggggcgggccctcgcgggcggcggtgagagctcccgcacagtcggctgcgagctctgggagcaggaggcgcggtgcgcatcccatcccgggacggagccgggcgccgtgcgatcctcgggagggttcgcggggcgcatgggcggggtcggggccagcggaccatgccgcgccacccgcccccgcccccgccccgccgcgcccgggctccggcgcccgcggagctgagactgagcgcgccagccctccggggccgaggctctgggacagacaccgcgagggaggcggccggcgcgggctctcgtcgcgggcgcagcgccccttcccctcggtaagtggcgagcggcgggcgaggggcaccaacttcgccgccaacttggggctgggttcccgcggcgcgcgagcaaggacggcggagacagaggcgggacacccggggggttggacccacgcaggactctcggggctcaaggagggggcggctggaggacccggaccctcaagaacctggccttgggttttgacccgggcggccggagagaaggcgaagaagaggccgagcagacaggcgcgcggcggacgcgagagaaggacgcgggcgaagcgtccaagacgttcgtccccagggtcgccgagccctcctcctccttcgcttggcgcggcagcaccgcgggaccaggggagtctgggctgccgcggacccaaactgttgctgctggaagccgccggggcggagagcggggaacagggccgggagtgggggccggggctgggatccaccagagcgaggggttggaaaggagtcgagaaggtgaaagggggctgtgcggctccccagcccagtgccccagtttccctaggtctgctgggcacctgctgcgcactcgcctcggcgcccagaccccttcccccgccgcgagtcccgcttcttccccttccagctctgccccatctcctttgccccagcctagctctctccttcctgcgacctgggagaatcggagtgggcttccagagtagtggcatcttgcagatgctggcccgtgcccggctcccgggcttccagagcgcaaagggaagggtaggcagagagggcactgggcgagcaagacctggcgctgggccctggctgcgcaccagccgcctgcgccggtctctgggggcttcgcccaggatccccgacggcggggaggggaagccccgagtctcctgtttcctgcctacgcgggcagggcggggacacgcggagcaaaggca

SEQ ID NO: 15612 - DNA, 14519 bp, Human; identical to SEQ ID NO: 15611

SEQ ID NO: 15613 - DNA, 22914 bp, Human; identical to SEQ ID NO: 12489

SEQ ID NO: 15614 - DNA, 9510 bp, Human
ttcgccattttggttttggtgggttttggctggctcctttgctgcaacctgtttcatcaacaaggtctttatgacctgtattttgtgctgacctcccatttcatcctgtgacttagaatgccttaactgtctgggaatgcagcccagtaggttttaggctcatcttacccagctcctgtttaagatgaaggtgctctggttcacttgcctctgacgatcccagcactttgcgaggccaaggcgggcagttcacttgaggtcaggagttcgagaccagcctggccaaaatgatgaaaacccgtttctactaaaaatacaaaaactagctgggcctgtaatcccagctgctctggaggctgaggcagaatggcttgaacctgggagggggaggtcgcagtgagccaagatcacaccactgcactccagcctgagcagcagagtgagactgtctccaaaaaaaaaaaagggcggggggtggaattccaaacaccctcttcccccaagaagtgattgtattaggaagttaggaggtggggccttcgggaggtaatcaagattagatggtcatgagggtggggccctcacccatggagattataaatgtccttagccggcctgtctcacttgttcagaaaccggaaaagtccgtggtctgcagtgtggaaaagggcacccggacctcttacttccagcctctagtctggaaactttgtctaaggtaccccatctacattacttagtcacagccaccctgaacccactagcctgtactgcgctggagcatttcgcataaaatgaaattaacataaaaatgacacgtgctcgttgtggaaaaaataccaaaaagatcacttttaattctgtcatctaaaaataaccaccagttacatttataaatttcttccagtaacttttttatatgaacatgtttttaaacttgggtcaatattaaaagaccagaagttgttaaacatcattttaaatccccttatccaggaattagcattgttattcttggccgcagcagaatattattttattccctcaagctttccatggcttgggtctgccctggttttgaacattaggttaggctacagaaagcattctgggtctctggcccatttgtttctttctttgtggagacggggtctggctctgttgctcaggcctgtctggaactcctgggctcaagcgacactccacctcggcctcccgagtggctgggaccactggcgcccgccgccaccgcgccggctccgggcctctctctacgcgtggctccgcaggctccattctccacacagtcgtctaggggggcgccaggagccccgcgacgggccaggccggaagctcagcaagtgcaccaggcggcgaaacggccggctgcgcagggcagccccggacacagccacgccgcggccgcccggcgctcccccgacccagccgaccacgaagccgccctccccctcacaccgcagaacctttctgccttttactacttttcaaagtggacctaggctcctggctcgagcctgaggggatacaagggatcacgaggagcgccatcaccgtgcaaggtcgacagcttccgctcaaagccctgtggcccacgcttccggcctcgaccgactacgtcatcaccaaaccccgtgatacctcactccaccttcaggtcctccgtcccaacggttccgtgtcctggaactttccacgttcctgcgcacgcgctctgcggcccttaacgtcccgacttcgccctcctctggccacgcccctgcccgttaagggccctgccacccccgtgacgtacctatcttccctcgggcaacctcgcaacagatctctgattggctgacccaggaagcggactttgcgaggcggcggcgacgataggctggcagccggccgacttccgcagaaggtgattggtcggcgctgctgtccaatcggcggcgggctgtcggattcaaatccggatcgttgggactgcggtcgttagtctccggcgagttgttgcctgggctggacgtggttttgtctgctgcgcccgctcttcgcgctctcgtttcattttctgcagcgcgccagcaggatggcccacaagcagatctactactcggacaagtacttcgacgaacactacgagtaccggtgggcgcctttcttagaccccgagccggctccctcagccggggcccccgcgggcggggcgacccaggcatagtagggtcgggggtgggggccggggcctggggggcggagcccggggccggagggcgagggccggggtttggggtcgcggccacctggcgccccgcgcagtcggacatggttgggtgcctggccgcgccgggccggttgggcctttgttcggtgtgcgcggagggtgagggaagagtgcccaccgggccgcatttagtacctgggtaggaaccggcgcaacttgggggtcatggggtcctcggcgacgcggagtgaccatcccgtcacttttttctcggccgtggccgaagtaattaggccgttcagtagctggtctcagttccagttctttgaaccagtccaggaaaacccacctggtgccgtcctttttcctttagcaaccgtgacacactttccctgtcgctgacggggtgatgcagcttttactagtttgtggtttagaatggtcaaatggtcattttcatctgttaacacagaggaacacttttctttttcttgtttttgaagtgagtggtataagaataagctttggaggcgaccccccgaaaaatgagcttgatggggattcgaaaatgtttactgggtatggtgatttgggccattataggttagccgcagtcatacaattgagggtattattaaaggagtttcattttaaggccgattaagaacttgagtggactttgggcatcattttctgctagtatacactggccaaattttgggctttgagaaacttttgcgtttgagtcctgaagcaccgtactagaacatggtggctgtaatcgatcagtaaaattagacaaattttaaatgtccctgtccccttccccccaattaaagtagattgggggaaagcgagtagggacatttaaaatttgttgtccttactgtatgcgggacacttcatttagggcgtggcttcagaaaacagtcaacccctttttcttaactaggtagcgactagaacgctgcgttctgggatactaccaagatttaggggagataaagcccatgccatcgttggccaaattgtgaccttgttttctgtctgctgcctttgtaggttagatttctccgaatgctatttaaggaagaaagaacaaaacagtgggtggtttctctttttctccccctccctagtagcatggaagtctgttttcacatgaggactactgaatatttctatgggtagtagtaattgcacccttttgtattcctagctagaaaaatagcatgtttttctggctgtaggtaaatttcaagtagattgtgttaaccttatagtaataataaactatactcgtgtaatatgctggcagtgttcaattatgcgatgttaatcaagagccctattgaggatatccaataatgaacacaatgtaaaccgtaataatcttactaaaacctagaaaattattctgaaacacatctggtgccaagtgtttaggataaggatttaagggtcggtacaagtttcttttagggtataatattgaaaataaatgaagctatttctcagacttctttctgatggcagtaggtcgattttttagttttaatatactcaaatgatttgtgtgtggtaatgtatagaagaaagtttacatatctgaagtgatgtattttaatccaataaaaattagagctggtattaattggccaagccagtaacctttatgaaacaggatagtaatttccacacataattttaaaggggaaactagtaataatatagcactaaggcatgagtctagggtggtttgtattaatatgtaatggtgcagcatgcaatgtaaatttcaaaggctagtatttatttttcccagtgtgcagttatctctatctttctttgatttttcttaattacaaacttaatttcctagtccttttacgtgagggtcttaatgtttctaagggcataacagtgggtgcccccacccccacatcatggaagtctgttttcacaagagaaaaactgttaatttttctgggcagccttacaaattagtaatacttgcactattttgcatttcaactgaaataaacgttagattttggaaataattttccttacatgtagttagtttgaaatctctgtgtggcaaaatacaggtagaatcctcatatggggttgatgctacttaaacatttttcctttataaagaaaccctgatggaggagagcctgtttccgtgtttatggagaagggtggtaacttctatctaaataacttgttggtagatttatgtactctgtaagtttgatagaaaaggtacaaaagcactacatttctctttgagaataatcaacaagatagaacgtagaaataagataacagattatttgaagttagatgttaaagcagcatttcaagaatgtgggtgataactggtaagaattacaaagaatcactatatagttcactggaattgatgaaaactctacaaattatggtagtaagctatgacttggtggccttaaggcaatctaacaacacagtagaatttttctgaggctcactttgccctgcaaataaattggtacttaaccacagactaaaatttaagttgatgacagctgggtgcttatagcgggttagggattcagtttactgtgtctcagaaagtgaccagattgcacctcattcatccccagccagctgactcacagacagatatcttatactggttaaaaatttgggttggtggttatggatggttcagtataaaactgttgctactactgcaggtggtaaacatggagctgagaattgtgactttcataaagtcctttttatggtaattgagtaaaaattcttactcaatttggggaaagagatttgttaggcaaatctttgatagaatgctttgggatactgttaatgatacagatttgtttttgagaatctcgtaaggctacaattatacatattgatggtttaactttgaaggttattccatgcttgcctaagaaactgaacaatgtaagttttggatataggtcagtaaattaactggaaaacggtgaggttgcacacaatgtgtatgtacagttagtggttttctgtttttaattttgaacaaagtacttgaagtataaagcaacttctggagcatacaaggactagtagctactacaaagctagtgttgagtaagaggaaacccaaattaactgtaacttagattttttcgttacataaaagtctaataatctggggcagggataacagctttacagtcaaggactaggctgggtccttacctcttgttgctttaccgttctcaatttacagttgcttctatggtcctagattcctgctctggctccctgatcatattaatgtgcattcaacaagaaggagaaaaagagttcagcatgttctttccctttgagaacacttttcataataagttacacattttcttatatcttgttggcttatgatttggaggctggtaaccatatgttcaacttatattttggggttctcttcctgaagaagattaaggcaactggtaagcattctgtgataagagaaaaagattaatcctatggaaaatgctttctgcttttggattgtgcactcttagctccctaatttgaacataggccatcatatcagaattaaaggtagtagattgcagttctcaatattaaagcaacagagttccttaaggtacatgtataaagcgacagttgtagaaaaggcactggactaacacttggctgtatcttgtaacaggcatgttatgttacccagagaactttccaaacaagtacctaaaactcatctgatgtctgaagaggagtggaggagacttggtgtccaacagagtctaggctgggttcattacatgattcatgagccaggtaagctatgctatgttatagtaaagcagtaattgttgaaatattggtggttatggttgtcaaaattttaaaaatatcattgacatcaaatgatatctgaaagtaactgttctgataagtttttttttttaatgactaatttcttgactctggagagagttccaattttatggtaaataaaataccacagcagtgaaagtaacacattattctacttggaaaataatgtaagaagtaaaaaaaaaaaaaaaaaatgtattttaaaatctgtatcattgttaacagtatcccaaagcattttatcataaatatatcctaagacaagtgttcttatctatgtgtggaaattgatttaatttaaagtgattcttcagccctctgaaaggatatataccacatgaagtttaaatgaggtaatagcatatgaactcaactgtgcttatgggtaccttatgctattatgtggtattaaccaaaagtttttcaggtgttaaatagtaaactctactaaaactttgtgggttttctagactaaaacagtgtgggttaaattttatatttggattatcagtaaatctaacagcatttataatgctttgaacaaaatttgaagacatactatagaagctgaagtaggtggaattaaaactatcttctactctgctgttaaagaaaagcattgcatcgaaaactctaaaaggactcatcactttcttgggattgagatacgtaatcctattagaattcagtccagataatacaaaagcaactgaagaacttaagtgtagatttctgtgccccacctattgaaacagaatctatggggatgagcattagtatgagatcctgtaggtgatttgaaggaggtgtttttccctataaagaggtaatctttttacttttaatctatttactgtagacagtaactgtgaaaaaaaaatcattttggatacctcaaaccaattaatagtggacttagtttattttattctggcttagttgagaatacttttgaatttctgttgagtatatgaaaatcatattaaaatgattcaaaacattttctttccacagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatccttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttatcactgtttcaagtttttgaggtatattttcttaatttgtgactattgaaatttgtgactattgaaattgatttcagtgttatagttttagctctgaggaagttaacttaccttaaagatgatgttaaatgagtttaaaatagtgcggtatgatctggataccatttaattcacttaatgaagaaattaattaccagggatatgtttaaactaaagccaaagtagattttacctcttgaattcctggagaattgtctagaacaggaaagcccaaattaatactatctgggctacttcactggccactggtggtcttgggagaaacctcttttttatcctcttctacatttccaaagtagggataatgtttcctataaagtatcaccacatttttaaaagttcaaaaacactgtaaaacacctttgcctttttagctgctaggaaagtgttttggagttattctaattaattgctatgctatagaaacatcttaaatgagcagccagcatacatcaggtccattggttaagaaagggtgtctttacacatgagggcaataaattttgaaggttgtgattagcagcatcctaaaatctactgccactaccataggttgtgtccagggtaaccaacagaaacatgacaaaatcaagtaaacttcattacacttccgggtagacccaatagtgctgaaaggaaggcgacagctacccctaaacttccagcataaattcctgccagaccagaccctaaggatcacttctgctagaggctgtgtagtgaactgagacccaccaggacagaaatctgaaaaaactggagctgcacctgccttacttgcttgaaatacttcgtattcaatggtagagttaacgtctgtgcaagggacagaggaaacctacaatttgcctcaacctaatccccattcctcaaatagcctgttttgctgacattttctgttccttaaatccacttgcactttcctccaagcctttgagtgagaggaaagttcctcctccatctattgaaatccactctgcattcttccctgtacttttggtcaacctcctatccctgccgcactttatacatttctctcaatatttaacgaatttgctctgtgtagaactttttttttctcgtgaaaattatactattccatctcttgaccatatcttagcactttttttaatttttgaaagaaaccgagcgatttttaaattattttctgtggctacttccaaacttaaggtttctggaaatttaggataccatcaagagtcttgtaggctttccaggtttgtaggacctacagggtatgcaattcctgtaagtcaccaatcttggggaaattttagggaaatgcagtggcgggggtgagagtaatctcggcctcctcagtttccttattagtaaatctttctcttcaggtgactgctcaaaggtcacctcagcgagaggcctttccagactaccccatcccgtcctaacgctagactcgtgaggcccaggggagaaaagtaaatcacggcctaactcttgtttatagtcgctactgccttggtggagactatctccgatatcccagcactaaaaggcagatccaagactcccgcaagctacggtgggtccccagcccagaggactcctgggggtccccattttccgcaagcgccccactgcctccacgtgctgcccgcgcaggtccagtgccgccgccgcgtacttccggccggaagaaagggcgggctctgtcgctttgctgtgacgcacttcctggcgtcgcctgcgggggcggaaacgctttgtctgtccggcaagccgacggcccgctgctggcctccgtgacgcggcctcctccgcgcctcgcggcatggcgtcggaggggccgcgggagcccgaaagcgaggtaagggccgacgggggctctctcggcagcctcagtccgtccgcctgcctcgcactgggggctcggccgggcggtgacggggctggtccagcgggc

SEQ ID NO: 15615 - DNA, 5543 bp, Human
ggcataatgccgcctggctccgcttccccctcccctctccccccgtccttaggagacacctctggagttcagaaatgctaggagagcaagctcttcattcttagaatccaggaagggccgggcttttgcagctctcctctgccaggaagccgctggggggcgcaagacgccagcttctcaccttggcagaagtgcctgcctgcaagcgcagaatggaaacttccccataacaaattcagaagtaccttgtacattcaccacccacctgaagaaagcctgaatgaaaggaacaaagccacggcgttgtttactttcccattatcgccccagtcttgcggcagggcccgggtttccatccaatccacccggcccgccactgtcctggccagtctccaaggcttcacccaaaaaaaggaagcaatgaggtgtcccccagcgcgccttttcacgtagcacagaaggtgctcagtgggtgaatcctctgaaagtgccagcgtgtatggtcaaacggcagcaacctctagcctattaaactctcccaagatctcttccagacttattccattgccggaaaaaaggctttttacatatgcgcatttaagtaattaagatatttcaacatggtataagacgtaggggctcttactccatcagtactggatgggaatttccttttgccctctactccccagggtaactgcagtcccacctgaatgcgttttgcagcccttactcgggttctatttatgcgcagcttggacagggctcactgggcccggccgggcagctccgtggccgtccctctccaccgcccttcccccgcgccaggccaatgcaagggtgtgtgtgttgggaggaggggaggacaaaaggggttcaggatctttttaacctgcctgcagatggcgccccgggaaagattccgagctgcattccctaagctccaggggctgcagccgcggggtcccggccacagggcgtccagccgcgaagactgcacagcagctctccgtccttcccaactcgcgcggctgttcggcacccgtgcgaggaacggatggaagggaattacatgtagcagggccagtactgggggcgtgcactcagggatcacggagtggcactcagcctcgaccccacgcgccaggcagcccggcgacccccacgcgcggcggggtcctgcccaccccacccggcggcaggtggacagtgttgctatgaagagaaagcctcgattgtccctacagcaaaccgccacacgccagacctctgctattgtgcgccctccatagaaatgcaaacgagcggcgtgcgccggccgcaatctgctcgcccccgcccgcccccgtctcccgcgccccgccgcgctcggccaagggcggggaggtggggtgggatcttccagagacggctcaatgtacacattgagtatgcctggcaggcatcaccagcgcgctcgggacgctagtggtcagctgcagggggctgtgcccactgccttttgcaagcctctaactggcgctacctgtttttaccttaatttctggctccaatgcaacagtctcatagacttcaaattaaagaaaagaaacaaatagaaaggtagcaatacaaaatgcaaaaaaaaatccctttgcttctataaaggtgcttttcgcaaattgcagcatcatataagcaaacaaggtttttgtgggttgggttttttcttttttttttttttttactttttccttttaaggacttcaaaaaaaaaaaaaagccaggcgagatgaaatctgcaggctccagtctgcctggtaacaccccaacaaaagcggcagatttgaggcattgtcatcccccgcacccctccccacgtggccttctggcacgagccgctggctcgccgcctcatttacatcagaaagcgggtgccggccaataggcgcgcagcctcgcgccagctggcggcgccgcacccaccagcctatataagggcgcgcagcgtagtaggggcgcactcgctggtggtgggcgcgccgtgctgagctctggctgtcagtgtgttcgcccgcgtcccctccgcgctctccgcttgtggataactagctgctggttgatcgcactatgactctggaagaagtccgcggccaggacacagttccggaaagcacagccaggtgggtttcagggcgctgagaaagccgctggtcggtcggcgaccgtcagggttttccagggtgggaatccgcggggtaggaggggagcgcgggggtccgggcgccagatcccggttggagagccggggtgcaggcgctgagccgggattggagtgtggttggagttggggagccaagggtgtgtgccggtggccggggctggggtctccgccgcgccctccggccggctcccgctcactgcgctggctcctccgcaggatgcagggtgccgggaaagcgctgcatgagttgctgctgtcggcgcagcgtcagggctgcctcactgccggcgtctacgagtcagccaaagtcttgaacgtgtaagtgtagacgcggcccaggctgggagacaggggcgggggtgaatggcgaggagactggcggatgggaggggtggcggcgggagaactcggctagccggttctgacctaggtccccgccttgccctcgcagggaccccgacaatgtgaccttctgtgtgctggctgcgggtgaggaggacgagggcgacatcgcgctgcagatccattttacgctgatccaggctttctgctgcgagaacgacatcgacatagtgcgcgtgggcgatgtgcagcggctggcggctatcgtgggcgccggcgaggaggcgggtgcgccgggcgacctgcactgcatcctcatttcggtgagtacagtcccgtcctgtccccgccccagtgtcgttcccgcctcggcccgcggccagccaggctgaccctgctctctctccgcagaaccccaacgaggacgcctggaaggatcccgccttggagaagctcagcctgttttgcgaggagagccgcagcgttaacgactgggtgcccagcatcaccctccccgagtgacagcccggcggggaccttggtctgatcgacgtggtgacgccccggggcgcctagagcgcggctggctctgtggaggggccctccgagggtgcccgagtgcggcgtggagactggcaggcggggggggcgcctggagagcgaggaggcgcggcctcccgaggaggggcccggtggcggcagggccaggctggtccgagctgaggactctgcaagtgtctggagcggctgctcgcccaggaaggcctaggctaggacgttggcctcagggccaggaaggacagactggccgggcaggcgtgactcagcagcctgcgctcggcaggaaggagcggcgccctggacttggtacagttgcaggagcgtgaaggacttagccgactgcgctgctttttcaaaacggatccgggcaatgcttcgttttctaaaggatgctgctgttgaagctttgaattttacaataaactttttgaaacaaacttatgctctttattgagggtaggggatctttgtgtcgggggaggtggcgtgcagggtttcagaggattgctggaactccgtggaactgatggcacctgttccgtcttcctgtcgggcaagaatgacaggctcctcccctctggcagagggagggcatgctgcccagtgctagggtagaacttgagcctggctcctacttttctccttttaggaagattttaaacttgcaaaacaggagcatacttgagataagacagtgcagcagctgaagtcttgccttccaaggcgataacagtgacctgtgcctcccctccccctcctcggccctcctccccctccctcctacagctgcttatctgaacagcttgcaggaggcctcaggctttcctgcacaatgagcattgccttctgcaggccctgccctttgtggtccctgaggatggtggcagactgctcctgctcttggggactttttcctcttaaatgctctgacacaaagcaatgctacaaaggtactaataccaaatatgacattgatgactgcatttaagtatgagtcattactttgtcatggctgtgatagaacttggaagatctgagaaaaaattggaaggcagcatctatataaataggcatgagcaattctgagggggcctggcatctgctatctactattttcagtgttctctgcccacatcagagttacgaggattgctgctattcacaattccgtttaaagactcataggaaaaaaaaattaaatattttaagccaagactttctttaaaaaggaactagggggaaatgtcctgatcgaatcaatcttttttatgagaccaatatgccttgagttcgttctgtgtctaactagctgctttcagcaggggaaatacatgtgggacccttgtgctgtcagctagactgccaagcaggctgagccttctgggcaaaggaggcatgatgtgctgtcttcagtgcttggggtggctgatttacctcattgagtgccacgtcctaaaattccgtccaaattacgggaggattcttgaggcaacaggaaaactgtactgaattactcttcttgtaatgaaagcgtccttgttttccatttatcagctcctaaaaacatctactcctcaatgggacagaagcctagataaaaaattcagttgtatttgtgcccaattttcattactattttacctatttgctgcttgaaatcttaaggttttcttattgaggtagtcttggggtgggcctgtctaccagtctgcgttccagcaaaatgaccagaacatgctattgtaaacacaaagtggacttgattactttaaaatgaacccttaaatgagtaaattcagcagaacattgcacagagcaggtaggcagaccctcctgttggccaagcgacacttgtagaacatgaggttgtaagcccttggttttttgattagagcttgctatgaggccacctgttggaaccccaaagggctaggagaattttcaggtgaataaatgcatgatgggacacagtgccatgcccaaaagttgtgctaaactttttctttttttttttttttgatgaacaggtgtttaatgctattaacatgaactaactcagagggcagataataaaatgtccagtgtttataaacacataattgcatttagtacttccaacaaccctatatgataatgcatatataagccctcagtgcgtggtaattatcactacatatgtgttgggggtgacccataaagacgagcacaatgcctggcatctagaaagcactgaatgaatgttaatgacaataatacttaaaagctaacgaagacatttgtcccagaccacagaactccaagtgaactagtgggttttggactagccgtctggtttcaggaccaacacgttgctgccatgaacttccgggtgctggagcacttgcggcaggcttattttggaaagaaggctattttcattagataactttctaccttt

SEQ ID NO: 15616 - DNA, 59719 bp, Human
  misc_feature (1)...(59719): n = A,T,C or G
ttcttgttgttgcagttgtttttgtttttgcttggcagggttaggggtgcttttttactggatggattgttaggccactttggttatcataagataaggagacaaaatattttaaataaaataacatccttttatgagatgagaaagcacaaacccatgaaaatatgctctcctggatgcttctctctacgttctttgttattttatgaaaagttacaaaattttaatcaactttactatgtaatttaaatgcctgaaattaggtgctgtatctcacagggttgctgaacttaattttcatatgataattgatgttaatgaatgttgcatcttctaatgttgcaaatattctttgatattttctaaaaaggattacaaactacagatttgtttcaagttcaattgttatgtgatgtcaaagcctagacaacttgcagaatgggagaaagttttataaatcatatatttgataagggattagtatctagactatgtaaagaactcctgcaactcagcagcaacaacaaaacaacctgattcaaaaatgggcaaaagacatactaaatagacatttctccaaagacgatctacaaatggtcagtaagcacatgaaaagatgttcgacaccattattgactaggcaaatgcaaaccaaaaccatagtgagatactacttcatactcattaggatatatgttaatttttaagggaaaaaagggagaaataaccagtgttggtgaggatatgaagaaattggaaccttcatacattgcagatgggaatgtaaaatggtacagctgcaagtttggtggtttctcagaaagttaaacacagagcaatcatttgatccaggatttccacttttaggtttatgctcaaagcattgaaagcagggactttcatcagatagtgtataccactgttcatagcagcattaatcacaataaccagaggtgaaaacaatccatgaacatcaacagatgaatggataaacaaaatgtgatatctatatatatatctatatagatatatatatagatatgcatagagtggagtatatttatccataaagaatgaaataggctaagtgaagtaagcctggcatgaaaggatacatattgtatggttccacttacatgaaatatctagattaggaagattcttagggacagatagtagagtagaggttaccagagccttggggaaaaaggcggtgggattattgtgtaacgcaggggtccctgcatcagcaccggtacgttaggaattgggccgtacagcaggaggtgagccacaggcaagcgagcattaccacctgagctctgcctcctgtcagattagcagtggcattagattctcataggagcttgaacactattgtgaactgcgcatgtgaaggatctaggttgcatgctccttatgagaatctaatgcctaatgaatgatctgaggtgaaacggtttcatcttgaaaccatccaccatctgccccttcccccagcccccgccctgcacctccaccccattatccgtggaaaatttgtcttcctcaaaactggtttctgatgccaaaaaggttgggaaccgctggtttaatggattcagagtttctgtttgggatgacaaaaaaaattctaaaatggatagtggtggtgatcgcagaacattgtgaatatacttataggatgccactgaattgtacacttaaaaatgattaaaatggtctttttatgttagatatattttaccacaatcaaaaaattaaaataaccaaccaaacaacaacaaaatagatttactcagataatacctgttcagtgtcttttcctcacagatatcttctcatttgttactgaagtatccgtctcaaaattgtgtgggtgcttattagatgtttaagattgtttacctgtgggtttgtattgcctttgaattacaaatggtgtggggttttttacattatttttgtgacagaaatagttaatgcatctcctttgttttgcagttacttcgagagcttaagcatccaaacgtcatttctcttcaaaaggtgtttctgtctcatgctgataggaaggtgtggcttctgtttgactatgctgaacatgacctctgggtaaggtgaattgctggcagacatgagcaaacagtcagggattgttaagagtaactaaaaacagttaggtgttctgcttattatgagacttatgtttttaaaataaaagtaacctcatagagtgtggttggtggcatgacgaaggctagagtatttgactttgtattattacttttcaatattgtcactttgatcttttaacagatactaaagaaaacaatagaatctaaagagtgttcaacaactattcaatattgcttcatatagttttttgataaaataaaaagtaactaatatatataaaattttgctctaaaatagaaaagtagcatatttccttttatttcgttgtataaagggaacataaaatgagaaggtggtatcctcatgtaggaggacgaatatgctatctttggagagatctaatagttctaccattatttgtcgtatagcattaagcaagtcttttaatggctttgaagctgtagtttaccccatctgtaaaatgtaatactttcttgccttttttaacaacgtttttctgaggaacaatcttgtatttgaaaagttttataaatatacaaatgtaggaaactattattaattattaactattcacaattgaatttaatatcctaattcttattttcagtggcagtagttcaatacagtatagtcatgcgccatataatgttattgtcaactagggactgcatatatgatagtggtctcctaagattatagtaccatattgttactgtaccttttctatgtttacatatgtttagataacacacttatttactattgtgtcacaattgccttccttattcagtacagtaacatgtacaggtttgtagcctaggagcaggaggctataacatatagcctaggtttgtagtagagtctatcatctaggtttgtgtaagtacagtctgtgatgtttacacaactgcaaaattgcctaacgacacatttttcagaatgtatcccttcattaagtgatgcatgactgtattgtacttacttgaattgggcataatcttgcattggaggaattttttgtggatgagagctctattacaaaataagattcgtgtgaaaataaattttaatatctcttgggacttttagttctttgttttctgacctatgataagaatagttttaggccaagtgtagtgggtcacacctgtagtcccaacactttgggaggccaagacaggaagatcacttgagccaaagtgtttgagacaagcctgggtcacatggcaagaccctgtctctgcaaaaaataaaaaaaattagctgggctcagtggcacatgctgtggtcccagctgttcatggggctgaagctcaggaagtcgaggctgcagtgggtcctgtttgcactgttgcactccagcccggctaatttttgtatttttagtagagacagggtttcaccatgttggccaggctggtctcttaactcctgatgtcaggtgatctgcccacctcggcctcccaaagtgctgagattacaggcctgagccactgagcccagccagtttattagtttatctaatgcattgcagaaaatgatgctatattgaaaaaaattactgtaaaataagaacttaattttatcttgtctgagtagctgaaatacaaacaccagcctcagtattttgcagtttactaagcagattattttttaaattggtatttgaggaactctaaggtaactataaaatttgctcttttattaaatataacatttatatattttttaaaaatctgaaacgttaccttgcagataaaactttgagatatatatatagaaaatctataataggatagccaaagtaattttgaaacatagtaacaaaattgacattcttatcaatctgtatagagaacatctgttaatacagattatagtttaagaaacaagtaaactaaacatctaacattaccttgtgttaattcattaagaattactatactcctgtgaactgctttttaaatgatatttaataatgtctttaaacattgtattgatttgcatactaatctatatttactaaattagcatggctatgctttttattatgtatacatgaaattttctctcttttatgaaactctttccaaagttcatgctggttattaatttcttctttttttttaaatctttggttcttctgttcttctattttaaaagaaatctaatcagatcaaccctgttaaatcagcgtggccagtattaaattgaacactcactatgctgagcctcataagaaataaagtcatataatttaaacttaaggcattttccaggctggtttataaacaagatttgtgataaaccacagtagagcatagaagatagtataatatttcactcaatgtgatttctagctgctagtttgtaatatttaattttacatgtaggtacaatgattatacttcagcaaattttattgtgggtaatattgtacagtgcatataactagttcattagctttatcatcatcttaataatatttaagccaaataagtatttttaatgttcattttcataaaaaacaaatgataatttagcctactaaaacccactcctttatctattttaattggaatgttgaagtgaattggtaggggttaggcagcagagggtaacaaggcagtcgcaataaaaatagttatttttaaaaatcacttaggcgttggtgagatttcatggtatgtatattttgcatttgttatgtagccctggaatataaagaaaatgacagtaggatttgtcattttaaaacattggtaaaaaaagtcacttgtaatactctaatgaaagtgtacatgaagaaatgtatatgaaattgattaattaccttacctctcctacatatttgttcctttgattcttactgcggcagagttttaattttttttttttcaaaaaattaacctattttatttttatttatatttattttacctgtttttattaagcttggagagagccaaagaatcttcttcttgttttttttgtttgtttgtttttgagatggagtctcgctctgtcgcccaggctggagagcggtggcaggatctccactcactgcaagctccgccttccaggttcacgccattctcctacctcagcctcccgagtagctgggactacaggtgcctgccaccactcccggctaattttttgtattttttagtagagacggggtttcaccgtgttagccaggatggtcttgatctcctgacctcgtgatccacccgcctcagcctcccaaagttctgggattacaggcgtgagccaccatgcccggcccaagaatcttcttcttaaggagaacagacttgattgtcacatcatattttaggacaggtgacaaaacagcctagattattaaattgttgtagctctgttttgtttgcctgctattaaatactttgaaaaaaagactgagaagaaaattaaagtagattaatgctgctaatttagattagtcatactacatatgtgcaaactgctacactttaccttctcgtagatatttgctatatatttttaccttggagagtaaagctcctttattcattaatcattagttattccttacttgtgtcatattctgtatatcataagaaaatagcaagtgaaaatgttaacttataatgttaaatatctcttatttttattatgtctactaatttcaagaacatgcttaatatttacttacatgtattggccaagggtctgctctgtgcaatattaggttcagggatatgtacagtggtgtgcaaggcatagtttactgcagccgagttatagattttcctgcaatttaagagtgatctaattaagaaaatgagtcctatcaagagcatttgaaacttttcaagaaaaaacttgtaaggcacatttattcataaagtaatttttctatgtataaagttgtgctttgttttactggatgtctaacaacattatacatagaaagctttgatggatggtacaaggcagtttttattttcctcagaatctttcccatttttacatttttccattgtgaactggtatatcatttctttgtgcttgtgtgtattttattgaagcatctccccacttgctttctttataacctgtgtcataaataggttctaattctatgctatgtcaaccagccagaagtatctcttgaattttgttctttttttttttcattttatctaccagataaacaggaatcaagtatactctgaaagtaattgatttttaattatgctttaaaaataaaagcacaatattttctgattccctattgtgataatttatctcctgaaatgctgtcatatgggtaggaaatggaattttagccccagttattagggaattttaaagttgtttatgttattcagcagagtacgaaattatattttcaatatctatgggaatccctgagtgtttctttttctgttaggaaaatattatacatcaaattatcttttcctttttttaagcttctgttgatatttttttctttctttcagcatataatcaagtttcacagagcttctaaagcaaacaagaagccagttcagttacctcggggaatggtgaagtcactattatatcagatcctagatggtattcactacctgcatgctaactgggtgttgcacagagatttggtaagttgacctgtaattggtttaaactagaaagatgcattacagttggatacttttctagtcgtctgtagataccagtgctatatgtaggcctgcaaaccttatagaagtagtgagaatgctaccttctcaaaacatggcctagtagtgtttttatataatgcctcctgcttctctgacatacactagatggtatttatttcaaagtgaaagaagagacatttgtgttcctaagcttctgtttccttttaagttcataaataaagcattggcttgctttaaattgattattagatacaaggccaactgtagaaatttatatatttataataacttgaaaataaaattttgggagcctactgcatactaatttacatattagaaaaggaaaatgttaattcaatatgcttatattttaagcccctctatattagcagtctgttggccaatcacctttattaatcataattgaagtatattattagaagccttgctgtgttcaggtgcattgaacttttgagaatttaaaaacttaagaaactgactttttaattttacgttgcaaagtcatttatgccttttttcacccatcttgcacaggggtccccaacccccaggccacagaccagtccatggctcattagggaccaggccacacagcaggaggtgagcggtgggtgagcattaccacctgagctccgcctcctgtcagatcagtggcagcattagattctcataggagccagaaccctattgtgaactgcacatgcgggggatctagattgcatgctccttatgagaatctagctaatgccttatgatctgaggtggtacagtttcatactgaaaccatcccctcccaccccgctccgtggaaaaacttcttccatgaaactggtccctgatgccaaaaaggttggggactgctggtctagcatattattattcattaaattttcatggatttaaattacctaaacttcaaattgccctttcttactacataattacattgcttttatagttcttttctttgtaaagatagtaactatataataaggtttataaaggcaccttcatttcaaacaaatataaacacaatgctaaaagtgattattttgtctctaatcacctgtatacaaaggaaatatcctgtaggctatgaggcggagcccatctggtctctcgcaaagatgttcttcacaaatttagtggatttagtctctggccttcaatgtgctgttccagtggcacagtttatacttctttcttctagctttagggaattgccttgtagtacatttgatgttagttactttatctccagttctcatacctacaaagcatttagactaggaccagtaacagcagaaatttggttgaacttgtttctttatgcaaacttttatttttaatacagttagaatatttcacttataaaaatagatttacaggccaggcacagtggttcatgcctataatcccagcactttgggaggccaaggcgggtggatcacgaggtcaggagttcaagatcaggctggccaagatggtgaaaccccgtctctactaaaaatacaaaaaattagctgggtgtggtggtgggcacctgtaatcccagctactcgggaggctgaggcagagaattacttgaacgcaggaagccgaggttgcagtgagccaagatcgcgccacttcactccagcctgggcgacagagcgaaactccatctctaaaaaataaaagaaaacaaaaaatagatttacataacagaaataagacaaatcctttggcattttgtgaagctcaaaataaattttggccattggggtggagtcaagttagggaaaaacatttctacttttgagctaccagtcctttttatgatctctaaaagaaaaaactgtggcttaaggacatttttttccccgtagagtcagttatgctaagatagctctacattttctttttcttgtaaatttttttttcacttgaaatacatatgtatattaggtaaatacagactggtttttaaaaccaatatttaaatttcatgtaataatataaatatacttaagccacttagattagtattaagtatggtagtgaaaattatgataccgagtttcttttatctctcttatggtaaagctcttcctgctaatgcatcttaagtagattctctttgacataggggtagtatagaacagatcatttcagaaggctctgtctgttagtggtgtactaagtggtggaaagtggaaggattggtgccccctaatataggcaacaagggatgcattatctgtagatgatttaaaaataataataaagcacattaaaagttagttgctttttattgtcactatatgctggcaattctgaacaatttcagtaataaaatatttctctacggtgaggcaaatcactcttactcctccatccctcttgccattatttaaagtttattaatccaaaaagttctgcagtgtctgctgctatcttctttgatttccatatttgagtgagatttcccatattttctgtgcatgacttagtgttctttataaacgtctgacccttctgtgtgtctcacgcacgcagaagtccactgaaccattgtttcatgaaaatgatagcctttgcctctaatctagatcctactggttcagatgcccacctttcaaattcttcaatttctgaagaaaaatctcatttaccatatatgtacattttaaaatgtgaacaccttcctgccaactgaaaaagttttaaagttttaatgtttatagtgtttgaacaatagctacatatgattctaatgtatgtagtaatatgatattaactctcaagaacattgttcagaagctgtatcacataacttttttaacattttttctcaaatatttgttgttacttgcatatgaaatatttaccctatcaaaacaaaaattaatagttcattatattctttacccctgtttagtcagatttagatcaaatgtgataatgctgaccttaactctcttcatagatttctaatgctatgaattggaccagttggctgacatgccacaagaaacttcatattaaggtggataattggcacagacaccctaaaaacaccattttaataatactctggaatgttattgatgtctttgtttaataaaattggctttattaattaatagaaatactggtttgagatggtagagttatgaatttctttgatatgtatagttgagcttttaaaattaacagtcctatttaataaataatgatttatttggttgctattaattatcacatagaagcagatcagtagctgaaatccggcatccttggtgggaaaatagagatttattaattctggaaatctttttgagctgagaatcgtaatcagtgtaaatgtatgggtgttttaagaaatatggaccagaaaagaaacataagcagtatttattttgtgaagtaattcattgatccaaaccaaactttttagttttagaacattaaaatatgtatatgtaagttgttgcttatacacttgtctgtgtccactagaggtaaataagaacaaagttatgtctgttaagttagctttgctccttcccttgatgactctcttcccttttctttgtttattctctttctctccttgggaagggaaaatagtttgactaccagtctactatagtcctggttctggtattaccatctatactgcttagggttctccagagatgcagaaccaacaaggtgtttatacatagatggagagtgatttatttaaggaattggcacatgcagttgtggaggcttggtaaatccaaaatctgcagagcaggctacaggctggagacccaggaaaaagttttagctctagtccaaagacagtctgctggcagaattccttcttgctcaggggaggtcagtcttgttctatgaaggcattcaactgattcgatgaggcatatccatgttaaggatagtccttatgtgttttactcaaagtccactgatttaaatgttaatctcatccaacaaaacattcacggaaacattcagaataatgtttgaccaaacatctgggcactatggtccagccaaatttacacatcaaattattcatccttggctgggcatggtggctcacgcctgtaatcccagcactttgggaggcgggcagatcatgaggtcaggagattgagaccatcctggctaacatggtgaaaccctatctctactaaaaaaaatacaaaaaaattagctgggcatggtggcgggtgcctgtagtcccagctacttgggaggttgaggcaggagaatggtgtgaacccaggaggcagagcttgcagtgagctgggatcgcgccactgcactccagcctgggcgacagagcaagactccgtctcaaaaaaaaataaaaaataaaaaagtcatcctatacaagtgaataaacaagaagcacaagttaaaataatgtgaggtaagttatttgccctgtctcttccccctctctccctgctgttactaaaataggagtattgagttaaggcattctaagaatttttacctcgtattataaagaggggactaagtgggaaatactgtgaaaacaagtaaagatacatttaactttctaacaccgttgtcaggaatgtaaaataatacagctgctgtggaaaacactgtggcagtttttaaaaaaattaaaaataagattaccatatgatccagcagttccacttcttggtatatacccaaaataattcaaagcagggtctcaaagaggtatttgtatatgcatgttcatagcagcattattcacagtagcttgccaaaaggtagaagcaacccaagtgtccatcagtggataaatgggtaaacaaaatggggtatgtacatacaatagaatattattcaatcttaaaaaggaaggaacttctcagcctgggcaacatagtgaaacctcatatccacaaaagcaaaaattagctgggtgtggtagcatgcacctgtggtcccagctacttgggaggctgaggtgggagggtcacttgagtccaggagtttgaggctgcagtgagctgtgattgtgccactgcacttcagcctgggcaacagagtaagactctgtctgtaaaataaaaattacaaaatttcttttgggtaagaaaattgacatatgtacaaggatgaaccttgaggacattatactaagtgaaataagctagtcacaaaaggataagtaccatatgattccactttcatgaggtacctgagtagtcagattcatagagacaaagtagaatggtggttgccagggctgaggggaggagcagttacgggacgttactgtttaatggatgcagagtttcagttttacagaatgaaaagagtttggagatgtacggtggttgcacagcattatgaatgtgcatttaatactgaactgtacacttaaaatggttgataaattttatgttacgtgtattttaccacaataaaagacatcgggagaaaatatgtttaagtgattcataataaggaaaagtttgaagtctgctagcctgattggattcagtttggtaatttttcttagcacagtcaaataacaagacatgatgcatcaaagttgtattgatactgtttgtgtagaagcccagttttgatttggcaatggtatctgaactgtttctgaaaaagtggtcctcctttctagatagagttaaaacacatgggcaagggcatgagcggtttttcactactgaagcctgtgttgtgaccattttgagagcatctagacaacttcactaactgcagctatgtggcctcatttttttcttcttttcttttttttgagatggagtcatcactctgttgcccaggcttgagtgcaatggcatgatcacagctcacttgaacctctgcctcccaggttcaagtgattctcctgccttagcctcccaagtagctgggattacaggcgtgtaccaccacatccggccaatttttgtatttttagtagagacagagttttgccatgttggccaggctggtctcgaactcctgacctcaagagatctgcccacctcgacctcccaaagtgctgggattacagacataagccattgcacctggcctggcctctttcagtagaactgatttcagtagaacttcaaactattttttataaaacttaaaaaaggaatgcttttctcattcagtttgtgaaataaatttcaaagccagttaatatttcttttactgggaagaattctgtgataaattaaaaatttgaggcaaagcatgatggcttatgcctgtaatcccagcactttaggaggccaaagtaggaggattgtttgaggccagaagttagagaccagcctgggcaatatagtgagactctgtctctacaaaaagaaaattgaaacacattgtcaaatatgctggtatttgtgaatctaagtgaagactgatatgtagtccagctccaatcttcttttctttccctatcttactccttaagctaattttccagccaactcagaggttgccctgcctgcttgaatcccctcatcccttcatcttcatagctcgaaattaaactctctctagtcaccctagctgaaaatgagaatgtttatatctaaaatcctattacagctactttgaaccacccatgggccacttactagttttggtaatatggtaatctatttgattataaactcctgagggcaaagactgtgtcttactctgtgtttgtatgcctcccactgcctaccaaaatacacaatttgtgtatacaatattgcatgtttgttgaatgaatgaactagcttacttgtaacagaaacaaagtggcttccaaggttatttctgattttacctaatgcttatgcatatctacagacacatgcatatccttttgcatttctttttactacccttttacctctactatgatttactgcagtgaagtggtgcacaaaagcttccccccatccgtctgcattttaaatcctttcagctgcttccctcttactactcagaagaactcagctcttactagtcagttcaaagaccattcaactaatgatattgacctattgatctcttttattgctctcttcttatacgcaatatttttgtttcactcagtgaaacctatttgctgacccttttcctatgtgttctgatgttctctttatgtcacttatttttctcaaattttttctttaatcttaaggttggaacattactatcatagttaatatacatccctcactttattcaaaaacatcttaaggttccttctgagtaaattctttaattgcaaataagatggcaatgcctaccttcttctaaacataccaactgttctgaacttggaactcttctatttcacttttacattgcatttaactgaccagtctattacttgtcataatatatttatggatgctccttgacttacagtggggttccatcttgataaacccctcataagttgaaaatattgtaagtctaaaatgcatttaatacacctaaactaccaaacatcagagatgagttcagtgtgttttaaacatgctcagaacacttcagtcaacctacaattgggcaaaatcatctaacacaaagcctattttataataaatttgttgagcatctcatgtgatttattgaatactacactcaaaatgaaaaacaatggttgtatgggtactggaagtacagtttttactgaatgcatattactctcacatcatcttaaaagccaaaaaattataagtcacgccattgtaagttggagatcatctctaatttctagcttatagttgctcattttgggactgctttcattttttaagtaattttctttctgtctttcttttcttttcccttttttttttttttttttttttttttttgagacagggtgtcactgtgttgcccaggctagtcttgaactcctgggctcaagagatcgtcctgcctcagccttccaaagtgccgggattacaggcctgagccaccacacacagccattttgtaaattaattttctaatgcacttattattggctgtgttttatgctttttgttgaaagtattcataaagctgtatcagaccataggaatgatttatactaaatcaacatctaagtattaaagacttggttttgatgtattttctaagaaaattaattgaaagtagagtagtagttatatgactggcctagtagccattaatttttgtaaagtacatgtattagagttctccagagaaacagagtcaataggatagataggtagatgtatgtgtggatgatagatgatagatggatggatggatggatggatggatggatggatggatggatagatagatgaatgacagagcatttgctagaggaatcggcttatgcaattatggaggctgagaagtcccatgatatgccaactgccagctgaagaaacagggaagctggttgcatggttcagtctaaatccagatgacctgagaatgagggagctgatggcataactctcagtcagaggccaaaggtttgagaagctggggagctactgtacaagtcccagagtccaaaggccagagaatggagagttctgatttccaagagcaggagaagaaaggtatcccagctccagaggaaagagaagttgcctttcctctgcctttttgttccatctgggccctcacctaataagatggtgtccatctatgtacgttacttggaggtggatctttccactttagtctactgtttcaaatgccagtctcttctggaaacaccttcaccgaaatacccagaaataatgctttgccagctatctgggtattctttagtcaagttgacaccttaaatcaaccgtcacagtctatatcaaattttcatatggtcattaatgttttccttgttttaaaatatgtgatatccaaaatttcattttaatagttaccttaatgattttatcatagtagtagttaacttggaactagcaggcacacagtgtgtattgtagtcctgttttactaaatggcatataatgttgagtgagatatactataacttttcattgtagttttttttttttttaattttcaagttcaattacaagattgtatagaaatttggagtatttctcacgcctgtaatcccagcactttgggaggctgaggtgagtggatcacgaggtcaagagatcgagaccatcctggctaacacggtgaaaccccatctctgctaaaaaaaaaaaaatggaaaaattagccaggtgcggtgacaggagcctgtagtcccagctacttgggaggctgaggcaggagaatggcgtgaacctgggaggtggagctggcagtgagccgagatcgcaccactgcactccagcctgggtgacagagcaagactccatctcaaaaaaaaaaaaaaaaaaaaaaaaaaagaaatttggagtatttcaactattgcagccatcgtcggttggccactcctgctcttaactaattcaaaatagtgatttttaatgtcatagtaaaactttctagaaaatctctagatttggggagtgtttcagtagaggtatgctactcacttcaaagcttattttggaaaaaataagcttttttttgtttgtttgtttttggtagagatgaggtcttgctgtgttgcccaggctggtctcaaactcttgggctcttgggctcaagcagttcttctgccttggcctcccaaagtgctgggattacaggcacaaacaaccttgcccagcctgatttattattactttttaaatctgatagtgttgctgtcctgcagtttattttaattatactgggtaatttggaatcactaagtgggacttcatgtgtccttggtgaaggatatgttggtttcctagcaactgttaaataagattaaaatcttggagggagccattgactcaaactcagtttcatagggcacactttatcaaggcatcttattgtgtattgatagcatgatgaattattaaggcattttgggtctgattctttttatttgagtgacaaagtgaaaaaacacctaatgtgttttacttaccaatactaatgtttgctcatggttatatgacatttttgtttttgtttgaggtgtattttcttattgtctgctcaactctactactagtaagtggaaaaattgagaagcaaagaggctaaatgacttcattatggttattcagagaactgtagcaaagctggactactgaatttaggatttttcctctagttcagtgatttttaaattgcagattataagccataaacgaatcaggaaaacacacgacacaatcagtttttttgttgttgtttttaatgaattagaataaatatgagagtgcatcatatatgttaagggtaattactgtttcatgaaacttttgattcagttatgtatatttgtcattattgtcatgtaatattaaatgtgtcacataatattaaattttactgtgggttgtgttgaaaaagttttggaagcccttgcactagaaaatgcttaggcccaaattatagaaacttaatgttttttgcaagctttttgacattggtaataaaatcattttgaatagcggttaggagggattatataatcagtagaatttaaggaaagtttcagtttcttccttctatacctttcaaattgttggaatagtttgtagttaacataccttattgttacaatcagagggaaaaaagtgttttaatctggatcataaaactgaagaaaatgtttatttaatgtgttattaaagctcacatgtaatgttcattgtggtttagtatattttatgttggtaaagggcgattgttatttttaaaatagccatatatacactttctttctttctaaaaagaggcattagtaaattcttcagaaaagaaaaagcaagcggaaaggaccctgaaattacccatagactaaaagaggggcagagcagtagtcatggaacagtgggaaagagaggagtctgcattctagacatctgttgccactatttttccttatctgtgctgtagtagcttccttgaaatgagagttgggaacctgttaagcgtgtttaaaacagagctttttgaaggaaaaatgcttttagttgtcaggtttaattattactcatgacttgagatttgcttcgtttgttgggaactccaaggatttactctaattgtaccttgtttaattgggtagctaataaaacacataagattgcaaccataaaatttaggcttgcagataaaacatgggtttggtaacaactgattaaggcaaatttaaatgagatttgcattaatttcagttaacattgtgactattgtgcttattctaaagtattcttacttaaatgaccagctgggcagttttccttctgtaaactgattataaacaacccatttggcttttgggtacatgccacatttgcttaattattatactgagcatgcacaatgtactgttttattatttatcaataaaaaagtggcccacttcattttattaaatgtcacaattgcaaatagcatatatgtttatatgggtaggttacaagttgataaaaatattatgtcgtttggtttgcatattacttagacatctcaccaatcaagaatggttattctaaattatctcatcaagattttgttttaaatggagtttctttaagatgtttttgtgtgaccatggaagttgacttgaagtagagggttatctgagtttttctccattcataacgtaattgatgtaatacatcattatgtattttacataactcctcccatttttataaacaaaatatactatcatccacagcagtgtgtttccaaaaaccgggacagatagggagacaagaatttttcatatctctgcctgcgtcttatataagctattacttgatttaatacgatattaatggtgacccctcagtttttctcttttgacctttggactttcacattagcaaaacaaatatatcacaataccaagaaactctctctttccaaagagagtttcagaatactctgaattatactgtgaaaaaaaaccataaaaattaatatctcagtctaactttctagtaatagagtcaggttttagagttattttccagacttctgaagatttgcaaaagtacctgaatctttaaagatggactatattagataagattttcttttatctcagctaaagctgttatctaaacctattttaagttattggtgccattggccacataaagctttcattaaatctttttcagtttgacgaccatatctctttactggatacaagcaaatgataaatggtcaaataacagaacaaaagtaagtcttcctacagaaacaagcacaagcagagagccatatttcaaaatcagttcaacccagaagttcaagttcttgtgtacatttttataaattttgtttgaatcaacatacaatattttttttaagatttaatacaatgagaagtttcctcaatataattagatgtaaaatcagtaaccgttactgaattaactattgaaagaaatgttcgtttattaaagtctcctactcccccaatacaactggattttaccttcccttttgatagtgatcactttgttatatgacctatatctattttttattatttaatttttataacttgcctccagatttttatcttactaaaagtataatactctaagtaggtatgtgttctgaagattcctctctgttcccaaatagatgtgtgaatttctaaaatcaatttctattctaatttccagtcttttcagatcacagacaggcttgtaattcaggtcagtgtagtttaagatgcctatttaataaaaacatagaagttgggaagatagattgctaatttttaaaaattcatttaacatctgtttatgtaaacatcttgaaccatttgaaataagatcattttttgttttccctaatttcacagactaataggccttaaagttggaaggcatcttagcagcaacagactattccagtctcttagctgccatagtaattcttggtaatatgcggggcagacaaccctgctgacactggtcgaacatttccatcatggctaactttctgtcttattagagtaaacttgttgttacacagctataatccttgaaggtagagtcagaaatttggaattcctaatactcatcctttgggccctctcttccttgattggtcttctcttttttccccccttctggttaacactagatggtaaaatcaaatgtctgaaaaacaaacaaacaaaaaacaaaaacaaatgtctgaaccttgatgctgaagaggggctaagggagatccaaaaataaaaggcagagcaaaataaagaacaacaaaaggagaaattaagaagaaaaataagaaagggttgcacatggtaggaagcgatagaaaatcttgggttatctatccttgaataatttttttttttaatcagcatgggccaaagaggaaaaattaagcccctgttatagtggacctgagatttgtttgaatctttgttctaccacttaattgtgttaccatgggaagcattaacctgtctgtcacttttctcagctataaaatggggccagacctatttgttttttcctttgggtagagattgatgtgaagactggcacataataaatgttcattaagtacatttcacttttcaagttgccctgtgaatattaagtacatgaggattaagagctttatccgttttgtttactgctatatcatcactatccagaatgttacacggtgcatattggatgcctataaatagcttactgaatgaataagtagatttttttgttagctcttccttcaaaacatctcagatccagctatagtgagaccttattggaattcaaattcgaataaagcacaattggcaattggtccttatcatctgcctggtatctttttctcaaagaagagtcaactgtagtgcttattttcaaggagaggaatccatgaaaggaagggcagatttggcagggattctggacttattagcccagtgtccctggatcaatccaataaatcatttgccatcttacaaggagatttcagaattttctgctgctgggaaatggatttggattgcccagatggtcattgggattgctagttgtagaggttcaccttgtccatttcattaatatctgtttaccctacccctagctagaccccacattttacacagtcgaatttttcggactccaataattgcctcatggtcttgctgctcaccgtttctgtcaccactactctaattcaggccacttggattactgcagaaactccccagtgatcttcctctcttgttgtcttgtgtttgtttgatctaataactacaaacaaaatgatctctctaaaaaccaaatcacatcgtgtcattcccctatttaaaattcctcaatatcttcccacctgggagactgatatattcaaaatctttcctaaacacattgtacagtataatgtctttttaccgtggtgaaagctgcaccattattttatgtaccactaagaaagaaaacatgctgccaatttactatcacaccacggaggctgagacacatcttgctttcagaaattctaagatttaaaaagaaaagtaaaaattggaatccatgaaatgcattttcttcttgtcatatagtaatggttaggacttattcactaatacagtggcaaatataatagaagtgacttatttctgtctttaaggagaattcttaagtttcactattagatatgatatttactttggggttttagttaaaggtaaaagatgttcccttctgtgcctggttaagttgtttgtttctaaatcaataatattgctttttctgcgtcttctgggatgatcatatggttatttcctttaatccattaatgtggtaaattacatttatattgttttcttttgtttttaatgttgaaccctccttgcagtggaaccaacacactgtcatgatgtttttttttcattcactagtagattccgcttgctaatactttgttttgtctattttcacaagtaagtttggtcagtaatcttctgttcgtatattacctttatcctgttttgttatcatgattttattagcctcagaagacgcttttagtctctggaatagtttgtataatataggaattatttgttccttgaaagttagtaaaagtcagccaggggcggcagctcatggctgtaatcccagcactttgggaggctgaggtgggaggattgcttggaaggattgcttgagcccaggagttcaagaccagcctggacagcatggtgaaatgccatctctacaaaaaaaaaaatgcagaaattcgccaggtgtggtgatgcatgcctgtggtctnnnnnnnnnnnnnnnnnnnncgaaggttgtgctagcactaaagactgaaataaaattaatgtaaaagtgcattctcagattttccctgagctttaaattcaaaacgaattgaggtgtgactgatgtaatttttaaaacttcaacttctttagcactatgccctatttttaaaattgaataaaaacaaatatagtctataacatggtatcagagattcacatcaaagaataccaaatgtctagggacttaaatggcatttattacacattaggatggggataggtgaatattagaattagatgacggttcagcaagactctcattaaagttaaaaagattttttttttttttttttttttgttgagacggagtctcactctgtcacccaggctggtgtgcagtggcttgatcatgactcactgcaacctctgcctcccaggttcaagtgattctcctgcctcagcctcccgagtagctgggattacaggcacccaccaccatgcctggctaattttcgttcttttttttttttttttttttttttgtatttttagtagatagggtgtttcaccatgttagccaggatggtctcgatctcctgacctcctgatccacccagctcggcctcccaaagtgctgggattacaggcatgagccaccatgctcagccggttggacgatttttgactatcatttcaatttctttagtaattgttatgctatttagatgctctatagaacactgaattaagtgaacattttaaaataaagtacaaattaccacaactggccctagaaaaggtcaataagtagatcaataactatggaagaaagacatttgtcacaggactacccctaagaaatgtacaaaatgcagatagtttcactgttgcttcaaaccttcaaacaaataatcctacattatataaattgttctagagttgtgtaaaagaaagaacatttccttaataactttataggaagaaagcataacactgacatagaacctgataaagataatgcctacaaccctaaaccattatcacctgtaaatacttaagcatatgtcttaaataaaatattagcaaataagatccgggtgaacttaaggtctaagtcagtgaagtgcattttaagaatgtgcagatgattccatatttggaaacctcttaacaaaattcatcttattaatagtgcagagtggataaccctatgattatcttagtagtcataaatataacacaaaattcaatatctggtgaaacagtgttcatttctggttgaaattcttaataaaataagaaaaggaaacttccaagcatcaaaagtatgtatcccctgtttcatcttatatcccaaatcagcagcttttatatacttccaatattctagcaccactgttacttaacagtgttctgaaagagttctggctcagaaataaacagtcacgatacaggattgattaaaacaggacaaatgcagtagtgctatccaactgctaaaccagtttctatatgtatacagagagagaggccaagagatttattcactgttgagtaaccagaaacaggaattaaaagagccttgataagatatttatattacatgtaaaaaatacagatttagagaaatctggaactgtgtccaacaaaatgtttataatgatctaacttcgtgaggtaggatttcagttaaatttcactttctgtatgctttctgtgttttgattttctacaagaaatgtttatttttgtttaattttttttttaaatgttgctaatagttttttaggcatagactagaagctagaaagtgatcataggcaattaggggcatctcatgggtggtatagaaagtcccgcaagatgaacttcttgcgggccttatccaatcatgcatgagtcccatcccctgaacccccagccccagaagtttttacttaagagtcactgtggtagtgaatcattgttaacagattatagtgtgagctgccatcttaattatcattataatgtatttaggacttttatatatcaagaatcttgctaaagcctttcatataagtcacatttagtctgtctgacaacattttatagatgaagaaatggaggctaagtttacataactaatagctaatgacattcctgattttttcagctttattcttaatcacctaactgtatttcctcatcttctgaagaagttcatcatattcctcaatatttagggggagaagaaagttggagaactatcagtctgaagtctcctgtgtctcttggaatatggaagttatcgtcatactatcagatatagtttatttcaaaaaactgaaacatattgtagcagaaggattaaagtagtgaaaatacagcagagaactaatggtctgttcagtttgccaattgtacaaaaagaaatagaaacacgtgtaccttgactttttttttggagacggagtctccccctgtcgcccatgctggagtgcaatggcgtgatcttggctcactgcaacctccgcctcccgggttcaagtgattctcctgcctcagcctcttgagcagctgggattacaggcgtgcaccaccatgcccagctaatttttttgtatttttagtagagatggggtttcaccatgttggtcaggctggtctcgaaatcctgacctcaagttatccgcccgcctcagcctcccaaagtgctgagattacgagcatgagctaccgtgcctggccataccttgacattttctatcagattatgacaaaattttaaaaataaagaatgagcaaaaattatagattacagccatgtaatttaataggttacgtggcatttagggatatataagagagtatacttttcaaataaataaccactcaaaaatatgtgtgtctaggaaagttcagtgtgtactagaaataaagatatgcatggtaagtattgacaaagacacaagtctgcattaatctctcagaacacagtaatagaaaactaaaaataaaattttattttcctgttagcataagttgaaaactgtgctatttaatacagagtttgaaagtagagactcttgagtgaaatatatacattcattgcaaattgaaacacctcaatattaaaataatggggaattgtacaaataggcagaaacatattgctttaaaccagttgtttgaaaggcacattaaaacagaaaaactttttgaacgtattagaaaaagaaataataatagatcataaaagccatttggaaaaacaccaagactaaccaaaagtcagaccacaaatgatgtagttaatttaatatacacttacatagtttgtgtgtataaacatgtattttttaaaagttcaattttattagtaaagttgtacattgaaatgtaggagatgccatttctcctattaaatggtagtgctcagttgttgacagtgcactgacagtataatgcagtagttaagagggtggattctggacccatactccctgtatttgaaccccagctctgctactgatgagccagtatgaactgctaatataaagtctcagttcagctgaggcctttctggccttagtcatctcatctgtaaaattaacctgtgtagaggacttggcacataactaacattcatgttgctgttgtcaaaccatcactctcttctttaaactcttcagtgaaatttccttttaaagataaaaggagcattttttctgcaactagaccctgcagtgcctggcccccacttgtctttgcaaccacatttcctgccagtgtacccctgtgaattatgccatacccacaaatgccttcttgaataaacccaggtatttaccacttcagagccttcttgttttaacttctgtttgaaaagttcttctgtccacacctgcttaggtaccacatacgtaagtaaccctttcctctggctagttccttctcatccttcaatccttaaacgtcacctcagagagaccttccctcaccatcctgtacatactagtgcccccattattctaattctctttttctttcattgtactaatcataattggtagggttttttttacatatatttgtttgcattttctaatgtctgtcttccttatgtgatagatacagtgtctgttttgttacccactatgacatgccaagaatggtacctgatagataattggcctttgctgtgctgtatgaatgaaggaacactaactgctggacataattacagcctttctagaaagcaagaattatcaagaataaaaaaaaaatcattccttttgatataacaatcttttaacaaattttcttaaagatattataaagaatggtgcaagggccatcacagaattgatggtactaattacaaattataaaatatttacatgtctaacaactagagaatagtttcactgaattatgacacatagaaaaggtcaactgttatgtagtcattaaaaattttgataagtttaaataatgtttcagtgttacagacaaaagcagactataaaatactggaaataaaatacagtgtaaatatatcaacaaaaaaatttatcaaaaacagtagttaaatttgagtagctaattgtatttccttaattgtatttgaaaattaactttcctgcaaaagcatatgttatgttctagaggggaaaagagatagtgtgtgtttttttaagtatcagaagtgttaaaaaatttcatgaatggaacaggcgcagtggctcacgcctgtaatcccagcactttgggaggccgaggtgagcgaatcacgaggtcaggagattgagaccatcctggctaacatggtgaaaccccttctctactaaaaaaaaaaaaaaaaaaaaaaaaaatacaaaaaattagctgggcgtggtggtgggtgcctgtagtcccagctgctcgagaggctgaggcaggagaatggcgtgaacctgggaggcggagcttgcagtgatcggagatcacgccactgcactccagcctggacaacagagcgagactccatctcaaaaaaaaattcatgaatagattcatgctattatgagaacttataagaatccagaagctatttcacaataaagaagggccttgctcattatcgtcagtaagtagggagaagaattttcttgctttaattaaatttttgttattattacttgtatattaaactattgtctagcccatgtggatcacagtatattaaatgtatataagaaaattagcatatttagttccagctacagcaggtggtaaattcctatttaagaactgacaaatatcactaaagatatgataaataggctgaatataaaagctctataaaaacactcttatagtatatgaaatgtaaatacaagatttaatagcaagagaaaagcaatatattaggaaaatggcaaaaataatttaatatacctttactatctagaatataatcaacatgaatatattagcttaataaaagtcttgtcaataaaacaaaactacagagtaagtcatatgattaccaatgaaaagtatgcaaattaaaatatgttacattatatatcaagctaataaaattatatgatgtagatatgagatatacattgcttttggttttacagattgattttattatacttgatggtgttatttctagaaatgataatgttgaattcgcaaaatctgttaatacgtatcaagaaaccttaaaaatgtttatattctttacccagcaattttaggaatttttgatagatgcatgcagaaatgttttcaaggcattttttttaaatttaaggacctaggaacaaccttaatgtttaataggaaatgagctatataaattatggtaaattcatatcagaaaagtaattttgtaaagattctatcagaagagtaatttccagattaaaaattttaatgatataatactaaatgagaaggatgcaaacaatatatttagtttgatgccttttaaattttataaggagaaaaaaaccaaaaagattactccagaacgtttaaagtgatcattgttagttcagagatcatagatgattttgttttcattgtgcttttcttcattttatgaattttatccattgagcgtgtattacctttgaagcttagaaaacaaaacacgaaaatctcttgaaaacccaaggtgtactgtgttttggagttgatgaagaggaggatgttgcccagcttcactgcctgctcactgtccaggcttgccaaaagatagcctatcactcttaagatacagacacccttttatattgcaaatggaaatgcaaaatgattcaacacctggagaagtaaatttgatgatacataacaaatctacctatgcatatatctttccacacagtaaattctgcttttagcagtttgtcctaaaaatataccacaacagtgtaaacatatatgcacaaagttcattgcagcattgtttcttaattacaagatattggaaaccacttaagcaggcaagcatatgacactgagtaaactatgacataaaatatgcacacaatggagcatctatggctgtagaacagaatgaagatgtctgtaaactgataaaatatgatttataggagatactattacatttaaaaagtttttaaaagtccagttttagaacaataaatctgttagcatgatttgatctgataattctacttttgagattttatcccaaggaaattatatggtgcatgtatcagggctttgggggatgggcgaggagcataattttacactggcaatgggaacatcgttagggttactgccaaaaaagtagggggtgggagtggcataaccaagtgtctgttaatagaagaatacagtatagttagtaaaagtaatacacaaacatctagatttgtcaaggaagtaatacttgggaagatagtagacaaagcaaagttagttttgttataccaccaaatctataaattaacatcgtttagaataataattggaattagagtgattttcagatttcaatgtaagctaggttcgcttttttaataaatcaaattaataataatgaaagaaaggaactattttgaaagctaaaagttttcgatactgtctctgtgccttgatacttctcctttaagatgcatttggtctccttgatgttattcagccttctagtcttcagcttagttatctcttctttcttacttgactcattagaatttgtttaaactgttataaaattttacagcttttcaaaaatgcaattaatcagatttgaaaaaaatccatttccatctattaaaaaatatatacacatgttaatatgtgtacacattctttattagaagtaagttgtatctgtgcccagcaattgaaaagtgtgttttctcttgccatgcagtttttgtactgtacatccatgttgcatttttaaggaagtaatattgcctgtgctaggctctgctacaggaagtaaatgatctttgtgtcagtgaaaatagaaggttctatcccatattgatctcttagcacttaaactagtgtgctatgcctcagttgcctaaaataggcagcttaagaattttgtaatttaaaaactcaaaaccccatagtatctgcagaaaaaaaagaaaaaacccttgggttttaaggatactaatttaaagctaatctgaacaatgtttattattttaaatatgtttgatgatagaccattgacgaaagaccattttagtttaacttggtattaatagaaatagacgaaagcaaaaggtagggttagtagaatggattagagaaaaataagagggaattataaaaagaaaatgtcatcttttattagcactattactcttgtgaagttagtccttgttttataaaatattttgatttgcattgaagatgacagtcaaataactttcattccccctgaaaggggacttcttaagtaagtcagaaactagttaatatccctatgatttttgagtactgccagtgtgtggcacattctgagtgctccctttatcccccaacagggggtgcagccccagctctgtggcttttgcatgcaggatctcagtgagtcctgaaggcactctgttcctcagatgccaggcagccacatctgtgaagctctcccattcctgaatttatctcacccatttagcctagactatgacctcttagagggcaggaactgtttgtttgtgtctctgttgatcctcagtgcctcttaattcagtgaacataagaatgaatgtatagtacttgaactgtttactatagagaatgaagttaggtgtttataagtaacatacatgttgtttttatcaggaaacagaattggttaagaattctatgcttttttttcaaatttaaacagaggaaggcaagaaacaactttactagaagtgggtaatttctccttgagcttaaggtgttcagcagtactagtggagtaaacttcagtattagaggtaaaaaattcatacccctgaaaaaaagaggaaaaactgtattataaagatttcatcactggatttccaggtttatctctatcacttaactctttagaagattacagtaaaacagtttgtaaaacttactgagtatgtgtctatttaagactttgctgcctgcttttgaatctcataggacttttgaaatgtgagatatgtgtcagtcccttcagtgtgtattatacaaaataatcatagagtaactagaaagtttaccaccaggctgtgttatttacacatttgtggaagtttaattctggacaaatgacagagaaaagcactgacaatatagtttcttatggatcattgtcttcttttaatagagagatccatcaagaatcaacttttcctgttgactcaaaatctccaatttgccttgatacattagtaaatatctgaagacttcatttcacccctggaataaagttattgccgttaacttggcagatgtgccaccattctccacttcctatgtcggatagctctgataaatgctgcattttcttcatcaacccagttcttgtctttatcaagatagagctttttgaattctttatttttccatcagagttggctcctaaaacgaaaccaatttgctatccttggtgtatgccaaaatcattggtgcactctcctccagcatgacatgctggagaacagaaagcttctgccagaatggttgtctctgcaatacaaacatctgctttaggaaatatcaatgagttttttgggagtgcagcagcaaaaagaagaagaaaagcctgggagaaataaaacaacaattagataagggaacccattgcttcaaacagtagtatctcatagatttatatcatttttcagatggcaatcaaggatgatctatcattatttctgtgcatggctttgctatacttgaagatgttgccatgatattataatttaagtcatgtaggatttctgatctccatggcaacaaatacagtttaatggagtatatgcctcatcagaatgtcaccagcaaagttctatatgttcttttaaggtgattatgtttgatagcatataaaagatcagagattatttaccaaagttacctctaatcacttcatgtaaagttttggtgctagagcttaaaaactgctaccaaattctgctactgatagacgaggaagaaaaggaaagaagtatatatcaagaaattagttttttgggcgagtagaatattgtttcaacattgcattaagtactaaaacaaaaattattcatcaagtcttttgaagtcttccttaatactgattaaacaacaaaacagaacccatgacaagagtagtcatcattagggcctttcctgtgtttttctcttaagattcccattagattacattcagaaaagaagaaatttagagtttgatttgtctactaaatcatactgtctttccctggggcatatgtagtgttaatggaaagtaacatgaggagggacccatcatttctaaatagtgctattacaacagcacttaagaccattgtcttttgtttctggctgtagcatgcccaaacggaatctgaattcactaaagagagagtgttgggataaaagtgagatgctggtaaggtggaatctgcttcagatggtgcagtaggcagtgagttacctagcaaagtaattttttaattattaactggagcttgggccccaaactctaatactaggtcggaccttgacaaagatactatttatccccccaccagtggtcaaacttagatttagaactcgaccagttcagtaagtctagaataaaagaaacctgaaatgaaaagcaagagagggattttccccttcttcaagtgccaagccaataccatccatcccagggcttttcagatctgtgtcccagctgctgaatgagtaagaaagtgtgtttaaaaagagggaaggagaaaaaaagatggtgtgagagtgagatcttttccactccatctcagatagacagaggagagacatgtgcatgtattcgttgtgcttttgccagatacggagagaatcttttaggattgaacactccggtgttagaaaaatcagtcacagcaatctaactaatcaacttgtacctctggagaaggtagtgggatttggggtagggtaaaggagggatgggtggtaaaagggacttttaactgtgtgcagctttatagttcgaattgtttaattgagaaaatgtttgtgtattacttctgtcattaagggagagggggaaaatccaattttagatcagaagaaaggtcagggacagaaaatggcatagcgatgacatagttgtgaaaggttgcagtctattcaaagaatggcgaaaacatgaaaacatgcatgcagcaggagcagtgggatgcaggggaaggcagggctgcgggtgatgggaagcagcctgccaggcgccttgcatcccatcacaaggactggaccttatgtaggagtgggggaggaccaatcaaagttaaagtagaagtaggtgttctttttttatagactgagtctcactctgtcacacaggctggagtgcaatgtcctgatttcaggtcactgcaacctccgcctcccaggttcaagtgattctcctgcctcagcctcctgagtagctgggattacaggcacgcaccaccacgcccagctaatttttgtattttttagtagagatagggttttatcatgttgttcaggctagtctcgaacccctgacctcaggcgacccgcccaccttggcttcttgaagtgctgggattacaggtatgagcccccgtgcccggcctttttttgtatttgtttttttgagatagggtctcactctgttgcccaggctggagtgcagtggcatgatcatggctcactgcggtctccacctcccaggctcaagcaatcctctcaccttagcaggaactacaggcgtgtgtcaccacgcctggctgatttaaaaaaaaaaaattttttttgttgaggtggggttctactgtgttgcccaggctggccttgagctcctggactctggcagccctgctgcctcatcctcccaaagtgctggcattacaggcgtgagctactgcacccaaccaaaataacattttgataatagtcataaaacatagcgaaagccaagacccttttgaaaaggttcatttatacctctatcgctctacagttttattcttctagtccttattcacaggaacttttttttaacctagttctaatcacaatctatatatcattttgtgttctgctgtttttacctagtcttcttggaataattttccgtgtggaaggttctaagcaagagagtaacataatcagatttgtcttttatgaaaatgaccctggcagcaggactgaagatgaatttgatgggaagagattcaaaatggggttaaagaatagggagtgtattcaacaggtgtttagggagtcctgctctgaagaaccatgagaggagagttctagcataaacatggaagtttcttcctgagcccacattttgaattgggagcaatcctttagcaaatagaaatgctgcctaattccatttggaaagcctttctctgccttcagcattttgcactatctcagaaatctggcttctctctgaagtaggccgggccctaagagaccacagagactaaccagtcttgattgattaccgtggtgcatgaaaacaattttatttgtcctgggtagcacctgtgtgtagctcccagggaatactgttagtgttgtggttagaagtgcgtgtgtgtgtggtagtgatagaggttctgagatttttttgtgaataaaacatcagtattattattattattacagcagtgcatattaattccaaaaactgctgcataaaattactttcaggatgataaattaggaagggagccccagactattcaaagacagggtagactctgctgctacccagtcttgctgattatatttagggcaagtcatttaacctctctggtgcctagtggactcaactttaaaaattgtaggagtttttaacctctgagatgttagtgctgccatttcagcaatacctttttttttttggctgggaataactatctttggtaggtgataggctagtatactacacattaaacgttggcagtaatagcttaggggccatcactacatatggttagagaagcctgtgaaatggttaccactataaacaggcttcactacaatctttgattttaaagtgatttatgtcagtatccgaagaggtgttcaatctagtttcacttttatttagcagactggtagaattcaagtcaaatcaagtagatagcaggatagtacagtgagtaaggagtaaaccagttgcctttttcttcccctctctgctttctctcccctcatcccctccttactccttctgctcttccttcgctttcctaaagaaagggcagcctttattcattagtgtagtagataccaccataaaagactataggtgacaatcagtatatattttaaagatttaaaaactgaaagctttgtaaactctttctttaaattttagcttactttttcacttaaaaatgaaaatcttaaaactgttcctgtcatgaaaaattcctattacttgactaacttgtttctaaagtactttattaaatttctcaataattcgtttatttaaatgtaggtgcatactttgtcatttccaaaaaaggatttctggtgattccttgcctataattaatttgctacttggtattaaatcatctttctcgattcatttttcctttaaagtcagagcaagacattttatgtacttgaaagagtgagaaggaaccacaacatgactttgtgagatgcttgccagtagtgaaaacagactgataagagggccaagaaaagcctcagccttctgtggagaaaagcactgccatatctgggccttcatgaaatttgcataccgctttgcatatatacatgcacagtttctttggtgacttcctgtatttggttttaatttttgaataaatgagattttttaaaaggtggatttgtgttatattggcatattgtctatttaaaagaaaccactactgtctactgaaaaaaaacactattttgtttccacagaaacctgctaatattttagttatgggtgaaggtcctgagcgaggaagagtaaaaattggtatgttatatctttgctaagtcacagtgtagcacttttttaaaacttttgcaggcagctatatcacttctaatttttgctataatatgcatatattcatgtagttccatatgatcgaagccatttctaaagagtatgcataaaagtgaaaaatgtttcacactcttgaaaggtgtcagacactcctaaagactgaagcattctaattatgaaaccgtgcaagtttcccagaaacctctgctttcattaaaaatggcctatagaggtgaggggcttctatctctgttagaggccagcctcacctttagtcacaagggcatacatacagcatgctaataattctactatcagttgtgttcgcttgagtcagattagatgagcacatatgcctctgttgacctcgtctagattaggagttgttaatacaaactctagggaaaaccatgaggctggatagatacagaaccttaagttctaacaagactgtctcgtagtaggcctttccctgatgggaaaaaataatgggcattctgtacatattttctgatagctctattttcttacatatcaaagcaaaattttacccacttctggtctgataatctgtaaggataaaactaagtttatttaatctgattttttttcattgtcatttccaagttgtgtttgtcacatatatttagtttgttttgtgtatttgtagaagaaatgtttaaattgtattaatttaaagacatcaggattgtaacaaagttaatagcaacttctgatcacaagatttaatataaattggaagtaacagctgatttgtatcacttcaccaacaaagaaacacatgtgtgttcttaatcctaatattcttccttataaatccccccagatctcactttccacttctaattagactcttaaaatactctgtttttgataaaactttgcaaatgtttagttatgaggaaatttgatgtgccttaacatactccaagtttggctttccttgagaagcagaacctgtcggcactcaccctagtgccttccaaaatgcctgttaagtctttacatgtgcttttaaaggagtctctccagtccatttttgcggcatcaaattcaaatgtaagttcaaagcatgcaaaatagaaaagagccagccaaacagtaattacaaaagtgttctttactgtataatttagggaaaatttatgtaatacactaaaacaatctagtttggaattatagttctatgtaatatatgtgatgttggcaggtttggggaacgctacgtcttaaagcattcacatttaagaagaaatactagttctgtaaatcagtatttagtaatcttattcatagttttaattatttgccaacttttgggtttttttttttacctttgtaattaaggtgattatagtaaggcctacttcattaaaaaatgtgtattaggaaaatagaactaaacttatcaaatggtgggtgaattttgaaatttttgaataggtggtatgaatagtgatcattcaacatgtattaggcaaaagctatgtgtaatgacaactgtacatgatactattagggatagatatgaaagagacgcaatttttgcctttaaaagatgatggtatagcaggataaacagccatgcccgaataactacactacatgttaaactgtgttaaatgccatgatgaactgtatctaatctcagttctagctctgaggtatgtgtatgtacctttgtcaaatcacctaacttcttgaaccatattcatctggagaaggaggtgatttaatcagatgacttttaaagtcttacctagcttttaaaaaaaatactgtgattccttaaaattaagttagtgaaattcatcccaagtaataggggaaataatggtgttaaaatattgcatagtcagcttctgattaattataccagtgaacaggcttgttgatggaaataatggaaagccttactctaactgatcccatttcctggtgcttgtgaccagtactaagaatggaaatgcagctcaacaaccctgtccctaacggtggggtgacacatggaaagaaaaatctgcccagagaagcaaggtcacccctgacctcaggcagcagagcttgactataaccccattgaagaactgggtaacagtaatttgaagagaatggagctttcaaacttgctttatgtaagacttctaaaatggatgttttgtgggtttcttcccctagaattgagcacatttttcatcttactgaataagatggtaaattagactaattggttagatttgtaaaaatcatttacttagcatgattttttttttattattttacagctgacatgggctttgcccgattatttaattcacctttgaagcctttagcagatttggatccagtggttgttacattctggtaccgagcccctgaactacttcttggagcaaggcattataccaaagctattggtgagtagaactaattaaaattccatgagtttttaaaagtttctttaaaagacacacattcctatatatttttaaattaagtagtatagcaaattataaaagtaagagcagactgagtgtgatggctcatgcctgtaatccaagcactttgggaggcggaggcagctggatcacttgagtccagtagttttgagaccagcctgggcaaaatagtgagacgttgtctctacaaaaatttttaaaaattagccgggcatggtggtgtgcacctgtagtcccagctactcgggaggctgagctgggaggatcgcttgagcctggtaggcaaaggttgcaatgagtcatgatcgcaccactctactccagcctaggcgacggggagacactgtctcaaaaaatataaataaataaaaaataaaagtaagagcaaggcctaacccaacattctactacctagaaatactatcagtagcaataggggtatatcattccacatacttctctctgcatagaaagatatcaaaaatctttgtaattaaatgggatcatattatgcattctatttaaaattttatatttaatttataaaactacaattttgaagtcctttaacttaagacaaatgtttcttttaccaaaagaaatactaacttctaaaagagccccctaaaattaaaggaaagacattatgaaaaacaatttagcactttaggacattttaatccacttttctgtttttgataatatcagttacctccctattataaagaatgaggaaattagtgctcttacacttcttcccctaccaacctctcaatctataagcagaattagtaatatcttcatcactttgtcaatgttgacattgttttgtttgctaaccatagttcccacagttgtttatacttaagttgtgcatttaatgctcagctgctaggcctttcaccatcgcttgtccattactcaaacctgattctgcttcattctctttggttgcattatcatcaagtagtttttttgtgtgtgctttacctttcttcttttctttattttgtgtctttatggtttccttaacttgttctgtatcctccaggatggtattaaacccacttttcctttactgggtaactgcatcctgaggttttctattttggattggttggtctccaggcatattctaccacttcatcctgccttttcccttttttattcctctgggttagatctattgctttctggatttcatgatttcatttcttattttgctacagtatgttctcatgtaaattcctttggaactgtatcttagaggtaaattttctagttcttgtatttctgaaaaatgctggtcggtatcatacttgctagcttgccagggtttacaattctaggtacaaaagaattttcctctcagaacttggatgacacccctccattgccttctagtgtcaatattgctaatgaagtctcctgcctgtcttgttcccagtcattggtagatcacctgggttttttctttctagaaacaaaaaggatttctcatccttgtatttcacagtgatatgctgaccacttggtgggcacactcaatctgaagttcatatcttgtatctgtgggaaattctcttgtgtagtcctttgatttcctcctcaatgttttctgtttctctctttcctcaactcagtgtcgtcagatgttaaatttcttggattaatcctttatactacttttttctcatgtttttctgcctttgtcatatccatttctaaaaacctcttcttgttctctgattactttttcatagtatcttgtattttttaatagaaagaaaagcctactatctgtgaagacaatgataacattgctgatttgtttgtattttgcagtattcccagaataattatctgtgttttctttacagtcactcttttcattgtatgttttgatctctcccttccatgtagcaagcattcttcaactgtttggtgacccttgagtgtctctttgtatttaaaaatcaggttactaaaactgcttgagaactttgtataaatcatggggcttatagagtgagaactttagggtgatacagcagagagccaccgttgcctggggtaacctctaaatgccagaaggcgcaggtctttcctctgaagccaaagtcttcagggaagagtcctccaacttttggcccatgctgtatgtacctggcagccccagggtgatgatagagagtagggaggaggatcagctcctcctgttcaaatacagactttgtagctggtattcccaagaacaaaatcttcgcagcattgtaggggaaaagtctgcttcccactcaacaacagcactgtgtcctgagaccttctctgaactgtcttgtctgccttccatcttctaggtctccacatggccagtttcttcttctcattcagaccttagtgaaaatagtaccttttcagagagaacttcccggattacatagtctaaaatagcaccctacctccgccttcacaccttcttttaccttattgtcttcattgactcaaagggtatctaaactccactaaaacaggtgtacctcacctcactgttcaccgttgtaaaccagtgcctacatagtatgtagtgagaactcagttttctttgttggatacttgaatgaatcttgtctctgacagtctcctcctgttcttgttactgtgcagttacacttgtatgactttgctgtcaattaaatgtagattcaagaagggaaaaggagcaatgtttgtgatcttcccccatattaatcttcaatccaatatatcatttccaaaaatctttatgttctaatcttcacacatgctttaagatcacattttattttacagaaaaataagtcagttagatatgggaattctctatactatctttgtaacttttctataaatataaaattattaatacaatatttagttaagtcagttaaaaggaaaaataaggatgatttattctagtcctattttggaatacatgttattacctaaatacatatctgggtatcttctttgcaagtgtactctaaaggcatttaaggacatatataaactaatgtgatacacagagatttttttccactcagaaaatgaatgtttaaaagcagtgttacttttggtaaagcatattaacaaactatacaaataagaaagtgattgcctaatcttatttcctattcactgaacacctgagacttgaatttatttaaattgagtaaaaaatatactatcacagaaacttgtgactctggctcactgtttattatcttgttatttttcctgagaagcttatgtcttattggaaacattaagatttatataaccttttactcactaggatattctacagtctagcagttctaatgcagggagtgtgccacaaatctaaactaccagcacttagggagctagattctcttgtcccaatggctgtatgatttgggagagaggcctttcttcatattttcctccctcctcctcctcaccaacataagcatttattgggtaactactatgttaggaggaccaaatatgaattcaaatgatgggccttaccctgaagagatttacagtccagttgagaagacagtatgaatatatgcatacaataatttagtcatctttgaacaacggaagtaacaaagactaccagccgaagttgtagtcttacttctatcactctggggtgtgtttacgcatttagtgctttagcctcagtttctgaaaatgagaatttagcctgagtcgtctctttgatctctctaaattcaaaagttctgtgcttttatttatttatttagagacagagtctcgctctgtcacccaggctggagtgcagtggtgcaatcttggctcactgcaacctccgcttcccaggttcaggcaattctgcttcagcctcccgagtagctggggttacaggcttgtgccaccacacccagctaatttttttatttttagtagagacagggttttgccatgttgcccaggctggtctcgaactcctgacctcaagtgatccgcctgcctcggcctcccaaagtgctgggattacaggtgtgagccacgacacccagccaaaaagttttaagcttttaaataaaaacagctgccttctgaggccgggaagttacagagggaactgacttgggtgcaaaggattgaaaccaaggtaagtgccattttctcagcagtggtgattccaacccacaccgtcgtctggtgtacacctgcttgcccaagatcagtcttggggaacactttcttctattgaaacattgattcaaaatttataatatacacaaaccactttcaatttaagtttctaaaaataaggtcaggcacggtggctcacacctgtaatcccagcactttgggaggccaaggtgggcagatcacttgaggtcaggggttcgagaccaccctcaccaacatggtgaaactccgtctctactaaaaatacaaaaattagccaggcatggtggcgggcacctgtaatcccagctgctcaggaagctgaggcaggagaattgcttgaacctgagaggcggaggttgcagtgagcagagatcacgctactgcacttcagcctgggtggcagagctaggctctgactcataaaaagtaaaaataaaataaaaataagaaggaattacaaaatggaaccttttctttaataccagcctctaccacacaatcccattcctcctgtctcctgcagaggtagcctaaagattaaaatactcaacaaatttctcacaccaccattaaagctgcttaccaagaacttccccagcattttgacttccttgtttgatagctgaattgtgagcaggtgatagaagagcctttctagttgaacatacagataatttgctgaatacattccatttaatgaaggggttacatctgttacgaagctactaagaaggagcaaaagcatagggaaaaaaatctgatcagaacgcatcaaactcacatgtgccccatctactacaaacagattgtagtgctgtggtggtttattccgttgtgcagaactgcaagctgagtcactaaaccaaagaaaggaaataataggttagtaaacattgtaatcccaggaactaagtttaattcacttttgagtgttttgttttttatttttgtttgtctgatttactttggggaaaaggctaaaaaaagggatatcaatctctaattcagtgccactaaagtagtcctaaaagtcttactgaagtatggacttttaagctcaggtgtttgtcctcaaatagctgcatggccactaaatgtgaggcattctgctaagtgggaaatacacattaaaatagagaaaatgagaatttcttcccttttatcaaaacaagaagcttgctattactacacttgttgattcaaatattattgagcaaagtcttttctcctcccaaatttggtctgtatagcatgccaattcctactatttcctttgcctggttagctcagtagctacctataagcatcacacattttgagaagtagatgaaacttatatgtttttaatttggaaagccattttataaggagtttggcaggcaggtgaacactaaagagactttccatgaattgggcacaatctaaaaaaaaaaaaaaaacaaggtaggaaaaagaaacttatttacaataattagaaatttatctgcaataatagcctgatcagctgactcagagttaatgattaatgtatgggtcaggattttgaagaaaggaagaatggtaaaattgacaaaggtgagagagaatagcagttataaagacagaagagttactagatgggagggagttaagcaaggttcaataagttatttttcctgttgactggactttttctttaaaaagcagtgtagctttgcatacattttttctgtgaaatagggtcttgctatgttgtcaaggctggattcaaactcctgggctcaagcgatcctcccgcctcagcctcctgagtagctgggactacaggcatatgccagtatgctcagctaagagcagtgtagctttaattatagctaaactacttacctttcatcttcctttacatattttattttcttctttggaatttttaataactaaccagatgaattgttacagtgtttattgggtgtgctgtaagtagaattttaaacatgcaaagccatccatcatccctttttgtgatcctacttagctgcctatgtggccattgattatcaaaggttagatttatagggtatacccatataaaaagaataatcacaaaataattaattttcccatatacctttcgatgacaaaaacaaaataggttggcctatgtttcttgatgagacttttccatatgatggtattggctaggcttggttctctgatatgtaaatacgatgtcattttttaaaatcacttgctgcagtcagtgtgaatctttaagtaaataggtgattaacttgttactttgaaatgtaaatatgtgaaattttagattaaattaaatatctctattccagttttggaatttaggaattctcattttaggttttttcttatttcctgtttaagtgacagttattaacatatctgaacaatcagctttgataaaatagtaattttgatttgttccctttggttatttatatttgtcacaggtattggttaagtcagtcaaaaaccatgtgttgagggtctgctatatgcacaccattgtacttagtttaggatttgttaagagtagaaatgaaatattttcagctttaaattctaaattggcaaatagatcttacctctactaatagttcttttgagtacaaatttaatatgaatgaaagtaaatctgtatcttgtgaatgaaaggaatttactttgttgtgtacagagaaacccatttgcctggcttttgtcaataattcatttgaatttataaccctttttttttttttttttttttgagacggagtcttgctctgtcgcccaggcaagagtgcagtggcgcgatctcggctcactgcagcctctgcctcccgggttcaagcaattctcctgcctcagcctcctgagtagctgggactatagccgcgtgccgccatgcccagctaatttttgtatttttagtagagacaggatttaactatgttggccaggctggtcttgatttcctgacctcgtgatccgtcctcctcagcctcccaacatgctgggattataggcatgagccaccacacccggccgaatttataatccatgttaacagtaatattttgcttttgcttcctgtcctttgcattaaatacttaaatttgcaaaatctgatactgcttatggcatcaagaaccactttggaaaaaaaactttgttaaagtagaaatgctgttaattcttaggcgttttgaggtcggacattgtctcttggtggaataccaccttactgattagtgctaacatgagagggtaattattagaccttgcaaattagcaagtaaataaaataaaaaatattttatcacaaaaatttacactgattatgttaggcgagtgcccaatttcaaatactgtttgggttttccgtttgtttttgtttagttttctttggttgtagttcccatgctccatatgcagctttactgtagttcacagaaaaggtatcacctggacattgaaaactcaccaaaatccagccagtacatttaattgggcttagagtgaaaccatttgggtggtatggaggtatacagaatgaaaaatcggggtggagggcatgggaatatatacttataataatgtttcatggtatttagtaattataattgcttaggaattaatatgagttattagggaaagaaagaaaaaaacactccccaagaaaataaaattgcattttcttttggaaagaaccactttattttgcacctttctttttcttttttccttgcctatttttctttctttttttttttctttttgttttaaagatatttgggctatagggtgtatatttgcagaactactaacgtcagaaccaatatttcactgtcgacaagaggacatcaaaactagtaatccttatcaccatgaccagctggacagaatattcaatgtaatgggatttcctgcaggtacacattattcgtttttgtttttgtttttaaatcactgttgtttgaacttagatgtcttcgttggagaggtatatatttttagctgatggaagctacttttacttgagtctttgttttttgacttgcatttatcaaagatccgtagaaacagcaaaatttgtagagtttacatattggcatggaaatatttatgggttttctgaatttcaggactgtatttttgtttcatcttgttttacttttttgttttgttatttggtatttgaaatgataaaatatgttcaatatctgtattaaaaaggtacctttagctcttaccagtagaaactataaatgaattcagtagtaggaatttttttctggcagcacatataatactgccactatttggcattcaaatataaattttgaaccttatttctatttagggcactatacagaatcacattatattgaataatagcatttaagtcttctcttagaacagtcacaatgtgggtgagagtcatagtaccctatggtgagttagcctgctgttttgcaacagagagatggtttacatgtatcctatccctggtattagatctctccaactgtatctcaatccctagttatattacagaacggtaatcaccaaaaactgctcagaggtccagaataatgagaatttgtttaaaacacctaaattttggctagtcaagtacttagtagaaagtgtttcttattaggaatatttctcaggtcactataaactcaagactaatagagataatacctgggacttttaattctacattcccttgtaagggtgttaattatcagtaaatgcagaataactacacagatactgcctttctccaaaattggtcaccagtgtggagaagacttctgttgtgatgggaattttatttattcagtaaatatttattgagtacctgccatgtgccaggcactgtcttaagtaaaaagttattgatgatgtaacagacatgatttttgcccccttggagtttgcattgtactgctatatgtagaatgtttaaaaagtaggtatggttttgagtagagacagaagaattctgttttcttcctgcttctgaatgtgtccaccatttctgagcccacgggaaaggcatagcttctgtgagggagtagatgtggtgaagatgtctatcagtgactcttaatatgtggttcagaggttagggtggtttataaggaagcttggaaagcaggcagcagaggttagatttgatagctaaagaatgagaatccatcagttcttgagtactagagacatgctttatgttgcattttagaaagatttagtaagatggtggtaggtaaaaatctgttaaaaagagctaactgaaatcagaaaccagctgtagcagtgctgcagacagaaagtagagtgaagataaggatggagaaaaaagggcagatggaaatgttttataggaagtgtataagcaagggaaaactaaagattatcttaaaatttctagcatgagaaattgataaaacacagaaattggagcaaggaaaatagttaaggagaaaattccatttaggagtgtagtgtatgtttagtttacaatatgtgatgtctttggaggatagttaccaaatatttttacaagtaagttcaaagaaaagcaagcctctaaaggccatttaaaagctaaaggttttgcgaggccgcggtgggcggatcacctgaggttgggagtttgagaccagcctgaacaacatggagaaaccccgtctctaccaaaaatacaaaattagctgggcatggtggctacatgcctgtaatgtattacaggcatgggattacatgcctgtaatcccagctactctggaggctgaggcaggggaatcacttgaacctgggaggcagaggttggggtgagccgagatcgcaccattgcactccggcctgggctgttaacaagagcgaaactccgtctcaaaaaaaaaaaaaaaagagctaaaggtgctgttaagctgcctgtgacagtcctttgcacctagtagactctcaggaaaacccattggcagatattggagagaacacattatgtagcatgtattgtttgagcaacttggatgccagcaaaagtagctgaaacgttttgtacttaacgtatttaggagctggggttgttttgggtaatgttaaccagactagccaaggtaccagcccacttattaatatactaattatatcctaccctattgtgcaaatagttattaccccttcttccattgattgcttatgtaaagaaatatatttaacaaggtgaaaggagggctgtatcataaaaagaagtatagtttaaagccactgaggggaagatcttagatttctcattgaagaaattgattgctgacttaaccaagaaatttggtagaaaaggggaaataagcagttttactaatagaaagaggacatttaataagataaatagaaatatgtataacttattcttctctagtgacagaaattgaggcagcttatagtaaaacatacagaaagtttgcagtttaaaatttaaaatataaacagatatataaagttatataagggataaggaattatgtttacacttcaagatatttactgttgctgaacatttatttgaagacagcttttttgtgtggaggttgaacggataggaaatgtaatgaacgtggtaataacctttttaaaaattctcaagaataggaacttaggcaacataaaaatttatcaatgtatttcacagataaagattgggaagatataaaaaagatgcctgaacattcaacattaatgaaagatttcagaagaaatacgtaagttggaaaaaaagagactccttgttgatttttgctttaccagaatactcagtgtaagactgaatattcaacataataaaatactcaatataagattactctaataaataattttacttatttactctaataaatatttttcatgatgacagtctttatttcttaagatgcttaaatgattatatacaaaagtgactaatattagcagctgatttggatataaaacaaattcatgtctttccatattgactactttttggaagctagacattagtgagaagtatcacagctgaataaataagaatctaaataaataaactttggtaatagccacttgctcaccaatctaggttacagtaattttaagcaggttttaacagagaagaatggatatttcacctgtttacaatgcaaagccagggattgggagagtttagtttgtatacctatgacaaaagtattttacacttattggtaaggctgaattaaacttttgacccagatgttatttaaaataattgttaaaatataattcatgtgaaaaaaaaagctgtttagtgtctgttattcatgaaattgtcttacatttaatcatcggtatcctttcaaaagtgaccattgtggatattgaatgaaatagaaaactgatttaattctactcattttatgctcatagtgttttcaatatatattttatatcggttatgatcaaaataattctcatcagaaggactttagccaatgtacaattaacctcaagtctaatatagctatttcatagtatttctctttcaggtataccaactgcagccttatcaagtatatggaaaaacataaagttaaaccagatagtaaagcattccacttggtaagcattggttaacagtattaatgaaatgcattttttccttaattgactagcccaactgaggcttttttggatcaatttatgtggttacttagctagcactcagagtgctttcatggtaaatgcagagatcttgttagtgcataccaataaagacaataaactatttgctcttccagactcatatcatggtttgacagactaatgtttggtcacattagattttctaaagatagcgatggtaacaaatctgtcaaaacatttataaaattacatgtattgtttttcgtctgtttaagattttaaaagttccagagaagtatcaagaagaaagtacttctcaccattgataaatagattgttttgtatttcagctctttgaaagactgtttacaaagttcttaatttccaaaatacctcttataaccttaaatgttaacagtcattcagcgattatatgtgctatttgatttttctggaagaatgtgatagatgccatatttatcagtgtgtaatggaaaaatgatttaacctagaatctaattgaatccgtgcactaacaaggtaatttgtgatgaaattatatacagccattaccaactttgtttacaataaaatttccattgttacagcgtaataattaataatgttttttgttttagaaaaaggtttataacacatagaaggggagtttggggaagcaggttgtattttgcttggcttgaaattcttttaatccttattcctaagttcttaaatgagaattctttcaccttgaagaggttaacctttcctttattgcaaccaggccatttggcaaacatttcttctgttcttcctttgtttctcctttttcttctctttctactgcttctccttctgtattttctacttactattatatcagttcacattttatatcatgtatttcatatcttaacagcaatttaaaaagtcattcttaacctgtcatattaccacacaatatattatccagataatggtttattataatgtacttacagtaggacccaaattagaggtctaagttagatccttcgaaattatggacttactgattctaataaaataatgatagtggcagaagattagaagtcatgacttaggggaattattattctccttgattccctgctactcattatagtctaggatgactctgcctaccatcaccactaaaactctagagatataccttccttgtagcttatgtgcttgtttttaccagggtgacccatcttaattggaggtaatcttgagtagtctcttaggaaagccctattataattccattaaaactgttgggtattttcaatagcaaattcaggcctttcctttcaaccctaaaaataaaattgtgctttctctgaaatatcagatcattaaaattaaattttaatctcaccattctagcgttttatttgcatcttaaaatatgtcgtgtcggcctggcgtggtagctcacgcctgtgatcccagcactttgggaggccgaggcgggcggatcacaaggtcaggagattgagaccatcctggccaatgtggtgaaactcctaaaaatacaaaaagtagctgagtgtggtggtacatgcctgtagtcccagctactcgggaggttgaggcaggagaatcgcttgaacccaggaggtggaggttgcagtgagcctagatcgtgccactgcactctagcctggcaacaaagcaagactctatctcaaaaaaaaaaaaaaatgtctttttatcctgtaaaatttgtcatctttctttaagttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctcccaggttcaagccattctcatgcctcagcctcccgagtacctgggattacaggcgcctgccaccacacccagctaatttttgtattattagtagagatggggtttcaccatgttgaccaggctggtctcgaactcctgacctcaggtgatccatccaccttggcctcccaaagtgctgggattacaggtgtgagccaccacacctggcctctcttttaagtcttaatgtgtctgttagttcattggttttcaaaatgcagtctcagtccagcagcatggtatcatgtagggccatgttggaaatgcaggcttttggctcctactcacatctaccaatcagaaactctgtgaggagggcccagcagtctgttttaagaagttctccaggtgattctcatgcatcctaaagtccgaaagccactgcattagatcagagtataaactaagagaccacatattagaatccaattgaatgaactatgtcttaactaaaaaatactgaatcttcacattagtgtggcatttatagtaataataacaataagagcaagcacttacatagtactttctttatgctaggcaccattataattgctctccatatattaactcatttaatcctgaaaacaacctgtgataatagtcaccatttttaatctccatttgacaaatgaggtaacaaaaatattaaggtaacttatccaatgtcacgcagctaataaatgttgagtcaggatttgaatggagcagtcgactttcagagtctctgctcatcacacagctctgtactttgtaagttgtgtatcaccatttttatttagactagaacagcactgcacagtaccactttctgtgatgatctgcacagtgcagtagcgtagccactagccacatttggctcttgaaatgtgcctggtgtaatggggagattgacttttttatttaattcagttttgattaacttggatctaaatatgaatcactgcatgtgttagtgtattatatgtgtaacaacagcttttttatcttaatagaaaaagaatagaaaatacacaaattttggtcctgttctaaattggataaagccatttagataatgggggtggggatccatttgtttagtcagagaacataagcaagagtaaaacaagtgagattatgaaactggaatgactaaagtgtgaattactacattaaatttaacaactaggagttttgttgttaatttgggggaataaatattttccaaattgtgatgttattcaccaaaaaatatatatcgtcttcacatatgtgctgaaagataactgtgagaagcaataccatcatgtttgtatgatttgtgatttcagcttcagaagctgcttaccatggacccaataaagcgaattacctcagaacaggctatgcaggacccctatttcttagaagacccacttcctacatcagagtaagtggcctagttggttaactcatcagcatgatggaagttttggagtatgctttcttctgcttgtcagctcttaagttgctcctcctcttatatgggaacccaaggaaatcctttatgacaagcaaaaatgagctttgctgattaaagtgtcatttaggggctttccagttaagaggcattcctgttcatctcttgctttatgaaatgctgatcacattagtttcagtagtgatccagctattcagtgacaggttggttatgcgtgctgtagctccttactgtctgcagttacagtttcatgttccaaaattgcaaatattcccaaatgtgttccctataccatcttttgttttgttaataaatgtagtaggaagggtaaaacaaaaattacctttgaatggtgacacatacttcagctagaatctatatttggtctgtattaatagaagagtaatgctgggataaaagaagaaagctgaatcatactcgatgattattgatcatttgtatacagctcaagccctcaagtagcctgctgtaatattactagttacaaagaaaagattcgttttgtcacagttacatgaaaggtgcttatatttgcaaatatggagacaaagttcatcttaaaagattaaaatgagaatctcctaaatgaagcatttggaatattgattagtataccagaaatggtttttctttttcttatgatcagcgtttttgccggttgtcaaatcccttacccaaaacgagaatttttaacggaagaagaacctgatgacaaaggagacaaagtaagtattaaagtactgttagcagcttcttgtttcgtgaatgcctccataacattttccattgtgggtatattttgttctccctctgagctgaactttttctgtttaaccaattgagaagaaccagcagcagcagcagggcaataaccacactaatggaactggccacccagggaatcaagacagcagtcacacacagggacccccgttgaagaaagtgagagttgttcctcctaccactacctcaggtggacttatcatgacctcagactatcaggtattccaagtttattttgtattgactgcatgtcagtgtttacatatgggtttatgatcgtgggaaaatgtgatttaattgagaaatactgacgtctgtatacccagggaaatacattaacatgaaatgttactggcatggaaaagtactgacagtggtatggtagcaagggtttagacttttgaaccagacttggaatgatcaaatacaaattatgccatttattaactgtgtgaccttggacaagtaggataatatctcctggcgttttttcatctgtaaaatgaaactagtaaaacctaacttgcagctgttgtcagattagacatgaagtggcttgacacctagcttatggtaggagcttgatagctattgttttggaacaatgtttcacagtgattaagaacataggctttcagatcccagtctggccacttacttctctgtatccttgagtaagtgattcagatgttctcagtttccatttgtagactggataatgatcaatgtgaagctgtagtaaggattaaatgagataactctgggaggttaagtgttgcagccatttcaggaaactgaggcttgtagaggttaaataactttcacatggatccccagcaagctgtagatgcaggactcatatttgatctgaccacaaaggctgttatgttgcctgcttagggatcctatcatggcattgtcagttacgttgtggaaagaccctctttgaaaattgtataccacctccttttctcttctgcttattctaaccatattcccaactacacaagggttcagtgtgggaaggatactgaaaatctgaccaattagaattatttacacacaaaaaaaaagagagagagaaagagatgttattaaactgataaggtcccgagtgctcgttactgtactttcagaattaggtattaactctttcttttggttaggggagaagtccagcccatcacaccatggaaatcactgttgtgtgagtagtaattctcttccagttagctaaacaaggacaccaagggcagacagctgtgggagttgttggttccagtatctttttcttcctttccggatgggaagagtgcatctctcttggcccacaaatgtgtttgcacactaaggtgatggcatccttagaaggaagcagagcagtgctctgaccttcgcttctggaaccgagaaaatgatgccatgctgctttgttggtgtgattgttgttggttttttgtggatgaattttaaaatagtatttgtgactatcatttcatgtgtccactctttttaaaaatgttaccttttctaggattggcagaatttggaattatatgtcttattaaatatgctttgaaagacagaagtaataagttctggttaatcttttatagtgtttgtcttgggagcaaatagtatgagagagaggtgtgagaatgggaataataatctaacatatcaaaattagagaaccccaaaccatcacattctttctctttgtgccattttagaattgagaataccgtccttcttactgtggttatatttttacttttgtatataaacttgtagcagaaaataagattcagtagcttaaaggggccaggcactgtggctcatgcccgtaatcccagtggtttagaaggctgaggggaaggatcacttgaggcctggagtttgaaatcaacctgggcaacatagcaagactctgttccttcaaaaaaaatttttaaaaattagctgagcatggaggtgcatgcctataatcctagcaatgattataccattacactccagcctggatgatagagtgacaccctgtctcaaaagaaaaaaaaaatagtttaaagggcataaaaatgtattaatgccaaagaaatggattctgtgataccttctcctatcatactcacttttactcttcagtcatgtgtgtgggggtgagttttctactgaagaaagcatgtaaataagctttgaattttttatgtatacatcattaagtttctgggtaaacatctcaagcaaatttaccaagtagatacaaaacagcataaaaaggggttactcctgtagaaaaaaatgtatttgcacagcatagtaataagcctaggcttaatattatttactagcaatatttctgaccttcctcaagagaagaggatgttaaaatatttggggtttttgtctttaattataaagttagtacatagcacaaaacctatacatcctttcttccttgaaacataatgacacttcagtcacatattgggattgagcttcccctagaagcacctgaatcacacttttccctcatctcctttccagcgttccaatccacatgctgcctatcccaaccctggaccaagcacatcacagccgcagagcagcatgggatactcagctacctcccagcagcctccacagtactcacatcagacacatcggtactgagctgcatcggaatcttgtccatgcactgttgcgaatgctgcagggctgactgtgcagctctctgcgggaacctggtatgggccatgagaatgtactgtacaaccacatcttcaaaatgtccagtagccaagttccaccacttttcacagattggggtagtggcttccaagttgtacctattttggagttagacttgaaaagaaagtgctagcacagtttgtgttgtggatttgctacttccatagtttacttgacatggttcagactgaccaatgcatttttttcagtgacagtctgtagcagttgaagctgtgaatgtgctaggggcaagcatttgtctttgtatgtggtgaattttttcagtgtaacaacattatctgaccaatagtacacacacagacacaaagtttaactggtacttgaaacatacagtatatgttaacgaaataaccaagactcgaaatgagattattttggtacacctttctttttagtgtcttatcagtgggctgattcattttctacattaatcagtgttttctgaccaagaatattgcttggatttttttgaaagtacaaaaagccacatagtttttccagaaaggtttcaaaactcccaaagattaacttccaacttataagtttgtttttattttcaatctatgacttgactggtattaaagctgctatttgatagtaattaaatatgttgtcattgatataaacctgtttggttcagcaaacaaactaaaatgattgtcatagacagtgttttatttttcctgttggtgttgctgatttgtgagcatgctttaagatgaaaaaagcatgaatgataacttccttaaaaaggtgcggcatccaattcaaatattttcgtcctgattttaaagctggttggtgtagtgctattaaaatttcgttcagttaattttccttttgaaaacttgttcgcacgttgtttagggtgcccttacttcagcaaaggagaaggagtaggagagccttagaatttttgaggaaaaaaaaacctataacatacaatgtactgtatcaaactattttacatgaatgacacaagtattctgaataaaaaataattgaacattgttaaaaacaaggtgttatgtaataaatttatttttcataaatcaaaacatggagtcagctgtcttttttatatgtacaaagggtttttgttttaattttaaattatgccttaataagtagcctctgaagaaatctcttcacttttcatgaagaatatctatgtgtctgtctccataatagagtactgacttgagtcttagatatggatccttttttcctgctatactcggtaccataatgtaagatatgaaacacagacacctatctaattggaagatattggtgagccttcaatcgctggaatcattcctaatttattctgtgttgtactgagaaggatttgactgttgtatccctaataattaattttcctcctccagaaaatacagaagattaggaaaaaaaactaacttttttcttaaaaacccaactcaatgatataaaaacattctaaaacaaaatcactgaggaatctctgtccttataggcccgacagtacagtaatggtaatttctaggagctgaattcatgtttccattttaagtcctcctgccccaacgcattctcaggatgtgtggacctggttatgagttcccctcctgagccctcaggagctccctgccttccatagtttggtctgggttttttttctttctttctttctttctttcttttttgagacagtctcactctgtcaccaggctggagtgcagtggcgcgatatccactcactgcattctcggcctcccaggttcgagagattctcctgcttcagcctcccaagtaactgggattacaggtgcccgccagcacacccggctaatttttgtatttttagtagagacagggtttcaccatgttggccagactggtctcgaacgcctgacctcaagtgatctgcccgccttggcctcccaaagtgctaggattacaggcatgagccactgcaccgagctgatttctgtcaattttacctcttactgtgccttcttatttcctgtccattctcattgttttctaatattgctccctaccgttaaagctgaggtttttcaagcttagtggatatgagaatcctctggagtatttttctgcccttcagggagggctactctactgacatgagtttcctatgtgaatttccaaaagcgaaacccattctagagtggaccgttccactctaacggtacaagagcctgaaggctcaattctcaggtttttgtttctctgtctgtcctcatt

SEQ ID NO: 15617 - DNA, 135171 bp, Human
tgtggctgtctccaggtttctggttttgtgataagaagcactcctatttagtaggcacttttagtcaagattctgttacaggtcaccaattcactccctgatgcagcaacattttattaaggatgaggcacttattagcggtgggctctaatcctctaacaagactgctctaagcagtttttatttaaaggactggttcacacaagaccatatttgaaataatttatttgtaccatgaaccacaacactaggaatagaatcatatttaccacatgctcagcactgtactaggcattataaaaggaggaaagaggactgtaaaataagggccttatcctcatggaactgatgatctaattagagaggtaagactgacctatatgaaacaaacctgaacactttgggatgatgtgtttaagggctaacagtgagtgcaaactaagtgtagcagcggtttataaggctggggtcaccgaagagggaagcagccagggaaatatgattagcaaccttgaaaacactctgggtatctatactttcatatttttgagttctaaattaatgacctaaatatagacatggaagccattcccctgggtaagtgaagatgaaatgaaggaaagtcattttaatttgaatgccaatttagctttcaattcagcagacatttgtcactctagtatcaatatttaaaatactgggtcactgtaattattcaccaaaatcctgtttaccttgttaattaccagcaattttttaaaatgatggcactttatggaaactgaatatacgtcatctttaaaaagagcttttaaaatccctcctttggaagtaatgcaggttaatagattagacattttatgaagagggctgcatgatttttctactgcatttctggtgttgcaaactttggtgaaattattaactgctattcattttttccaacttttagttgtctctagctagatgttgatcattattacacatctgtaaagaaaagagcaaaccaacttgaattagtgtttcttgaactattcattagaatttaaaattttttcctaaaagtttttcaatttagtgatcctattggtaaataaaaagaataaaggcatgcaaattaaaataaaggtaacatttctattagatgtttttaaacccctttcctttgtgacctagcttttctatcttggcttttctatcttttcttctcttcctttcctttcctcctcttttctttttcttaagtttgtttatgcctcagtcatctggtcgcacgtggctatgttccactgtggcagggcttagctggcagtttcagggatatcttagttttaataagtattgtggatttcctcacatctagggtggagagagattggttatagggtgataaaaacagaagaatctgtgttgaaggagatgggaagattttaagaatgctaacgaatttgagcagggcataaaaccaacccatgaacagggctacagtcctctcagggttgcctgaagcctcagccctggaggacgtctgacaccttacaggtagaggacctctgtgcaggagccctcaacacccagggaggattaggatataagcgcaaactcaaaggtactgtaatgggcacctagcaatcagaggtgatacaagggtctcttggcccgaagtatccccacctctcctcgctggaaaggacgctgcctaagcctcatcccgagctgggggcggaggaccaagggtgagagccaccgcctccgcaatcccccgcccctcggcaccgtcgctcagcgcgctcgccggctccctattggccgaggcactcgccaatcctggtgaagcggccccgtgagttggccctggttggtggagccggcactgagcccccctcctgctccggccgagcccccccgccgggagggggcgtggccgcggccgtggacgggccggaggcggcgtcgctcgcgccgctgcgtgcggtgtggtgcgaggcgggtgcgccgggcggccgcggcgcggcgggaccatggagctcagagcgcagccccggcgccggcggcgggaccgcggaccggtgagtgagggctgcggtcgccccggctctccgctgtaggctgctgtggccctctcggctccgggccgggcggctgtcgggggaggggcggccccacggcgaactgaagttgctgcatcgccgcgcgctccggccgggcggcggggcccactgcgggctgcggcgccgcctcgcgcctatccctgcagcccggccgcattctcccggccggctcccgcgctggcaggggcttctcgccgtcacggcgcggccaggcggcccttctctcccgcgcctccgggcctccggccctttgccgtccggtgcgcgctccctggactcgggacagccacccgccctccccgccgtaagtggcgcccgggcctccgctcgcgccccacgcacgacgccccgggccgctccgcgtccgggaccttcgcatccgttcagtgtctgcgcgccctcgctggttctggtccagctccgcgtgccccccggccccattcggccctccccgccctggcctgtgccctcttggtgcccgcgtgcgtgttggttgcgggcgtcctctccctcgaggctgcggtgccgcgtggctcccggcctcggagaccaggccggactcttggagtgcaggggaggaggtggggcggcccgcgagtgcgggggaccgcgcgcacggagccgcggcgcgcggggtatcatccccgggggtctttacccgcgcgcctgggctttagcgagggcagaagcttcctctcagtttgtggtgctgacgtgcaatggcgattgcttcttgatttggcccctctgcaagggagagttccctggtggagacgagagttcttaattattcagaaactatgtgatgggcttagggatcaatgggagcatcataggaattctttctcattttaaggttaatttttaaattagcggtttacttccagcaacagtctcgagttttcaaaaactgaaaattaaaaagactacttttcgcagttcttcaaattaaatgcatagcagaacatggtattttaagattcagagtctactttttataagggggagaggatagctatttgaaatattttgcatcttaaaaattaggtttatctaaagcttaaaatgcgactctatcaaaactaagttcaaagtattgtaattgactaatctttctattgtctctagggcaaattctattgcttctttttatatgtgctttacccaactctccttttctagcagttaaacaatgcagtggttctttaaagctagttcttttatctgcttgagaggttaaacaaacgaaagctgggtttgacctttcccaaaggcattctcattgtgtcctctccagctcccttctcccagggttctaatgacttcagtgtagtactcatttttcttcatcttgaaagattttcttagttggtattcacaaaagctgtgtcttttcacatgtttaaatattggaaagtttggtcaactattatatttaccttccaacctgtgcttattctagaactatgtacatatagaaattgttcttgcatttccagttggctgacatgaagttgcttaatagcatttgtttttaaaaaatctgtttgctttaaaatttacaacctaatagtcaatgatgtgcttcactatcttcaacaattacgaaaacaaaggtggaacacactttgctaagtggtcatgccaacattgtaacctcctatctcttgtcagtgtgtctttgtagtcacacgttacggttcccatagaaacctatgtatggcaggtaaccttttggttattgggatgttttgattaaaacaattgcgttataatgcaagtattaaatgaattgtccctactcacgggctagtactagtgatcgtctttggaattccaaggactttctttgaagagtactcccagattgtttttcactttgggtggctctccattgctgtagaccttgaatctctttttcttttcttttctttctttctttctttcttttttttttttttttttttttttttgagacggagtcttgctcttgtctcccagactggagtgcagtggtgtgatctcggctcactgcaacctccgcctcctgggttcaagcgattctcctgcctcagactcccgagtagctgggagtacaggcgcccgccaccatgcccggctaatttttgtacttttagtagagatgcagtttcaccatgttggacagattggtctcgaactcctgacctcaggttgatccgcccacctcggcctcccaaaatgctgggattacaggcgtgagccaccgctcccggccgaatctctcaacttctcttctcagtccgttttaagggccctgtttctttcaagtcaggctttttttggctttgctcttgggcatgtggaactaaatgcttctgacagccccacacattcttcttcagggctggttctttacctgtggcttgactttatgctggtaatacagaaatattttatgccagtaatacataaatgatgtacattataaaataaacaatatcaacacagagatttatagaggtaaaaagtcttaagttttctttttcccgtcttattgttgtcctattcctatttctttcttcagaggtaaccataatatagggtgtatccttctggattttttccatttaatactgtagatgaaatatataaccctgtatgttaaaaaaaccatttcatgaatgcctactaagtaccaggtactattttaatcactagggttgcaaaaataagagacagacgctttcaagatgttcatagtctaccaggacaagcaattacagtgcagtgtgataagtaccatgatagagtcagtaatcagtgagggatgtaggagcctcatgcatgacctaatccattcattcatttgctttattcattcagtacacttcagagttttaatatgtgccggggatacagagataaacaagacagatacctctgtcagcccccgatgagcttgctgtgcagttcagtctcaaagagttttaaccgttggttacaatgtattgtttgatatgggatctgaaaggggccagcaacaagagctcagaggaggaccataaacccaagcttagggacgttcagagagacaggaaagcctcccagaggaagcaccatgagaaggaattggtcgaagtctgggttgaggagagggtgtacagagagatggtcagggaggtgatgcactggagcaaccacaaacaccaggagttcagtccagtgggggtggttgtgggcaagggcagggaagtggcaagaagtgagggaggagaagtaaggagggactgtgccgtgtggggtcttgtgattactgttgtgtggagttcggagacctctgtgggcaacaggaaatggttgaagaattgtaagcaaaagagggacacggtcaaatttgccctttggagaatggattagaagagggaaggcttgaagcagggaaatttgaggaggtagaattgctgggatttggtcattggccgtgtgtgtgtatgtggtggggggagttggggcagggaggagttcagggcagtgtccagctctggctgggtggttgggtgatggcactgtccttaggtggggacagagcagcatccattttggggaaaagattatgggtcacacttggctgggttaagtttcaggtgctgaggggacagtgtgttcagttggctgcactagggatccagataatcaggagttgtctggattagagagacgcatgtgagagttattagctgtcccagactgtctcaaacagtttgagagtttcccaaactatcagctaaggtgctacagcaaacagggagactgggggatgtttcacattgttgaggaaaacacatagttccgtctcttcaagcctgtggaaactactagctcaagatagttaaaaatgtctagattagattgcactccattccattcgatgacctcatgtttgtaaagaaggatttttggtggttgctgtagcacgtgaaaatcagtgtagaaaaggaaatgagggaggccattgtccagtctgactccaaggtttgagagaaattgtgcagtgctcaacaagtgtacacatactgtattagtaaatacttgtggttatctaagaatgaaataaaaatgccattttttctctctattaaagtgtacttttttcaagttggtaccaagttgttaggacattaagtacttacgtttttaacattttctttgctcaataagcatttgttttggcctgagactccaagggtgcggtgaacagagaaagttttggaactcctgcctttgcctgtgcagtatttgttaatggaagctgttggagtagatgaggtcatttgaggagtgtgtatagagtaagaaaaggagtggtgtggagtgagatctgaggcactcttgtgtttgaaagggaagcagataataggctcccacactgggactaagaaggatgggggtcatggtgtccgaggaaacctcagcaggcagggcgtgctcagctgctgcgagctgttagtaatacaggggacactagaggcaacagtgacatgacagggatgggagggggaggccagtttgtatcaggatttaatagtgagtgagagtgagggagtggagcccagcatgtgtagacagcaatgctcaagaaatttgatgctggtggttaggggtggttatagggagggcagataaagggggaaccctttggtttttgttttttaaatggggggatttgagcatgtttaaatgctggtaaagaaccaggagagggtaatttcagagtttccattggagttagcccactagatagcggtttcagagtttccattggagttagcctgaggacatgatgaatgatcttggtgaggagtctgtggaacctcattgctgtggattgcagagtgaagggtgttgagggagggaagctggttctttcccaaacttgattatgaagaggagagaatgacattaactggagaggggcatctggtgtaggctgatttcctcccctcccctcccctctcctcccctcctccctcccttccccttcgcctccctcccttttcttttcttttctcttttcttttcttttctttctagcagtgactttattttctcttttttttgctgttgtcttaagaacaccttttgtcttcctttctcaagacatgctcttctgaggactggttgttcctttgcagggcggttgcttcccaccctggacttttcctaggtgccattgtgtctccaggtcgtgatgtctttgtggctgactgtcctcctttgctgtcctgttctgacagaatactctctcctgtcagtgttttttctgctacttacctcagcaccagttttgtgtcagatcctatccgcctatcttcatagatgtttttatttttattttttgtagagacggtgttttgctatgttgcccaagctggtcttgaactcctgggctcaagcagtcctcccaccttggcctcccaaagtgttgcaccgcccccgatgtcatagatgtttatagattataataatttttccgcactaatgcctggtgtggtggctaacacctgtaatcccagcactttgggaggctgatcacctcaggtcaggagttcgagaacagcatggccaacatggcaaaaccctgtctctactaaaaatacaaaaattagccagttgtagtggcacacacctgtactcccagcttctagggagggtgaggcaggagaattgcttgaacccgggaggcagaggttgcagtgagctgagatcgtgccactgtactccagcctgggcaacagagtgagactccatctcaaaaaaaaaaaaaaaaaaaaaaaagaatagtttttccatacttagatttcagccttaatctttggagccaaagatgcttctgtttcttctctgtgcctgcacatgtgcctcttctctgggagattagctcttctgactttttttttttttaaattttaaaacattttaaacatcacagacattctagggtatttctcatcttttaggtctcctggagcttctaggccttggctctgagctcagcatctgggatgatttctcaactttgtactttctgaaatttccctgggatcttttctcagggtgccctctgaccttggagcagtggtcttgaaattgatctaaagatatcttctgttgtgttatatgttcttgaacctttttggtattttaatcttttcttccttttagtttttccttaaatacttaagtcagcccacacatgtttgtatgccaactatgtctgaggcactgttctagttagcagtgataagaatgtttaacatgaccaagctgctgccctcagaaagcttatattcaagtgaggtaaaacaggatagattatcttgctaactagttcacaaactccttgttggcaggaaccacatagggtggtgccttgtatataatctgtgcatagcatatgtgtgttccagcttgtcagataacctcttgaacgttgtcgtcatatagagaccttcatttaggttttgcacttatttcactgtggtaacacttggtgccttctcccactggctgtcctctcacagcctttgtgatctttgatcttggaatgcttgttttctagcagttgaaagctgaattgaatttttaaaagttcctctagtgcatgctgaagattttattagcttgctgcggcagttccattttagttcctctcatagcatcctctcattgagagctgttatccattttgtgctcttgagaagctccgtgaaattatattgcagtaccaaagtataggtgtgattaactgtgaactggaatcagtgtggccattattttatcagctaaatggatgaagtggttcattcttggcacgtagtagatactcaacaagtatttttacattgactgaaaatgttatgtgttttgattcatggttatataataagcaggacttgatcactactgggtagtttacacagtatggtctgagccatgttgctctactaccatcacttattttccaacttctcaaaatatgtacatgacaaggttgtggtttttttttttttttttttttttgcctgttttgttacatagtcctgtgttaggatattacctaggcaggtttcagctctgagttggctttgcagctctttgctggggcatagtctatcctaatgttagaattaatgtttggtagacacagggtctcactctgttgcccagactgtaggccgtggtgctatctcggcttgaaaccgggaggtggtggctgcagtgaggtgagatcacaccactgtactccagcctgggcaaaagagtgagactcggtctcagaaagaaaaaaaaaaaaaaaagaattaatgtttatagaagggctcatgaatttcaaaacttgcttcctgtggtacacgggagaaactctagtacaagttgaggggtgccattaaccagaaagatggtaaagagagagggggcaacttacaagtatgtttatattgttctgagagaggttgtggctgttgcacagcttagaatgagaaggaagagactgactttacatgccttcaaaagtaagatcttaactttggcagaaatactataattttccaatatagaacacgtctgttttcaatataaatgtaaaaacacatttaaaaaaaaccagccctgtaggatttaaaacgtatctccattcttggttttctgtagtatttgtcatatatcgtttagagttaatcatcctggcttttgatcagaaacccagaaatacacagtaaccccctaattccccaaacacctgtcttgagattttaattcttgctgcaaacagcatttgtttcccaaggcttctctagaatgtgaattgttctttgagatatcccagggaggaagagtattaaaaggttactccttttcaaaagttggcattgcaatttagaatggttacaaagtttatcaatgaaaatgaacttgatgcctgagctataattgaaatctttatagcgtctctgctgtttgtccattgtgttacagagcattcattgaaaacttcttccatttctgacatgtccagttcccacccctcaaaaaaaaattatgaaaactacaaaacttcagaacatcatttgaaataattgtgtagggattaggcaccgaagagtttagaacagctacgttacattaagctataattatggttactttttcttgccacacaggagtttagaaatttgtggttttatttcttaggctattttgtttctgatgattgtcaaatttcatttgagacaatattgccctgcattttaatatttacttagcattttttctctttttgaacagttacataacttagataaactgtgtgtaaatgaaagttacagatagagttttaagtggaatatgtactttattcagatttttattatttgagatgatgatttattgaacataagcaatggagacttttctctcatctgtcattaaatgaatgtctggattagcttataggaagtgctcacagtaataaagctaaatataaagaatgagaatcaagaatatataaagaccagaaatgaatacatcaaaacctgtactatcaataaagttctagtctccgtggtcagtgtcttagacatgaggactgctttaataactgcaagatttcagtgactcagagcaagaagcatctgtttctcacctatgtggaagcttatgttggggtcgtcatgggttaggtgtccacatggctgttcaggtggtcagcctttttccaccttgtgacttagcctcctataggaactgggaacctgcttggttcaggcagtgggtggagaatgaggacagtcctgtgggaggtttttatagaccagcacacattgcttctcatcctactagccgtactcagacatggcctctcttagcttactttaggctggacacatagcagagctatacgccgcaggagaagagaggtcatggggactggtagcataactagtctctaccccagtctgactggaacttgtgtgagcatcctggtggccacagtgaaaggaaatcatcctcagctctatgctgtcattttcaccatgcataaagaagataccagtttcttttccttaatatgtcccccatttcacacttggggctttgaattggttacattgaaaggtgtagtaggtgatgtgctcagtggcattcatgtggtacattgaacagtggttcttgtttggctgtttatcatgtccttaaataaagtgaaagtacaacaatcaaaaacaattctgtggaggatcaaactgacatggtttattatatattttctagttgtgagaataagcacacttcatatccctcaaacagtcattcaggaatataagtgatctcaggtggattttttggtgaaagatgtatagaagatagtttgaagttactgttacagatgcgcttggagtgccagtattttgtcaattaaaggtggctttagagaccgagagagatggttggttagttcaaaatcagtatcctgcatggcaagcttgttctagatcaggggttggtaaactacagcctgtgggccacatctggctctttgcctgattttgcaaggaaaattgtattggaatacagacgtgtttgttcttttatttgtctggggttgctttagtgctgcaaggcagagctgatataggggtaagtggtggcaacagaggctaacttacacagtacgacatatttgctatctggctctttacagtaaaaattcctgacccttgttttggagaacatattttctgccttttctgatggggctcacattgtagtaggtgagaaagctaataaacaacattaaaaaaatatatatatatatataatctcccttcacttgctttgctttctttactatgctttctttagtatacagcctatgtgtatgtgtgtgcgtgtatttatatgtgtatatatacgtgtgtgtgtatatatatataaagaaagcgaagcacgtgaagagagagaatatcagagactgccatttttgataaggtggtcagggaagcctatgtgagatgacatttgagcagagatacaaacgaaagtgaaggagtgaaccagctaggcaaatattttgggaatgaaccttatttggggagaaacagcaagtgcccccttgagataccgagtagcagcagggagggcagtgtgaatagggggttgggtagggggatgcgtagtgacagaggtattaaagggccagattgtgtagggccgtatagactgtggtgcactttggattttattctgagtgagatgaaaaaccattgcaaagttttgagcagggacatgataccatttaagttagattgtaagaggatcactaggactgctgtgtagaggatagacaggggacaaaggtagaaggtgggtgtctgtgtgctctgtgtgctaggtaggcattgcgaagtgctgtggctgttggatgaatcagtggttcctgccttgaggaggtcttagtagaatagcagaagaaagagatcactgtaatgcactgctgctgacagagaagcaaaggtgccctgggatggggtaggaggggtacctgatccaaaccaaaggtgacaccttgacctgagaatttagagggggctgatgaagactctgattgtatatcagagctctgagattcttggaaggactacttgcatgcaggaattttccccacctgttaaccacgtgagcaagtgctcatccagagatgagtggtttggtggcttttaggtcacatgccagtgccaacaattgcagtctggagcattgtgttagagtgatgttaaggtggtatctcagctcagcaggatacaccacaggaactgaagggtgaaatatttgccatctttgccagagagcagaaccaaagtaattttggtttgggaaagttagtaccataggactgtagaaaagtctcagtaaattgtctgtggaatgtattgtagagtattgctactttccccgtatgcctggcagtatgaattagttgcacaatgtacgtctcagtaattaagcaaaccggtctgctgtctggagttattggatatgacccaattaaactttggaggatgtctgtaaaaatgattttatttttgggacaggtgatagtaaagtattttggataattagttgaaaaaattgctgccgttttaaattagtgtagaagaggacattcacctttctgttttctataatggggtgtctagatcatctagagagaattttaattatcataatattggtttaaaaagaagtagggagagaaaataaaatcacaatcatagaggaaagtttttttttgtactttctctgcaactgatagaacaaaggatatagatgatttgaacaaaacaattaataaaattgcctcagtgtgtctagctgttgtacctaatggcagaatgcacattctttgtaagtagactggacagtatctatcagcttgttgggaaaagcaagtttgagtatattttagaagattgaattcgaacagagtgttctataaattaaactaaaatcaatagcaaaaggtagctagaaaaccttttctaagtatcccatgatcaaagaagatattacggtgagaattagaaaattttacaaaatatgttgattagaatcaatatgaaaatactgtatataaaaatttgtgaggtgcagctaaagtcatactcagaggaaagattatagccttacatgcatgtgttaggaaagaagaaagcctgaaaaatactcagtgatgtgaacatcaattttaagaagttagaaaggaacagcatactaaacccagaggaagtagatagacattaaacgaggagaaattgatagaatagaaaataaatatacagtagagaacatctgcagtactagttttattgaaaagattgatgatatcaatcaatttggtgagattaataaattaaaataaaagacggaaggcacagataacaatgtcagccatgaaaaagagaacatcctaaaatatcctacaggcggtaaagatttttaacaagatattcatttatgctaatacatttttaactttagattaaatggacaagtttttccttaaatgtggttttgttattcatttaaattataccttgatcagccgggcgcggtggctcatgcctttaatcccagcactttgggaggccaaggtgggcggatcacttgaggtcaggagtttgagaccagcctggccaatgtggtgaaaccccatctctactaaaattacaaaaaaattagccgggtgtcgtggcaggcgcctgtaattccagctacgtgggaggctgaggcaggagaatcgcttgaacctgggaggtggaggttgcagtgagctgagatcctgccactgcactgcagcctgggggacaagagcaaaactgcgtctcaaaaaaacaaaaaattacaccttgatcatttgttttagggtccttgttgatttgattttctttttaacataatctaatacaaaactacaaaaaccgtagtttcagagaagtgtcactccctctcatatccctttgactgtgtcctttctccctcttgtaaataaccagcctcacttttctagtttcttttaagacagtatacatgtatgttttcttatttacctttttttcaaaaacagaaggtggcatactgtttaaattctgttgcactttgctttttttcacttaaaatatactctagaaattaattactctttatcagattccagagctcttcctcataatgttatagctgtatagtgctgttcacatagtgtgaatatgatgcagtttggttaccagtcttctgtgtttggacatttaggtagcttccaatattttgcaattacagtacaaataatgtggctatgaataaccttgtgtatgtatttttatattgcaggaggtttaatttgggaataaagtcctcaaatttggatttctgggttgaaggataaatgtatatgtaatcttgttagacgctgctgaattccccttcatagagattgtaccattttgcattactctgagcagtgtgtgagtgcccgtttctttatagcctgctagttagaggatattgtgaagctttcaaatttttgccaatctaataggtgaaaaatctttgtgtagtttaattatatttattttctttattatgactaaagttgaggatcttttatgttcaagggaaatttttatattattttgagaattgtctattgcccttttttctatagaatttttgcaccttttctgttcattttttaaaagtttttctttgccttaggaataatattcctttgatatatgttacaatatttctcctagttttgacttttctgatttttttccccatgaaaatatcttcatgtagtcagatttatcaagcttttaattgaattgggcatgggttttgagtcaaggtcagattatttatagagggattcaccaatattttattctagtacttgagtagttttcattttttacatttagatttatgatacgctacaaatttattctgatatatatggtgtgaggaatagatctgattttgtcttcttctgaatagtgattgagttgtaccaacaccatttataaagttcatctttacccagttattagtgatgccaccattgctgtatattagatttctgtatgtagctgggtctatttttgggcgttccattccattctgttgttctgtctgttcatatgctattcacacaattttaatcatgaggctttgttttaatatttggaaagggcatttctccctcttagctcctcccttgcacatttactgagctggtcttttgtgtttgcttttccacatgaacttcagcatcaatttgttgagctccattaaaaagctgtgtaatttttattggaattgctttatatttacaaatcaactctgacaacctgatgaagttgtgatgtcttagccaagaacagtcgaatgttcgtctgctttcatgtgcctttcagatgtgtataaatttatagatttctttgtataggttttgaacatttcttattgtttattcctgagtattttgttgctgttataaatgggactttctgttccattttacattctaactggttattctttgtgtatgtgaagactagtttgtttactttatatcttgctaccttgcttaattctttaattgtttgagttaattttgtcattgattcctggagtttttcaggtttactaacatgtcatcaaccactagagagttgttgttctttttttccattgtttgtgcctttaattgttttctgttgtctaattgccttggtgaataccttcagaaaaatgttaaatagtggaaaaggtagtgggcattcgtatctggttcctgaccttaatgagaatgtgtgtagaatttgccctttaggatgttggcacttgcactcaccgtgtgtatgtgcgtgcatgcacatgctcttacactaattcattcttgttctgtcttaagttatgttaagaaagtatgcgtctactcctatttattctatatatatattaggaatgaatactgaattttgttgagggcttttttggcctcctgtggaggcaattatatgactttcttgttagacttatgaatatggtgaattatattactagatttcctaatcggaatcattattgcattcctggtataaactccttttttgaggtggagttttgctctgtcgcccaggctggagtacagtggcacgatctcggctcactgcaacctcggcctcccagattcaagcgattctgccgagtagctgagactataggcacgtaccaccatgctgggctaatttttgtatttttagtagagatggggtttcaccatgttggccaggctgatcatgaactcctgacctcaagtgatccgcctgcctcagcctcccaaagtgctgggattacaggcgggagccaccgcgcctggcctggtataaactcttaatgtggtgttggagtctgttaatattttatttcagaatttggcattaatattcatatgtgatattggtttgtaatgttcctattttgtgtgatcacagtcaggttcagttattaatattacacttgatttataaaaaaggatttggcaatattttttcatgtttaaaaaaattgatgtaatattgggattatctggtttgtataggtttgatagacttgcctcttgatatcatctgggttttttgggggagggtagtttgataacttttttcagttcttctatggaatttagttggcctaagctttctatctctatgggtgtccatttgggtaaactctgttttcctatgaaattatccatttcatctaggcttttaaattcatttccatagaggtgtacagagtactttcctgtgattaatatattttatcttttttgtatttgtgcatttgctcatttttccttgataaacttagattgtgctttatttcagttttttttgaggtaaaatatacataacattaagtttatggttttaaccatttttaagtgcacagttcattttatcctttgctgtgcagaagctttttaatttgatgcaatcccatttgtttatttttgcttttgtttccttgattactactttaaatgtgttctatggactctgatgtataggttctcattatctctcagaaattcagtcatttgtttgtatatcccttttcacccaagagttgtataaatttttaggtggaaaggcttttttgttcttaatttctagttttattttccttgatttaattactagtattattatttttgtatattttactgatatgaatacagaaaagtctacatcagaagtatagttgaattttcacaaaatgaattcatccatgaaaccagtactcagaccattcccagaacttcagaaggccctcacattcccttcatctcatgcccacccctctccaaaggtaaccactaagttgacttctaatattgagttttgtctgcttttgaactttacagaaataaatcattattatgtagttttgtttttaaatctttcattcaacaagttttgttaaattcatctgttatttttgctgtataattttccattgtataactgtaccactgttcatttgtccacctctccttacagtatttgtatcattttcagtgttttgtatttctagttttgtttttgcactgtgatcagaggatattttttgtgatatttccattttatgaacatagtaatgatttctttgtgccttaacatataattttctgtgagtgttcaagaagctatattctctgttaccagagtggagtgctgtctctctctctatatatacagaacaactactttgttggttatattgttgaaatcatttatatcttttttttcctatgctctgctttgtatcaagtagtgtgttttatttatggtgtgtttctatttatttactcttggatcaggcataatttgttatttagttcatagagattaataatgtattctgcattgtgaaattaacttttagtatttaaaagtagttaggactattcagataacttttgtcttgattttttttttgtctgattatttttattcacctggtaaatttttgttcctttatttttagcctttttgaatcactgcattttaagtatgtcttttatatacagcatagtctttgctttctaagcaaatttgaaaatatctttcttttaataagcaagttaagctgattcatattaattgttataactgataggtttgttctcagttctgtcattgtgttaaattactgtctgtattttggtatatttactctgttcatttattgtttgatgtgtttttcttaatttaaaaaattcttttgatatcaggaaggtgggactaagtttttcttctaatagtaccattgaattcgtacttttgtagtaccttaaccccttcttttttttttttttgagatggagtctcgctgtgtcacccaggctggagtgcagtggtgcgatctcggctcactgcaagctgcacctcctgggttcacaccattgtcctgcctcagcctctggagtagctgggactacaggcacctgccaccacgcccggctaattttttgtatttttactagagacggggttacactgtgttagccaggatggtctcgatctcctgaccttgtgatccgcccaccttggcctcccacagcgctgggattacaggcgtgagccaccgtgcttggccaaccccttcttatttttaacctatctttttactgtcttgtatgctacttttataaggcatcttttccttctcatctgttcacgatacaatcacctatgattgtatggcttttttttctttcctttttctcttccctttcctcccattatttcagttgcattttcaaatcttttcaggacatatacagtttatgtatcatttttctgtcttgtttttattcttagttctacagttaaatacataaaatgcttactttgtgaccagtccttttgcttacgtttctttagtcatcccttgtttagatggagctcaagcccggatgttccattgaatgtaatgtatcagtgtctctcctgtgcatctaggattctattagttgtataatgttcttggcagaactgagaacatagttagcctgtggtccagatgatgaacctgggttgagaaagggattagaaccctcaggaaagatacatgtgtaagtattttgtgagttcttgcttgttcaaagtttttttattagcctcgttagttgaaggacaggtaggcttgatatacaatcctttttactgagcttcttttcttatttttagtatttatttatttgagacaggttctagaatgattttctactagtcttgctttttatgttgctttgctaagtctgatgccaggctgattcattctctgatatcattctgtgatatcttttagcatggaggcctcgaagatatctttcatatgcgtaaagtctaatagtttactaggttacatttttggggtagtttgttcttggtcagttttccccagttggctcttaaaatgtgtagattcaggtcttttattttcaggaagtttttttagagtattattttaaatattctgttttagtgttttgaatatcttcttccagagtttgatgtatatgtatcttggaggtatatgtatttctaattatataaatatttgaccctctttgcctaatttgttttattcacttcaactttgaccctttatacttctttttaaatttcactttcttatggttgtttttctacttttcctcaatgccctttgtaaaattttcatttgaatctattattctcccttggacatcttaattccttctctactatgactttttctttcttttgtttctttcctgggttcaagccactcctgtttcattactttctttttttttccttttctatttttactcttctttggggtcttgaactgtaagaggtcctggaacataaatttgagaattgttgcatcatacagtagtggtttacgtggggaatttcagaagtactgaggcctttgacctagcctcagaaattgcagtggtctgaagtggtacatgggctttgaatattttaaatgatagccaggagattgtaatgtttaggaacttcactgagatatagtttggagtgtggtacatcatgtgcttatgtaacttatgtacttactatctcaaaaaaggtctaagtcagtggttcccaagttttcagagaagagtcatctgaagatcatattcatttttcatagtttgttgttagtatgtagaattacagttaactttaaaaataactttattgtggaacaataatagactcattggaaatgcaaaaatagttcacagaggttctatgtattctttacccagcttcctccagtggtaacatcctacgtaactatagtataatatcaaaaccgcccttttggctctctgagcagcaccatggctgttggcaagaacaaacgccttacgaaaggaggcaaaaagggagccaagaagaaagtggttgatccattttctaagaaagagtggtatgatgtgaaagcaccttctgtgttcaatataaggaatattggaaagatgctagtcgccaggacccaaggaaacaaaattgcatctgatggcctcaagggtcatgtgtttgaagtgagtcttgctgatttgcagaaagatgagattgcatttagaaaattcaagctgattactgaagatgttcagggcaaaaacttcctaacttccttggcatggatcttacctgtgacaaaatgtgttccatggtcaaaaaatggcagacagtgattaaagctcatgttgatgtcaggactaccgatggttacttgctttgtctgttctgtgttggttttcctaaaaacaatgtaacaatccgatatggaaaaccttttatgctcagcaccaacaggtccgccaaatccggaagaatatgatggaaatcaagacccgggaggtgcagaaaaatgacttgaaagaagtggtcaataaattgattccagacagcattggaaaagacatagaaaagacttgccaatccatttatcctctccatgatgtcttcgttagaaaagtaaaaatgctgaagaagcccaagtttgaattgggaaaactcatggagcttcatggtgaaggcagtagttctggaaaagccactgggagcaagacaggtgctaaagttgaatgagctgatggatatgaaccaccagtccaagaatctgtttaaagttcagacttataataatggcaagtaaaaagtcctatttgtggaaaaaaaaaaatcaaaaccaggaaattgacattggtacaatctgcagaccttattcagatttcactagtttatacatgcactcagttgtgtgttctgtgcaatttaatcatgtgtataggttcatgtaatcactaccacatcaagttacagaactgttccatcagcacagaggaactcccttaggtttcctctttgtagtcactacagttgatttctttatattaatttgtatcatgtgactttgttgaatttgtcttttaattctagtagttttattgtggattccttagacttttttttatgtataggatcataaaatgtggtaatcatgaaattgactagcaagacaattttacctcttttccaatctagatactttctcctcctttccccccttcttttctttcctcctgccttattgcactggatagaacttcctttagaatattgcgtagaaattataagattagatattcctcccttgttcctgatttcagggggaaagcattcagtccttcaacattaagtgtgattttagttgttttcttgtagacgacttaccaggttgaaaaatttttcttctaagtctaggagtttttaatcactgtgataagtttaataaagttgctaccttagcattcattttaggcctaacataaattgttcgtaattcagtcatgccctgtcacctttggcctagttagaacttcccctccctgcagttgtttgcaatatggcctacttgtgcctcatctcactgacccaaaatgcaacacaccatgagctgccgatcacagtaaaacctaatggtcagcctcagaagtcatgtgaataagttcccattcacatttgttttctttaaccaattcacaagaaggaaagcataaggaataatgtcccttaaaggtgtagttccacagttcttctttctccctctccctcctgctccttccctctcctgtctcaggacctcctgtctgtctctgtttggcactctaacctctctgggacctatgagtaataaacttctttcgtttcatgtattttgccttagcttcctcattgtgtctccattgagacacacatactgtattgttcttgatatcatttaacatcttttctttaacaaatcaacagtcatgaatggatattggattttgggaaatgctttttctattgagatgatcatgtgattttgtcctttatgatagtagttattatattgatttttggagattaagctaaccttatattcttgggatacatttcctttttttttttttttttttttttgtgggtcagggtcttgctctgttgcacaggctggagagcagtggtgcaatcatagctcactgtaaccccaaactccgggctcaggtgagcctcccacctcagcctcctgagtagcttggactactggtgtgtgccactaggaccagcgaattttttaagtttttttttaaagatggggtctcactatgctgctgaggctggtcttgaacccctggcttcaagtggtcctcttgccttaaggagagagaaactagattaaaatacaaaagtaaatacccaagcctagagaaggggaaagatagtgatgactattattaacaaattaattatagtaattattattttttgcttaccattagttaattttggatagcagacacatacattcaaatattttaatagtccatgaaatatataggtgggtagtctggttctagacacatgttaagctgaagtgccaaggataggaagtaaggttgaaagtagtggcattcttttactgaaaagacatttactttttgggttgttttgcaggtataatggtatctcatctacattgtcactttgcctagtttactattttgttttttgtttgtttcagtgaattcctgaaagagaaaaaataaacaacatgattctctctgtaacagccccccggaccccctcacccagtgttcagcatgatatagacccttgtgtttaccctttttttaaaaccaggaaatggcgctcctggtgtttggtgtgagcactgattatgcttggtcatcagaaatgaatgaactggcaagggaaatgaataaatgagctcagagaaagcaaaactgaatcatgctgaagatgctttctaggatgattgtatttctgaaaccttaaatcaagcttgtccaacctatggcccatgggctgcatgtggcccagaatggctttgaatgcagcccaacacaaatttgtaaattttcttagaacattacaagatttttttgtgatttatttattatttacttatttttagctcattagctgtctttagtgttagtgttagtgtattttatgtgtggcccaagacaattcttcttccagtgtggcccagggaagccaaaagattggacacccctgccttagatattgaaaattagaggtgcctgcatttccagtaattaagacaattcttactgtgcatttttttgctttccattatctttcattaaaaaaatctccaacttttaccttttagaatattaggatagaatcttattaatatgaatacgtccaaaagttggcttttgtggttttcttttgtcagaagtgctgtaggataatataacttaaaacacatacagttttctgcttctctcaagatgttcagttgtttttcagaaacacctgaatgaatggtgctaaactttccatgggctttgtctaaaactcgacaagcattagattaatatttcttttgtaggtccaattagcattcaaatattattcctgaagtattggatttcatatgttattttttgttgcttgttgatattttggttttattttgggggctgcctaattctcaggtcaaattatttctggtagttttgaaatttcttttttctttctttttttttttttttgagacagagtttttgctcttgttgctcagactggagtgcgatggcacgatctcggctcacctcaacctccgcctcccgggttcaagcgattcttctgcctcagcctcccgagtagctgggattacaggcgtgtgccaccacacccggctaattttatatttttagtagagatggagtttctccatgttggtcaggttggtctcgagctcccgacctcaggtgatctgcccaactcggcctcccaaagtgttgggattacaggcgtgagccactgcacccagcataaatttctttttttttttttttttaaggcaaggtcacactcctgtcacccaagctggggtgcagtggtacaatcttggctcactgcaagcttgacttctgggatcagttgatccccccacctcagcctcctgagtagctgggattacaggcatgtaccaccatgcctggctaattttttgtatttttagaagagatggggttttgccatgttgcccaggctggtcttgaactcctgagctcaagtgatctgcctgtcttggcctcccaaaatgctgggattataggtgtgagccactatacctggtcaaatttcttttttttaagattattttgaaagtatcggttgtgataaaatgaggaaaccatatgtgaatggatggaatgtggtgtcttttcctaagttgaatagaatttgattaatctgactatcctcagaagattttgcaaatttcatttaaatttaagttaacagaatttctgaagtagtaatctgaggagttaacctaggccagccaattttttttttttttaacagttgaatgaatagaaatccagaaaagtttgagttgagcaaggcattttgatctatttccccacagaaatcagtgggaaaactttcacttttgttccaatcagagcaactcccttttagttgtttagtgttttgattaaagttttattttaagaaaggttctgctttaaaaaaaaaagttacaaaaccactgcttttaaggggaagggatcccaaataagtatgagtggaaagctatcagagtctcttggcttttttaaaaaattagcgcctactagagagtctttccttgacagttatttgctataaactaggctttgatatgatcagaatagaaggcatcatttggagtatcaaatacagaggaaaataaagtgattcttcagcctttgctttggcatagaatgttaccaggtatggacttaactatgtttgctgaaattattttcaggttttagagtcaggaatgaaggaacattccttgagtatttgatagatttgtggtttatagacagtaaattctataatcgatgagcttcctctttagaagttcttgaaccaaatttatggttcactgtaagccagtgtataggatttaaaaggatgagtctttgcatgagtctgatttctaactcatttgatacttctttttcacttccaataaatgttatcttgctttctgaacaaagtaggttatacataaatgcaattacatacggatggttcctgactatacctacacccttgtgtaggtttcaggctctggactggatgctctgttgcctctaagacctgatgggacaggtcaggagcaggggctttggggccagactgatttgtgttcaaatcttgactctgttgtttattagctgtgtgattcggggacatatcttaacttctgtgatccttgatttcctaatctaaaaaagaaagccgggccgggcacggtggctcacacctgtaatcctagcactttgggaggccgaggtgggcggattgcctgagctcaggagttcgagaacagcctgggcaacacagtgaaaaccctgtctctactaaaatacaaaaaattagctaggtgtggtggtgtgcacctgtagtcccagttactcgggaggctgaggcaggagaattgcttgaacccgggaggtggaggttgcagtgagccgagatcataccactacactctagcctgggtgaccgagtgagactccgtctcaaaaaaaaaaaaaaaaaaaaaaagcctacctcacagtgttgtacttaaagagtatacttaagtaagagaatgtaaataataaagtgcttagtactgtaccgagaatagaaaatttcccagtaactggcagagtaaagaaagcagcaatagagagaaaatccctaagaaaccttcagatctgtatgtgtgttctgagaccataccttggaagagagggcaaaaacaatgtaggtctctttttccagctattaacatatattctaataggatagataccttgagagaataattagtcaataagaaagataatgacaggcacctctatggatgcttaaaatgggggcagaaagaaattaatgctaaagtggtaatttgaagcctagggtcttagtggaaagatagcaatagccatggtaaagcagtttggacagttactgtggatagcatctgtcacttttgataagagtacatgtttgcataatgatttatgggttaagtgtctttagttatgtgatctcatttgatgtatacaacaccataaggtggcttattattcagatgacactggtcacatggggacaagttccaaagggagcaagcaaggacagaaaaaacaattattttccgtaatggttaagaaacggaaaggttcttatagtcacaaatggcaagtgaacagtaaagctggttcaagaaatcctgattctagtctagggctccttctcctatagtgtttattattttgtttttactcaaaatggaaatacttaaagatgcagagtagttcataattagagtaggcagaagtgggggtgaagctaagagtcgaaggctccttaagcccaagtaggagttattttctgctaggtagtgtctttcattgaaaatttcttatttcattgaaaatttttttaaattatgaatttgattatattacttgttatttctttgaaccatttttcagaagaatgaccctgagcacactctgctatggtgtttgtactttaccctctgtatttcatttctagaacatccttttcccacttcttttagcttcgaccatcttttgaagccactctagctttgttggagtttgctttgtgatcaggaggctacctaaagcctgtttcagtctcttcaaatagctacagcagcggcagatagtaacaggagtcagaagtgtggttgccactcaagtagcccaaaaaggtttgcagtgcagaagctgaaatggcttaccacagatgtgatccacttaaaaaggttctgaaaactcaattcagtgaagtgtgtttgggctcagtgcattggacctgtgacttcctgtaatgtttacttaaccccctaacttctaagtggtacctcccccacctccctggaggggaaaaagatacgcaattggttttgcaggattatggagatcaaacaagcatctaacaaagactcttccttccaggtacctctttctctcttccctctcatcatagattaatcacttagttgcaagggaccagtaaattaacagaatggtgaacattttccttttcttggtgcttttgctggatgactagtggtttctgctggaacagagatgaaccatctcaaggttatgaaaattcctgactgtggcaaatgtgaaagagtgtctttttaattcctgggaaatactaagacttcttctctaaggtgcttatttgtaaagtaaaaaggtgaccttaatttccagtgctatgcagtgaacacaatttttgtggaaactagtcctaggatttgaaatgaagactatatggtctctgttaatctgtattggtaaacgcactgcactttattgagagttctggtcgttaaccagcggaattactagtattatagaaatttattaaggatggcttattggagttgacttgtaatttcagtcatttctttgtaattacgaggtaaaagatgatttgtcttgagtttaattatttctgtaagttaaaataaggaatttgtaaagcattcctcagttttatgttcagttatctaggaaacatgcagcaaagaaaggatgtgagataattattcagaaattttagttgctcgtggttgtgtgttgaaggcatatacgtgacaagcagttttggaatttcttgcaaagtcagtattgccctatagattgaccttacagaaagtccttattgtgtgtttcaaagtcttctttgtaaattaaaatatgaaagctgttgttactctgctgatagttctgataactcatgctaactaaatagttaagggagtggaagaatacagccagcattccatcatctggaaggaaaatagtgaggtggcagatccctgcctgactcagctttcaccatgccataaataatatcattttcccaagcaatactgtggaatgcaaaaagaaagaaaaatgtaaaaaaaaaaaaagtggactgagatgaagaaagccaatttatagttgtaataaataatattttgtgtcaaaaaggaagaacaaattgacaagaacttggagaaataccagctatggataaagggaaataaaaatgatggaaatccagatggtatagaactaaagatccaaatgtaaacagcagctgtttacattaattatcttgtggatggagtccctcactgagctgatatgctgttacgttagtgctttcaggttttgggttgaatcacttaggtatgcctacacacttgctttgagaaaaatcatatggttagctgtgctttccttaataatgataagttaaataactataattttactatactcagtcatatggagagatttgaagactgaagtataattctgtgttactgctagttggtaagcagatgtccctacctcatggtctctttgactaagttagattgtaagcctctggaaggcagaagactgttcttcatctcaggtttggcataatgcctttcatatagtaggggctcaggaatctctgttgatgttataaatttgataagtgttcactgctgaacctgcatgttgatggtaagaccatataatggtcttacctagaaaaaccatataatggtcttacctagaaaaaccttttgacttgtattgctttgctctatcttctgctgaaattaaactataaaccccccaaatgcataataaaagcccttgccttgctgtgtggctgacagtttctaatgtgagtggaggtaatagctgaggatggtgctgtagaaaacttacctcataggcctaggaaagaaaggtttaaggctatcatcatggattctgttagatgacttgatttttactgtattaaaagcttcctttccagtgatttgggattgcatggaatagagtgctgtacttgggtgtcacagaaccctgggtttgtggatagaattatgatgccccaaaaatacctcatttgatatataatcttgattttgtttatagaattttctgtaatgaagtaatatttgatttttttcaagtagtttaatatttgccctttattgtttttcaataatattttgaaagacgttttcttcttcaagattgttaaaaatattttttgtgtttcttttcgctctttattggttttattttgcacatttttgctgttaatacatctgaaacttcttttggtataaggggtaaagtgaggactcaatttgatttttttctcctaatgagtatccagttgttataatagcatttaaccaataactcttaccctagggatttaaaatgtcacatccatcttatactgagttcctatatatactgccagtttctgcattttctagtctattccattataggtttatttattcacactattttaattattgaagctatataatgttttaatatctgataggggatgttctctacccttattcttctttttcagaattgtcttgtctgtctttgtttgcttttctataagaactttcaagtaagcttgtctagttcctaagagaattgtcagggatactcaagaaacacctgccctttgtgatcaattctaagagccccatctgtattataaatctggagactgggttttagaccttattctgacattaactggctctgtaataaaaagattaaattcatgttttactattttatagatgtttgcaggtgcttttaagagagttattttgtactgacaatttttttggtttctatattctcatcactaaatagagctattttaaaaatcctcaatttcagtctggtcaacatggcgaaaccctgtctttaccaaaaatacaaaaaattagccaggtgtggtggcacacacctgtagtcctggctacttgggaggttgaggtgggcggatcacttgagcctgggaggtggaggttgcagtgagccaggattgtgccactacactgtagcctgggcgacagattaagaccctgcctcaaaaaaaaaaaaaaaaaaaaaaggaagaagaatcctcagttttctttttaaaaagaatcctcattttttttgctttttttttttggtggtttgtttgttttttagtattgcagaggggtcctcatacttggaaaaattggaaacaactgaattagagttccctaaactctgttttttttttttgaaaattcaattctaaataaataaaaggtggtgtatcatcaatccaatcaaggattgaatttaaatctttgtggcctctgaaagggctacacagtggagggaaactacagaaatggctcttggcaagatcatttgtctgtttcttttcctctataaccagttggtgttttgaaaggaagcatattgtctagattttcagagttctctaaaaacaggatggaggagtattatttttgaagtatgtagcatgattgtatcttcagcacaattaagtgctttgaaagcttaaattatttgtgctgtcataattgactattatgattgaaataaggatgtatatcttctttgctttttgagtgttgctagattgagagctgctggacagaatgatgggttcatgggagaagacaatcaagggggtggtaattctctaaagtcaaacttgacattttgaagggcacatcagtctgtagcttgtataattctgtaacaaattggaaaataatggaacaaatgaagaggaaaaattggtcttcatctgttggtgaatgtcagtcactattaaattaaaatgagtttttaaaatgaagagaccaaaagttttttttgtctcttttggaaagttacattgagaattcattgatttatgattgctataggacttaaaaagaaaaaagactaaaaaatccaaaaccaaatcctaaagaaaagtttaccagcaactccataatcccatcaagaataatattctgaagtagagggcaaggtttggaattggttgactctagttacacaagactcagtctattaaataactgtaaataatgttcttaagcagaagtaaatgtgataaatcagataagctgatagaaattactattcttcaaatcagaaagatgagaaggaaggttaggaaaaacaagaatataagcaaaaaataaccctagagtgtaagtctgaaaaattcagagtgggagttggtttattgaatcctcaaatgctgtttgtttgtatgctaaatggaaatagaggcagcataacttaatgtgatgtgaggtttatgttttcactgtttaaaaacacaacatgaccagaccaaatcagaaccacagagtcccaattccagatttctgggagggaaacctggcccattttaggtagtgtctgtccccattcagtcagctgtggccaggaggttggggtaagagattaaaccttacttgtgtttttaccaaagtcaaatagtatccccaaatcggcttctgtttcagttatcatcacagattacattttaggaaatgtgtatatatttttcttctggattctaatttgatcttgtcgaacgttttgtagttttaaaatgcgtaacagtttacttcctccagtaaagtgtcagagagtacctgtgtccctccccatcctggccaacaccgggatttttcatatgtttaatctttgctcatctaacaagttaaaatggtatggcattgcagctctaatttgtatttcttctataatttatttatttttttaagacagtctcactctgtcacccaggctggagcgcagtggcatgattatggctcactgcagccttgacctcctgggctcaagtgattctcccacctcagcctcccaagtggctggggccacaggcacacaccaccacacccagctattttttttttggtagagatggcgtttcaccatgttgccgaggctagtctcaaactcttgggctcaaatgaccctcttgcctcagtctctcaaagtgctgggattataggcacgagctactgtgcctggccctgtatttctttatattgcttgaggttgagcattcttccatgtctgcttttcaaatactcagtagatggatagttacttcgttcctttctgtttttgttcaaccaaataggtagactgtggggcattttgtgagagtattagtttggaagaagtttcaacttgttctatcagacatgaagtttagcactaaaaatggttcctctcagaactgggtaatgtggagtggagggggcagtgcctggagagcattgaaggaagaagtggccactgaacagggtgtcatgttgggaattgctgtgattgcaagatatcagaactttactgcaaattgagcccagcagggatgggcaaccatatggcttagaaagtgacttatgtaggcaagtggtaaagtcttactgaggtttagtgatgcaagcctgatgtggcatcgtcaatagatgcatttgtttgaggagtcttgctgttttggctttagttgaatgttaagaataaaattggtaccatgttaatacttttagaatgatttttgactatatctagtatttaaagcttttctttagttatttctccaaagcacaacagagtttggcagatttatgtgtgaacttaaaataaaataaaagataatgctgttagtgtagtttggggtgtaggataccttctgcctctgagggaatgttagacctcatgctttggattgttttgaacagaggtaaacatactcaatttgactagatgtatctgtagattttaatgttagtgagcagtgctgtcctgcttcttgtgttagtttcttgaatggccaccccccattgctggacttacgccagggcagaagaaggttcacctcatgagctcagtgtacaggaaggaatggaaaacatgaacatgcttttgcttttctatgtgtaacttccccttcccctttgaaaccaattcttttggaaagctgcaactgaagacccatatctgaatagcattctaacagtatttctcattaatatgctttgtcagtcctcagtttgtaagacattgtcagaatgttcttggtttgaagcctggatgctttcatttcccatcgcgctaatttccatcctgttaattttttattcgtgaccctctgctgagaggcccccccaacacctgttaaatcacagagaaaaaagtaaaatttgtggtatttttagttatttctgtactaataagattgccacctcttaactctttgtaaaaatgtaacatggtatttactttaactccagtaatagttttgaattttgacctttttttatttgagaaaaaagaaacccgaaagaaggtggaaaatagattatttggttaaaatttctttttctctttaaatgtctttactcctacagatgtcacctttaaatgtgagtcttaaaccagaaatatgccctataaatctactcacaaaagtaatctggatgggatttaagcccaggcagatctcaatgagattgttaggtgagatcaccaagggagggcacacagagaaagggtccaaatcaatatgtcaaaagtctgctaggctaatatttctctgcgttcttctatgtaaaatgtgggaataaaatgccacatacacttttcatcctttcagcagtgagttattgcacacctactgtgttccatgcactgatctgggcactgggacacatcagtgaacaaaacctcaaaaaaatccctgccctcacaaagctgacattttaatgggagaattgggcagtaaaggagacaaattaataaattattcacatgtagcatattagaagataatagatggtaatggagagaactaaatcatttaaaaagggtaaggaggttcaggacttgcagttttaattggggtgaggcagaagtaatatttgggcagagatttgaaggaggtgtgagggactgagccacgcaggtgtaggtgggtggggcggaacattccaggagagatggtagcaagtgcaaaggtcttggtgggctgctctctagtgtgtgtgttcagggaggagacctgcagtagaatgaggaggggagagggagagagtaagagatgaggacagagtggttaggggagggaaggaagcaggtcatgtggctctcttaggtcatcgtaaaggttttagattttcatcacactgtgtgtgctgaacggccaccagagggtttgaaatggaagagagatgtgatccaacttctttgacagaaatgctctagcttctcaggaaaacagtctgttggggaacagagaataaagtggagaccagccgggaggcttgggtgaggatgcaagcagttgaggtgggggaagcagtaggattttgatgtatttagaaggtggaaacactagtaggatttactggtggatctgacagtgagggagggaaattaaggatgcccagggtttttgacttgagcagctgagatatggggttgccatgaactgagagggggagactacgagctctagattgctggggaacgtcaggagttcaattttgggcatgttatatttcatattagggttgtgtattagacatccacgtgaagacactgagttagctgttgagtatacagtttcaaagttcatggaagtggtctgggctggagatgggaatttgggagttgtcaggatatatgtggcatttaaaaccatgagatcaggaaaggagggagtcgggatagagaagagaaaaggtccgaggactgagttgtaggttcttgaggtcggggatgctttaggaacggctgggcactggtgactattacttggtcaccccttaaggtacttgcatccctgccgggctcactgtggggtgttaatcccagtgcactcagctgttatttcagaatggatgtctaactggaaagatactaggtagtcattcaaaaggacctcaaaggagcaggcgagtttttttttttttttttttgctttctaccgcagtgattctagattattttgggctttgcttgatttctggaccaataagctttgctgaactgcagttttaatgaagttcatgatatcaccaatctctacaaagtgatttatttaactaatctctaataataaaatatttcaacctgacagctgactttttaagaagcatgtgattaatagtagtttgagtgataattaattttcaggaaagattccagaatattggaaatatttttgtttttttgcgggagtgaatctgttttatttatgaattttatggtaattttaccttacagtgtgtcttagctcaggctgcgtaacaaaataccacagactgtatagcttaaacaacagagatttattttctcatagttctggaggctatgaagtccacgaacacagttccagcagggttcagttcctggtgagggccatctttctggtttacctgcgagttctttgtcctcagatggcctttcttctgagtgggtgcagagagtgtgagtttggtgtctcttcttctaaggccataggtcccataggatccagctcccaccctatgacctcatttaaccttaattaccactataaaggccctacctccaaatgcatcacattagggttgggagcttccacatgattttggtggattatatacaattcagtgtataatacaatgtcttctcaatttctctccctctaatatgaagacattcttatcagtgtcttgtcagttgtctgttccagggtaattttttcaggataaatgtcattgagctgtgtatgcgtgtgcctgtctctgtgggttaagcatacatggattattttctaaggtcatttctgtaatgatacacaacttgtggcaatatttacagtgattttcttcacaaatgtttttgcacaaatgtttaagcagtctaatatttttatttcaggaattggtttttgggtttctgtagcatttgagtactgtttctaggggatgttaacggtttttagggagtccctgccatgcaatattggttcagtgaatggatgaataaacttaggtgaatgtatgtgggtggggagtgggggcgttgtactgtaatgaaagtggaaatgtaaaaaatatcatcttagcttgtttatggaagggtcatttatcttgcaaaattttctacctttagcattactgaggaattcattttggtccaaaccgacttggcagaagcatgggcttccctcagcgtactgcttgccggtgcctcctgagttttttggtttgagggtgagaaagatgaaaggttatgaaagttctgtcttgtgaatatgctgaagatcaaatcataaagtgtccactctgtttataatttcacctttatttttctaggccatttaccaagccacctgaaatttgctttgttttaaattattgttattattatttactgttagtcttgtgctttatgtctttaaatttaacttcaggtatttttatgtaattgataatattcttttgtcactgttttgtgtgccttagcatttatttcatgtcatattttcttgcagatttatttatttgctctttttgagtcacattccagtggaatccaaggtccataaaaacaaggaattgtctgccttttactgcattttatattcagcgcttaggtactagcatatagtaggtatccaataaatattcttgcataaataaatcctatagacactactttgcatgcttttccatttagtgtcatgtcagaaaaatgttatcacataattaacaagtcttctaaaatactgcataggtcattgcataataatttatagctctaacatagtttgctttaaatcagttccttcctttggctgatttagttgcttctgtgttttattacatacataacactgaagggaacatcttcgtgtataaatctttgtccacatttgtgttcattcctttattcatatattactgtattactagaagaagaattagttacattgatttaggtaatttaaggctcttaacatataatgacaacaaaagtattccaatttatactttttaaaatataaattttcaaagggcctttttctcctggaatttcattcttaatactattttcttctcattttgtatttactccccttggccataccatcaaatgctcttctattctagtccttcagttccagcgagggctaatttatggcctctgctccaaggtctaactctgcatttgttagatatctggtggttcccccggtacctcaagatcaccatctccaaaagtgtaattatttttccatcaaaacctgctctttgctgttctgttcccttttgagataaatgaaggtaaaatcttttcagcactcaagctggaattgtgggagtgatcgtcagttcctccgtttcctcttgatcctcagctaacttgtatatgccctttgactcttgcgctcctggctgcagcagtggcctaagcttactaccgtctcctttctggacgattgtattactgccctgttgtagctcctgtatcactttccccgtgtacatcattcatactgccaaagttacctccctggaacgcctgttttctattcctttcctaagtaaattaagttccttccaactctcccggttacttgtagatcctccttatttaacaggggctctgtgtgctctgcctagtccttgcctagtctgccttctgtcatttcctggggatttttcttccttctccttcttgggtatcttgaccttttggagctccacattgtctgtcttcctcattcactcctctgtggctgctctctggcagacttctttgtctagaatactgtccctcagttgttcgtttaacattcatcttcagattcagctctgggaagtctttctttacctaccatttcccaacaacaacttccttttctgtataaccaccagcagtgtataagtaccttgataacgtagtcttcaatgtcatttgttgctaatatttatgtgtatgtttgtatcatagacagtatgagtgttatttatctttgatcccatggcacttaccataaagacttgcagaaaagatatttaacaaatgttagttgaacaaaggaatatctcaggaggaacgtactttgacttgatgtctttttggtgttctttcttcctgtttctgtctgatattgtttccattcagtctgaagaacttcagcatctttttaaatatggatctgctcagctttggcttatcagaaaatgtctattttgccttcctttttaaatattaaaccttttatttttatatagtaataatctcacagaacatggcaaaaaagaagttcacagttccatgtacccttgcccagcttccccaaaggtgacatcttttatagcttgtagtacaataccaaaaccaataaattgatactggtacgtactaacgaccttattcactgttcactgtattttaaactgcaggtgtgtgtgtgtgagtgtgtaaagttctctgcagttttagcacatgtgtagattcgtataaccgctgccaccttcaagatacagtactgtcccatcaccacaaaatctcccttgtgcaatttctttgtaccctcagccatcctattccttgtccctggcccctgttcttcatctctattagttgtatcattttcagaatgttacatacatgaaatcataccatatttaacctttgtgattacttttttcactaagcaaaatgtctttgaggtctgtccgggttgttttatgtatcaattgttcattcctttgtattgctgagcagtttacaattgtatggatataccagagttggttcaacaatccacgcaaacaacatttgcattgtttctgctattttgctattatgagtaaagctgctatggacatttgtgtacaggtttttctatgaatatattttctctgggataaatacccatgaatgtgattattggaaagtgaatctttagttttgtaagaatgtgccaaactattttccagagtagctgtactattttacattttcaccagcagtgtgtaagtgatccttttttttttttttttgcatcctcaccagactttggtattatcactgtttattttaactgttctaacctgaataatgatatctcattgtggttttaatttgcattcttctaatgcctaataatgttgaccatcttttcttctgcttatttgccgtctgtatatcctctttggtgaaatgtttattttttttttgctcatttcataattggattgtttacttttttttttaaaaaaagctagttttgagagttctctctctagtttttttcattagacaaagaatcttgtatgacagtcattttccccacacctcagcattctaaacatgtcagttcatcatattctgactttaattatttttgataaaatttagccttcttaaatgttgcccttattgcagttttctgcaagtcatatgtctcattttcctctggttgctttgagtattttctctttgtctttggtttttagcaatttggctatgatgtgcctaggtgtgatttttctttgtgtttactatctttgggtttaatgagcttcttcgatctgtgggttgatgtccttcattacatttggaaaattatcagattattatttcttaagatatcttttatccggttctctccttgtcttctgggactccagtatattcaagccatttattatttctcagctcttgggcagtttccttgtttgttttccatttttctctctctgcagctcatagaaccaccttctgctatgtccagttttctgttaagctcatcgaatgagttctttctttctgaaattgtaatttccatttctagcttttctatttacctattttgttattttactctgatgaaatcttccaactgctcatgttcacctgctcatctttctcactaagtcttttagtacatttatcatagttatgtctactggttgcaacatcaggatcatatatggatgtaccctctgttgactttttaaaaatggaccatgtttgtctcctccttgtgtcccattatttctatttattattattatttttttgagacatctcactctgtcacccaggctggagtgcagtggcgcgatctcatcccactgcaacctctgcctcctggctttaagccattcttatgcctcagcctcctgagtagttggaattaacaggtgtgtgccaccacacccggctaatgttttgtatttttagtagagatggggcttcgccatgttggccaggctgatctcgaactcctggcttcaagtgatctgcccgcctgggcctccgaaagtgctgggattacaggcgtgagccaccacgcctggccccttgattttttgttgttgttgttgttgttgttgtttttacgttttagtcttttttttttattatactttaagttttagggtacatgtgcacaacgtgcaggtttgttacatatgtatatatgtgccatgttggtgtgctgcacccattaacttgtcatttaacatgttaatgctatccctctgccttcccccagaacaggccccggtgtgtgatgttccccttcctgtgtccatgtgttctcattgttcaattcccacctatgagtgagaacgtgcggtgtttggttttttgtccttgcgatagtttgctgagaatgatagtttccagcttcatccatgtccctacaaaggacatgaactcgtcattttttatggctgcatagtattccatggtgtatatgtgccacattttcttaatccagtctatcattgttggacatttggcctggttccaagtctttgctattgtgaatagtgccgcaataaacatacgtgtgcatgtgtctttatagcagcatgatttataatcctttgggtatatacccagtaatgggattgctgggtcaaatggtatttctagttcaagatccctgaggaatcgccacactgacttccacaatagttgaactagtttacagtcccaccaacagtgtaaaagtgtttctgtttctccacatcctctccagcacctgttgtttcctgtctttctaatgatcgccattctaaccggtatgagatggtatctcattgtggttttgatttgcatttctctgatggccagtgatgatgagcgttttttcatgtgtcttttggctgcataaatgtcttcttttgagaagtgtctgttcatatcctttgcccactttttgatggggttgtttttttcttgtaaatttgtttgagttcattgtagattctggatattagccctttgtcagatgagtagattgcaaaaattttctcccattctgtagtgcctcttcactctgatggtagttccttttgctgtgcagaagctcttcggcccgatgattttttattgtttgctggacattaagaacaagaaagactgaggaatatctatcccggcaaaaggcttgctcttccttttgtcacactgttaatgagggggactgagctggatctgggctttgaagtagcattaattagagtcagtttaccattggattcacatagtttgagagtgggatcatgagtttgttttcggcagttttcactccgaaccccagtaagatcttggagatctctttatgcttcagagccaagctgccagcttcctgagtggtgggagatttctctttgttttatagcttggctgctagcctttctggacagtggtgagttatttatactctttcgatggctttcagctcctcagaaggtatctctttgccctgctctttttaattttatttattattatttattttttgagacggagtctcgctctgttgcccagactggagtgcactggcacgatcttggctcgctgcatcctctgtctccagggttcaaacgattctcctgccttagcctcatgagtagctgggattacacatgcatgccaccgcgcctggctaatttttgtatttttagtagagacagggcttcgccatgttggtctcgaactcctgacctcgggtgattcacccgtcttggtctcccaaagtgctgggattacaggcgtcagccgctgcgcctggcctgccctgctcttcttttcatttcttttttttttttttttttttgagacggagtcttgctctgtcacccaggctggagtgcagtggctgatctcgactcacagcaacctctgcctcctgagttcaagcagttctcctgcctcagcctctggtgaagctgggattacaggtgcctgccaccaagcccggctcattttctgtattttttgtagagatggtaaaagctgatttctgtccacttacttgccttcctcctggtgtcaggctgctgctctgcatctagggacttcacaggtgcctgacgtgacataggggctctctcagctctcctgccctagcaccttgtgcactacccatgtgtatttgattaaggcccacaggaaagagttggcaagtggatgcagatttgctgtgttttggggctcctggagattctaatctatcatttcagctcacatggagacattaaaagtttgttaacagttcagctggtatcttcttacccttatctattggcagattctttgtctttccaccactttgccacagatgaaaacagctgtggattactactttgcctatgaaggccttcttgatatctgatatttacttcctgtaggtttctttgtgttctatccacattttctaaatcctggggcaaattgtctctgtgtaatgttatagaatggaggttacagtcatcccatgggatttgattcattgaggcaaagtggataaaatatttccaaaaggcatcatttctaagtggactggggagttcacaccttggctttgccacttagagctttgtagtagtattcagttactctctgaaagtactgctttgttaattggaggttaaaacacccacatctgtcatcctctttgggctccgaagattaaatgatgcagaagtacaaagtaaacttcccagggcttgagtggtttgactaggattactgtaggaaagattttgagatttacctttaatggtagagtgggcagtaaggtgagtgggatggatacaggatggctttacatttcctgagctgtctttacagcaagattatatttcatttcaaataaaagaagagaaggctagtggttaaaagcatggtctctgaaaaaaggttttctaggtttgactctcaactctattatgtactgtgtgacctggggcaagccacttcacttctctgtttcttagttcctttgtttgtaaaatggggatattaatagttcctacttcataggattgctatgaggaccaagtgagaggctaagaatgtaaagcagagttctggctcagcatggcaggctcagtagcagtgaagtacattgcttctcattttttcctttctggttgctctcatgtcagggcagggcagagacaatcctggttagcttttcatcccagcagagaattcagatacaaatcctgattaagaaggtgtatttagtaagatgtttcacaatgctcatgggagctggggtgtctccgttctgctgttggttggttagtactggaggccagatgttttagctcctctttcatgactttaatcttgtgttggattcatcaccaaaagacgaacaggagcatccgctctgcattacttattacctccaagaagaaacactgtcgcagcactgtagaatgttaatgtctcttccctacacaccctctctccacctctccacttctgtctttcctcctttccttagttgtgggaatgtggtatatagtcagggtgatttctttgtggcagggtagagatgattagcaatttggttctcttaggttgaaaatgcttacatttataggttatatagtagatagagccatgctgtgttgaaatctcatggttttgtgggtttatatagtgtattttcagcacttttaggtgcaataacattcacttgctttcagatgtattttaaaaattgctgattacttttgtattaagatttgaggtcattaattttaagcagattgataaaaatggtacttaatctctgtgtatttggtatgtgaattacgtagcatttattttaggaaatttccatggaattccatttatctcagcagttttgaggggagaagataatactgtagatgtaacttactggagtgctttaattttaattctgttgactgtctctgtgtataggtttattaccactttaatttcttcagtttactttgtatgtggagttctatagtcatttaatcattattcctgtgctcaaaggttctacagagatgaggcctgcctttgggctcttctagactttgaaagaagcatcttgtcactggagtatggatgatgggggatgatggagaggataggggcagaatctggatcttggtaccctcctgccttcagggttgacagattcagctggcattttatgcagaattcaagttattaacagaaaactctacaagagcaaatgaagctttagttaaataaacatgaggatttcaaatatcagaatatcaactgtttggaatatctacattcctgtaccctttcagtgagtaaattggccataattatctttatttgtagaaaacaaagaggtgctggttcagggatatgtgatatattggccactggcctcaagcatgagttttgtcatttggagacagatcagtgctgccacctaacctcaaagaatgaggatgtggcctgtcatctgcatacacaaatgcaaagatatcatcacttcctttttgccaagagtgggctgagtaaatttgccagattgtggtgattgtgcttgtctgccgacagggagcatgttttgcttttagttgtccagggataataactgccggttattaaatgcctctgctaccttgctgtgttctttgtccataagacttcatcctccccttcacattttaaggggaggtatggttagctttatttttataaaaggggagcttgagactcaaacagtactaactcttccaaggtccagagcttttcgatggtagttccggggtggaactcagatctctgacccccatacctctgatctttcccctttaccatgcagcctctgggcttcagaaaatgtttcctacaggattatattggatgccactgattaaatgattactgctacttaattaattggagatagaatttgatgctagaaatgtttttggcaataatgagttacttaggtgactgaacttttacatttatttctaggaggtcattttttccttgtttttgttcgtttgtatcttctctcataaattgtagtattcttgtggcatgatggtgggccatttagttccctgattactttagatatagtgagttaggttttgactagaggctcaggagctttgaatgtagacatgttgtaaaaatggtactgctgtgtttgtcagttttgtttgaacacataggatcccctgtgggtacaggtttatgaatctctttgttatagtggccactattatactttatcctcagagagagaaaaagaaaaactgaagttatttgttgaattgcacatgaaatctttatgtcaggtttagtattatagaggtaattttgaaatatagtttgattttggagtatttaaaaattgtcatggtaataatgaaaaaaatacctctgcaatgcagtatttacatcttgctatttctatttgataatgtacagattttctgtatatttcgtgcacttatgtcatgattttcattattttctttgtccaaatgtaagactcaacacatttaatgaaactaagtggaaatcctgatctggttatgatctaacccgttggtatccaacagattgctgactgtgtagtattttagcccaggatatttgtcacctgatttttaagtctgagcttgaagaggaaggcgataagggcccatggggaggtaagagtaactgctgttggtacctctgttaaatttgtctttctcctgaaatagctgtggaagtgtggagctgcaggtataagctgaaggtaaaaaagacagcactattcttcttctggccagttgtagaaagctcagcagcttcttgtgtcggggcctgggtggtaccttttgtaggggttggactgtagttaatgtgaggacagattagaaaatctggattcagagagcaaggtgaggctggaagttaaaggtgttccagcacctgaacaggaaccaggtgaatattcaggaatcaaggtaggtcaaatcaaggaaataaaaacacaaataactagttgtttggttgagcaggtgctcaggaggcaataggaagtcagagaccagggatgggatataggcatgggagaaaggcagagactcaaaccagtaaaggatataaagcaactttaagcacagttaagaaaacctcttttgggctgtgtgtggtggttcacacctataatcttggcatttgggaggctgaggcaggaggatcacttgaggccagagtttgagaccagcctgggcagcacagtgagactctgtgtctctctactaaaaatatttgtaaaaaactttaaaaaagggaaacctcttttatacttatttatgatggcctgtgaacaacttcaaggattttctggttggagacaggatggtggggccaaagctaagggtaatgccctggtttggttgctgaaattaaggaaagaaagacatttgtctaccaggtgattcataggtggcatgataaacagtagtttaatgtatagagttgagaagacaaaacacaggcctctgaaggtaaatcccagtggaaagtagcatgtgttgggtttcacactggtgatactcctagtgagttctgttggagttaggagggtggggtgatctagctaggttggtgtggtcctgcagccgtagtgaagaagatagagtcagtcatagaaggagtggagtttggaataaaccttgggacttaggtgagatagatgtaggtgagtgtgtcttccacctgtatttactgtgtgattttttttggatgagtcttccattagactgtttcctaatttgcaagatagttaaactaattcctaccttgcaggtgtcaaggttgtaggggattaaatgagatgatttatgtgaaagccctttgtaaatggcactgtggattcagatgtaagttgttattaataaattgccagttgcaatggggagcctgttggataagagctttaattcattcatcatatgtaaatgaggtggtactctttgcaatcaaagctgtttaatgaaggtcatgattagggggaaagagtcaggcggctgtttttaagtaaggttggtgtatgcctgagatttcacttataaacttataaatacataattagtattgaaaattactgtttaatgtgcatccgaagtgctttgcatttttttggttgataaaaataaatgtatttgaagagtaagttactgaactataaaaaaaagaaggagtccatttagtagcaaaattacacgatgcttctcattctacattctgaaataggctatttttagcatctctttgaatcagggatgaattctagttatagggttcagtaattaaagcagagaaaaatacaaagtagtttgggcaagaaaatctttttacttgggttggatttgtttcaaggtttaaactgtcatctcaagggcctccctggaagccactgtttttgtaatctttgtggggtcaagagcaacagaaagtgccaaaagatcagccaaggacacagtgtcccacttttttagaacaggggagttttaaaacttctggaatcctggtatttcataactggtgatcttgtatctgtgttctctgcacaatcctggacagaggcgccagggtcctttggtctctccctgtctttcctgtcctcaggcccttccttctggtcagtgcttccaccctcaggacctctgcccctctgtccagctgccctgctggcccctggttttcctccagttctcaggctgcctttgagtattgctaaagaaaactgcttaatgatgcccttggtaccagtccacatttgtatttaatgatggtagattattcagaatgttgctgaatagcttctttacttggttctagtcagcagtctttgctcaagctggaagccttgttttatcatgagaaagttattattattttatctttttatgcccgttacaaagaagctcattaactgtttggtggagttgaaacaactgttgattcaaattctcatgctcatgcttgtgtggcacttaaaagtggtgatcacagaggcaactcagggtcactaaatacggggcaagttcagcttttctagttgaagtagattaggaagatgcatttttttttaaacctctgcatttggggaaaaaaaataactttcacaaatgtttttgagtgttgtctatgtgccaagtattgtgccaagtgctggaattaaaaagaaaaagatttgtcacagtgaagaatggaattagggatcaaagtattaggatccacaggtggctgcccggggccagacctgtctactgtgaacattaaaaaacgaagcttaactgttacccgaaggcagaaacatcgattagataatcgagttttcctttggaaaccaattatatttactacggatttctaaccattttcaacctctaaatttttttatttctagtagttcactttttgttgtggtaatgaataactaggcaaatgcaagagtagaactcaatttgaacttaaatcatcttggttttaggtttttgtttgctcatttgtttactatttgttttgttctgaatccacattgattgagagggtgccatgaattcctttctgtgtgaaaccctgggattggtactgagatgcagtgaacatgccccagctctggtgggttgttcaggctggtggggcggcacctggtggtgcagtaacagtacttggtgctctttattgcttgctaaatgaggtagacggctcttcccatgggttagctcatttaattctcacagtctaatttttgtagttagggaaacttaggtttaaataaactgctcagagttttctgtagcctcacaggagacagacaggtggatacacacacactttatttcaggagcaagttctccatctggagctgtttgactttctcttttttcttttctcttttttttcgtgtgtgtgtgtgtgtgtgtgtgtgtgtgtgtgtctgtggcggggacaggatctcactctgttacctaggctggaatgcaatggtgtgattgtagctcactgcaggcttgacctcccaagctgaagtgatcctcccacctcagcctcctgagtagctggaactacaggtgtgcgtcaccatgcccagctaatttttttttttttttttaagatacggattttgccctgttgcccgggctggtctcaaactcctgggctcaagcaatcctcttgcctcagcctcccaaaaggctgggattacaggtgtgagccactgccctggccctttgactacctctcgtagcacaatatttagttggtgataagagtttatcttcatgttgactttgtatactctttgcatctcaaaggacagaaatcagtctcttggtgtcactgttcctctcttgtttactgcagctggaaccagtcttctgtcatagcactttccatgctcagtagtccccccatatccgaggtttcacttaccgcagtttcagttactggcagtcacctgtggtctgaaaatattaagataattttgtgcatgcacatgagagagagaccacattcatgtgacttttattacagtatgttggtgtaattgttctattttattatgagttattgttagtcttactgtgcctaatttataagttaaatgtgcctaatttataaaataagttatcataggtatgtctgtataggagaaaatttagtatatagggtttagtactatccgcagttttaggcatctgctgagtgtcttggactgtatacctctcagatggtagggagggttcctgtgtctctccacttaacactttctagcttgtggtgtggtattttttgatataatgctttacgtttgtgtgattcatagttatatttctaatgcctaatagtgggctagtgtcaaaaggcaaattaaaaatctaattaaaaataaagatctaattggcttttatttgtgattctagcattgaatcgtacctcattctgtaaaacaggatgggtgttccagtgaactgaggagaggagcttggctttataggcaaaaaaaaggctgaagaaagcagaaataaagaatgaacagcagattggtcatttcagaattactttccttacagggttaaaacagaggaaacttttcttattatcccagctcaggtaaactgggcctcttctgattggtggccatgaatctcttatttttgttttttgtttttaatagaaaactggcttgtttcagagcagttttttgttttgttttttttttgaaacagggtcttgctctgtcgcccagactggagtgctgtggagtgatctcagctcactcactgcagtgtcagcctcccgggctcaggtgatcctcctgcttcagccttctgagtaggtggaaccacaggagtgggcccccatgcctagctaatttttaaattatttgtagagatgaggtctccatgtgttgcccaggctggtctcaaactcctaggcttaagagataatcctacctaggcctctcaaaatgctgggattacaggcatgagccaccgtacccagctgagttcagtttaagtggtagttaccacaagtgattccattctggtttggtgtggtctactggggcctagtacaggagctcagtccgaaataatgtacccctccccacccccccgtcccccttaaactgtgttgaacagtagtaaatgcttgaatgaattgaagagtggttgatgtggtccagatcgttgcctgggttatcagattctctggcgagggactgttagcccagaggtatgggccactcatggatctttacaatgccatatcaggcatgggttcctttttctttgtattttactaggcagttattcattaaatggaagagaaagaaaatattatcttacgattcttgtatttagatctgtggtaagtaatttttgagtgaataaagtactcaaaactcagagaatttctctttatttgctctctcttagtataattaatacagttttattgaaattaaaatgcacctagctgagaatgtgatacacataggtgttcagtgaatgtcagctaacgttatttttgttttagcttacagcagtatctcttctgctacttgttttgtatttatttatgtttgtttactcttccccaccagataaactttctggggggcaaagaccttactatttgacattgtttttgcctcactttctataagaggtcaattatgtgttgaattgtatggtggggccagctaaaatgtgttcatactggctctgactttaaaaggtgcggaaccgttgtagcaatggggtatcgaagctcaggtagtcaacctgagagaccaagaaagaggagaaacacaaagattgctgtcttgttatgctagacatatgctttttgctaaaaaattcatattcgacattcttacgagatatatttctctgaatctaggagtggttacatttctatagtgtcttgcaatctcataaatagaacattatacgtgaatagttaaaaacattgatgatgtgatctcatcgatagaagtgaaaagaagaacatagaatttcagcctggtttaggaggtaaggctggaaaaataagtggggaaatagagctatatctcgagctagcttctcatttctggaaaactagaatttggaggcttacaagagatgtcagggaccaaaatagtaaatccaaatacaatcagattaggataatattgatagattaacaatgagtcatttagatacaacctgttctcaggttaagtgttttcatgtagcagaattctttatttcatattgattttggatgtcgtggataagtaagattaaagggcgtattactagggaaaattttattatcattgaccttgtaaaatgccctatagtacagaattaggtatcatgagataaactctgtcatttctctcatcagactacagagaaatgtaacctgaatgtgaagtgagctgctgacaaggtgaatggtctgaaagtatttgaaattacctgcactcatattggctgtcataacgctgcatggtcccctcctcctcttcccctcttctttttagaaaaagacttttttttttttttttaactaggcagttatttttcctggcttgacttgtggtctgtgattattctctaaattgtgacttccagtggtttcatgatgtcatttttcttttcttttttccctgaatggtataaataatttttatttagtagtagtagtttaatacttaggcctagagacagcaggattatattttgttgctaccatattgaggtcattatttggaacctgagtgaacaaggataagtacatctgtgatgggattttagcggggagaggtccttaaagattacccagtctgttcctctagtcagtgatttgttcatttattcaaatatttgagtgtctatatgcttttctttgcagtatttcttttcccagatgttggtaataacaccttcagtacaactatctcaagccaaaaatcttagaagagtactgtccaacctagtagccactagccacatgttactatttaaatgaacattagttaaaatgaagtaaaatatggagttcctcactcacattagcacatttcaagctggatccatgtggctggaggctgccctctgggacactgtcactgtgtagaacatttccatcactgcgggacattcatttggacagcactacctcagagcactccttgactccaggggagtcagcatccccatccccatccacttaatcttccgagacctacgtctgtcagatttgttccctttaaagaatcctcccttgtcttagtttaggtcttcatcacctgtcttctgaattatggcttaaattcagtgaccagccttgtgaagctgtccctgccgttgcccctccagctgtagccaccttctcccttgtgctctgtgcatccgccatatacacctgtcagagcactggccccacggaatgctacatggttgtttacagacttttcttcttgtggactgagaggttcttgggagtccagggttgggctttggttttaccagggggaggggcaggcacagtgactgacacataactacatatatatgtgtttattgagcaggtagaggcatggatggatggaggccatagcaggttgcagtttgaaggcaagagacctttggatacctggaaactagacgacaggagggcatttgtgacacagggagtgtaacagatgcaaggccagaggtaggaagttacagggcaattctgcttctggacagtagccacaggagagcactgtcagcaccattcagagtgtagccatgtatggaaatagaattggagtgatggtgttgcatagaagcatgcttccctgttctggccagtattgcagctcgtagtagaggtgctgtgtttccacttagcagccttaacctgtgacttcaaaggagttactgatatgctctccattgtcaaatgaggctacgtattcacaaagtctagttaattcttcaagacttttatggttcttgacttatgttagaaatgttagcagctcagcagcaaagaaaaaggcatgtgtccgtgcccaaaaggagacaatccaatgtagatattacttacttactccttttttttttttttttttttggtagaggtggggttttgccgtgttgcccaagctggtctcaaactcctgggctcgtgatctgcctgctttagcctcccagagtgctgagattacaggtgtgagccacaccgtgcctggcaagaacagttgctttctagtcagactcatcctgactcttctttttcctagctgtgtgatcctaaaaaactcactttttgatcctaatttcttcatttttaaatggagatattacctgcctgtgaggactaagttaaatgtatatgacatgttagctctatgcttagacctgagtaaaacatttaccagtaatagctaataacaaaaataataagtccatagcctttcacacaaatgggaaaattcataattgtgtttcacaaaggaagagttaacacgtgattcttaaacataaatggtcatccagaaaatacataggatgttggacattttccttgtccttaggcgtagttagctggatataaccatctcttaagtgaaatgtatagggctggttaccctcaaaatcatcaagtcgaatcagctgatctagtagaggtaaaattaggcctggataatctaaacccagggataattttctgtatttggaaataaggtgatcacttatgcagattacttaggaaaaagctcacttttctcttttactcagcatcaagagcatgcagtacagctgctctgaaggaagagaagaaaattgtgtgctgctttagttttaaataagtaaaataggatgtataaaatggagtatcgctgaatgatcattctattttttttttttgtactgttaaaaggatggttgcggtcttaactatgtgagttcttagaatctactggcctacatagaattcatgggggtccagataattctttttagtagactcaaagttgcttttcttccataatgaaatggcacagttatctgttttctcatgcctggacctcctttcccaagcttgatgcctcccacccttgtttgaccttcctgaagctgcaccccgccccacttctgggccgctgttctctcgctttcttgcgtctaccttgtattaaaattatctgcatttatttgttaccctcacaagactgagtaccttcacaaacaggcattttcttattcatttttatgtgttcagtgtttaaagaggggctgacttctacaagatgcttggtacagtcttgctgagtgaatggatgcatgttcactaaaattttcttgtatgtattcttcccaagtagaccataattctgagtaggaaaccatgtcatgcttcttgttacctcatagctctagcacattggtatacaacattgatcagtttgctctgtagcattgctgttaatgtccagtgtcctggaaacaccttctagggcgtatttggcagttattaaatctgttactattttatccctgtagctactattagaatatttataaaatgatctccaagacttttattgaatttgaatattgttatgggaaaaatcgatacaaatgctcttattagctacagttcttatgtgaatgattactattatttgattcagtctgtaggcagtaacaaaacctaaaatatatgtgttgttgagtaaatgaattgagcagttcagttgaatacacttagacttgactttttccttttctgcccttcagctattatttactgtgagtccttgaagttaatttcagaggtttttcaggatagggggttggaattatacaggatttcacacaccttattagctccttacttaaaataattaaaaaagaactagttcagggattagagctcccttgaaattgttgaaatgtgaaatttgaatttaagactttcttgaagacttgaatgcattttgcctactggtaattaattttttttcttttctttgtagttttagttttgattgctgttaactactactgataactgagccaaagtggtgatgctacttgaggggaatttctgcaacccatagtcaacgattacatggtaagagtgtgtgccttttacccttaaagccatttaatttctgtaacatagtttagaaatttaattagaaatagaaatagcataaaatattctaatatttttgaatattaaatatttaatattaatatactttaatatataaatattaacagcaggtaatattttagagctttagatcctaattaatagtttgggacattgaaagagaaaaaaaaacttgatatattcacttccatgttaatttttttgtgtgaaaaacatgattatgtagtttatgacttattaagctgagatctcagtcttcttacctctgtttttgcccatttactttttatttcctggaatttaaccaattctttgttatctgaatctttctagtaatgaatgggtatgagaagtcaagatttaaaaacttaaacctaatcagttggccggacacggtggctcatgcctgtaatcccagcattttgggaggccgaggtgggtggatcatgaggtcaggagatcgcgaccatcctggctaacacagtgaaagcccatctctactaaaaacacacaacaattagtcgggtgtggtggcatgtgcctgtaattccagctgcttgggaggctgaggcccgagaatggtgtgaacccagaaggcggagcttgcagtgagccgagatcgtgccactgcactccagcctggcgacagagtgagactccatctcaagaaaacctcaaaaaaccaaaagcaaacctagtcagttttacaataatttactctgaactgaggtggtggtgatcgtgatagtggctaaaatgaggtttttgaattatttatggatttcagtgagctgtcttactctaattttaaggggtaattgaggagcaatgagacatagcagactagtagggcaagttatttctttgagcttcactttcctcatatgcagaatactatcatctgtcttgcctgatttatgaaactgtaaaaatcaaatgagaggatgtatatggaattttccttttctttctttcttttttcttttggaaggatagggagagaataacacgtcttttggttttaagatgatattgaaagagaacataaggtagaagaaaggctattataccagaattagaagctggaagattgatctctaatcctagcttgccttgaccttgggcatatcattacatattaatttaccataggaaaattgaacttgatttccatactttcactttacaggtaatttttcaggaatgtatctgtgttctctgaccaagtttaattaagctagaaatcagtatcacatacccaagaaattccaaaatattttgaaattaatgatcacagcctgaaaatccatggttaaagaggagcttacaaggcaaaatactttgaattgaatgaaaaggaaagcgtaacgtatcaaaatatatgcgatgcacctaaagcactactttaaggggaaatttatagtgttaaatgcttatattagaaaataaaagttaaatagcttttgggcttttcctgtatgtcatgatgggttacaggctgattgtagttctgataaatggtttctttcacttcctatccaatttatatgaaaaggggagatagttaaatttttttgtcaggcaagcatttattttttaacacggatactgtctagtatttgtgttccactttatagtttttggggggctttcaggtgtgtcatctcaccacagccttttgagataaccaggcagatattactgctttcatatttagaataaggacttgaggcttatggaggtctcagctcttgaagaactcggggcttctgcttgccacgccatctgcttgttttgctgctgtgctgcatttccaggctttttgtagaagcgctgtctgtgttcagactgttgtaggtggcacactctgattagcttggtgaggcagattctgttggatgagggaattctctaggaggagtgctttttcttaggcatttccgttggtgtttgtattatgcccatcagaggtggcctttttttaagtaccgttttggagctatgtctatctggttgctaaatgtgtctttcctgtctcatttcttttatcatgatatttagtcctgtgtgtggctaacagtcgacttatttttacttgaccttcatgttagaatgtacatattaaataaatgttcagtgatctcctactttgtcatactcagattatctgttgccacagatttgttttttttggtttttgtttttgttttgatttttttttgagacggagtctcgctctgtcaccaggctggcaggcagtggtataatctcggctcactgcaacctctgactccctggttcaagcgattctcctgcctcagcctcccgagtagctggggttacaggcatgtgccaccatgtccagctaatttttgtatttttaatagagacagggtttcaccatgttggccaggatggtctcgatctcctgaccttgtgatccccctgcctctgcctcccgaagtgctgggattacaagtgtgagccactgtgcccagcccacagattcatttttaaactgctttattgtggaataattgacatacagtaaactatgcttatttaaaatgtataatttgataagttatttgaaatatgtatacacccatgataccatcaatgtagttgaactggtgaccgttgtttcctcatggcccttggtcatttttcccttttgtttccctcctaccctcacataacggctgctctgctttctgtccctatagataagtttatatttcctagaatgttatgtaaatggaataatacagtatgtagtattttcgtctggctttcattcagcatagagattcatctcttgttgttgcatgtatcagtagttcattccatgttatcattgaatagtacctcactgtatggatgtaatgcagtttgtttgtccattcacctgctaatggacacttggattgtttctagtttttggctgttacaaataaagctgcatgaacattcatatacaagtctttatgtgggcacatgcttttatttattttgggtaaatatctaggagtagaatggctggatcgtgtgataagtgtatgtttaactttttaagaaacttgcaaaccattttccaaagattattttgtttctcttgagcagtggatgatagttccagttcatccatgttctcataagcactctgtatgaacagtctttttaagtttagccattctcatcagtgtgcagtcatatctcctgcggttttaatttgcctctccttaatgactaatgctgttgagcatttttcatgtgcttgcttgccatctgcataacttctttagtgaagtgtctgttcaaatcttgtgcccattttaagaaattgggtactttattatagattttcaagaattctttatatattctgtatcagatctttatcagatatatgatttgtagttttattcattttaatagcattttttttcctttttaccccagaatgaaatttttgggagccaatatgggattattttttggttttattttttgcactttccccaactcccataaaagtagttactctttgtcatcttccttttcttccattttctggcagggcacttagtttgtattctctttttggggggctgtacatgagtcaatagctgtgcaggacagaagacccctaattagtgaatatgtttgcatggctgggatggtcagctctttatttctggaggttggagatctgccattccaattgtcatcagtattgactcgttgtccctggggtgtagtcaaaggcctcacctgaagtactacaaggtcagaagccagaacagggccagattcagattcaatgatgaaaatgctggcgacaattcaccaacatcccttgatttttacatgttcatttctgattgaattgtattgtgcttactgtgtgattgtaattttctgtgtgattgcagttaacttttttgtgtgacctaattcatagctttttttcttacaacttttccgtgttttcttttttaaatatgcattctcacatctatgtataacatttttaaaaactatcaattaacacttgttaattgtattattcaaatcttggtctttgttggtttctgagaaaagtatgttgggtcttctacaaaaggataataaaagttcataattgtcatttttagtgttttttttttaccaattgaatatgataagtgtcttcccctccatctgtttttgttgcgttcaccttgagtttctcttgtgtcttagagcctgactcccttttgttgttagcatttgcctggtgtatatttttaatctctttatttttatcactcctagttatttcattttagatgtattcttgaatatttatcttacaaaacccaaacaactcagtgtgttgctgctttgttcagtggaggctgtttggtgagtggtaaggacatggactgagtccaggctgcctggggttgaattcaggcactgcataaactggctgtgtggtgtctgtcaagtttacttaaatattagtgcctgtttcttccctatacaatggaaatattaatagtttctatctcattttataagaattaaatgagctaatatatgtaaaattcttgacagtgcatggcacattctataagtggtttggctgtgttcccacccaaaatctcatgttgagttgtagtccccataatccctacgtgtcaagggagagaccaggtggaggtaattgaatcatgggggcagtctcccccatgatgttcttgtgatagtgaattctcatgagatctgatgattttttaagtgtttggtagttcctcctgcattcattctccctccggctgccttgtgaagaaggtgccttgcttcccctttgccctccgccatgttggtaagtttcctgaggcctccccagccacgtgaaactgtgattcaattaaacctctttcccttctaaattacccagtcttgggagtatctttttagcagtgtgaaaacagacgaatatgaagtcttagccattaatagtgagttcacccattaacacttactgtgattatttggaaggccatagtcactattagtgcctcctttttgttaaaaaaattaatactttcttgtccattgctgactttattacaattttttcctgtaatggtttgttatttatatatccagtatcttctagttgtttgtacgaaatcaaaatattgatcatgcagataacacctgaatatatacgtcttttaaaaacttgcaacacatttgcaattaaagtaccttttgagtctcagctctgttcctcctcccttagaataataaattcattattatgaatttgagacatttccttctctgacacacactctctcgctctctctctctccccaccgtctcccccacctccgcccccccgtctctttcatatatgtaggactacatagtactttttactaaatggcatactgtaattatgaactttgtatttttcattcactgctatgttttggaggacactccatatatatatttatcttgtttcttttaacagctgcctttcccctattggtagtcatttccagtttatctctatgtcaaacagtgctgctgtgaacattcttgtacatgaattctgtgcacaagtgagaatgtttctcagaataagagatggaaatgctagggtccatagtatgcatattcctagttttattagatataattctttcaaaggacaatttgatggttggctgccatttgtatttctctggtgtaaattgccaagatcttttcattgtggttctccaaccacacatctcgtggccacagtccttcctgtcatatttttggcttgtggtttcttcctttaatctcatcccgttgcctttcaactttggaggttatctatcatttgtagtcctgtagtattgttgcacatattttaaatgtacatctttttcatcatttctgtgggtttgaaacaaaggagaagcctagtctaggtgctctgtttattatattctatttctataatcttccatttcaaattatataatttttgaaaggatttcctatgaatgagctaaggttatgcacatacatgccatacacaacctgcttataagtgtctcattttaatggagaaatatgcttagcatatgctgcagccttaaatggaaagtagattacatttaatcccaaatcaaggaaatggagattgttgttcttccttgtctgaaatgtcaccttaaactgctgttttccttagtttacccacagcagcatttctgtaagtctccttggaggctgggtatatattctagtcttatgcacacagcttcctggcagacatcaaatggaatttgacttaccagatgtcgtactgaatcatggtctgcagagatgcggatggatcacatccttggctggggaagtggggtggatacaaatatctgggtcaactcagtggttaaccaaaggttagtcatgttataaaaagtcatgtatatcaaaaatacaaaacagagtaagatagggggtctgaagcttatgcatgcaatcagcaacaaggcagtgtcaggagttgaaggaccagacaaaaccatctgtttaataagataataaaatctgatataaaaggaaccttggaaatgtaaaccacctccttcctttttggtcagagctgactcttaatgacaaatgatcaggtgcttagagggttaagaatggggagggacctgctgggatagagggaaagagaatgaatagaagcatcatattagaagtcaaggattacttgaataccaaagcagacaactttcccctccttggctgcctttttatcctggtaagacacagaaatgaagtagccttggcttactggcatatttataattgggacctgtaggaagcgtttacaatggggatgtggtgggcagagcaccagtggaagtgagagaccgagattctagtgtctactccaggatgtaggagattttgggtctctttgtcttaatctttgattgtaaaataaagttatgctagatctccaaggttccatttatcttaaaattttttttattaagtagctgattttgtctggctgatcaaaacagggaagaaaaatagttcctggtcaaagcatctcggaggttcctgggttaataatgtgcatcagaataaatttttatgcacaataaaggactataaaacagatgtaggttcaaatattaaatgtattcttgaatcccacatgttctgagtatctagttaaatgaacaccatggtctaaaaggacttagaaataaaatatgggtatattttaaaaatattttttatctaataggaatttagtgatttatttaactttaaaaagtctgaattaaatgaacataacacagagcataaagattaattgaagcatagatatgtagagcgtggcaagttgtagaacagcagcttttttcagagctccctttaccctgtccatggctagaagagaagggcagggagaccaaaggcttgatcttcacaggctcccacaccacttctgtatccccacccatgatacgttgttcttcacttttactccgagatttcttcccacaacagagaaactgcaagacaggagctaatggtgaaaaccctggtggagagaaatcttgacctagacttcaaatccctaccttttcagttagaaccatattagcttctacctggaggatctttatatgccattttgtggcccttgaaagacaaactgtgtcccagaatgtcctctaaaaataggtacttgacaaggtttttcattacattattccatagacacaaagttgcctttttctgggagacttattatttagttgttgaggctgtatagcaaaagctaagtgacgttttaaaatggtggaatgctgcttctaagccttgagtgagagcttcactcttccatcctcaaacgtctgttgaatagcttcccgatgctgagcaggatgctggggggtctgtgatgccgtgtcatctcccattccccactgagaatggagtatttctagttgcgttttaatttccaggaatgagacatacctttaatgtagtgcttatcacactgtgttgtaactttatttatatgcctgtctctgccactaaaccattagcatcttgaggaatggggtttgttttattttcgtttgttcagtttttgcatttccactagctaaagcatcatgaaaacacactgaatgtttggagagtaggtgaatctgatatggtagtttctgaaagccagctgaatgtctaactgaaaaggaaagtatgccagagctggagggaacccaagagagcaaatctgttctgcaggagaagaaactgaggcccaccctgatgaagaaactgaggcccaccctgatgaagaaacttgcacagagtcgtgtagtgttagtggcagaacttggactagaaccccagttccccaattcctagtcctttgctgcttcactgtacctctctgtctcccatcctgtggaaacatacagaccacatttcaaagagcaaagtgtgaacatttgtcccagtgaaatgaggttgattgaattttatgtggtctttcttccttccctccccctaaatcacaacttttaataaagctttaaaaagaagcagtgtggctctagaaggcagtgtgcgaagtgaggagtttaggaagctgaggcccttcctttggcggtgggaatgttatgttagtgagtatcttttgggagttgtcagtaggcacttaactccaagcagagtgctgtaaagtggaggcaggcagacatagcccttgtccttcaaaatgagaaggccacactgaggggaaaggtcagaggaagggcttgggccagcattgtgtcactctactctatgggccctggctacttttgcttgggtcactttcattccgagggcaaaactcatacatacaagtaaaacatggttaaaaagcccaacatctgcagtatacacacatttagttttgtgtgtataatatagtctgtgccacatgttttagtgctatcatgcactgtgctctaattacctggcatgcagcaatcagagcaaaggttaccagcacatagaagagagaatcattaacactgtcaggttctgcaaactggttgttctgaaagctcaaaggtcagtctttaatggctgcatagtggagaaagaaatccactacaaaatctattcagttaattttgtatagtcaactacctctacctaccagtaatatcgttttaaaatatgtaataaagacttaatgcagttaacatgttactctacatcccatgaacccttactgcggtggagaatgaccacagttgtgggcttcagtttatttgccccattacagtgtattctatgcatgaaagctgttatccatgttaatagagtagtggtggtgttcttttctttccagaatagtctgctctctttggggtctgcacacataaattcttaagagtgtactcatatgttcactcattgagaatatcagtttacttagctggacgtggtggtgggtgcttgtaatcccagctactcgggaaactgaggaagaagaatcacttgaacccgggagatggaggttgcagtgagccaagatcgcaccagtgcactgcagcttgggagacaaagcgagactccgtctcaaaaaaaaaaaaatctgtttactgtttctttctttttttgtgaaaatagttatcagctcaatgtcttaacaaaagaagaagctgatatgttacccttgttcttactgtgaaggtggagtttctcttccaattaggatataagagaacattgcttctattttaagaaacaaaaaaggccagattatctagaaagcaataacttttcttaaatcccaaagagtgacaaacccatctgagagtagacaggacacttgaactgtttcacatttagcagagcacagggggaacaggtaaccatcatagaagtgcataagaagaattcagcaaaaattgtaatgcattcttaaggttgagtatgggctaatgcatcagtttaggataaccaggtaccccagatacaaggggaaggttacacttactcataagctgttttctacagccctccactgggtactcttaagaaagcttatgagcaagcctggagactagacagaacctcttttgatcgtgctgctctgcgggaggtaatctcagctgccactgggagacaggcatgatgtaacacctgcttccccacagccttctctcctatgacagagttcccaggagggcaatgaaacctctagcccataggactcagcaaagatctatttctggcagaggtttaggaaaccctctttcctgccctgtgaccagcaagatcctctgcttctgggacgaagggtaattaatagcaaaagcaggacagactcttaggctcataatctttcactgatgcaaagcaaagttctctttctgctgcatgagggacaggaactctttcatgcccaagacagggacaaatatcaggcagagtttagttgtgttggagaagagatgcacagatcctgagaaggccccactctgaggtccaggtatatggatcattcctaaaatttaggctgggccagggagagcaaggagcctagcacctggtaacgtagcaataacagtcatctctggagagcaagaatgtaaagaggaatttgtgtcacctttgtgacataaatgtcaaggaactacaggatgatcaggaacactgaaaaaagtctagcacactaggcacaagacagcagcccatggctaggggattttgatgcttggtgtatcagataacaatagcagccatctccctcaaaccctgactaggttgactcaatcaaccttagtaatggcttgctagaagaacatgtgaattcattgctggacaagaaatactgtttacttagtctctactgctttgcaaatgatatccagcattcagcacaaaattatgagacaaaaaaggcaagaaagaatgacgtgttgtaaatcaagagataaagcaatcagcaatcaatggaaacagactcagagataacttagatatgggaacttaaaaataactgtgattaatgtattgaaaaatgtattgagaaaagtctatatcaacagaaataaggaaacaagtttttaagagttaaatggaaactgttggaaatgtaaaaacaaattgggtttattagcaaactggatgtagctgagaaaataatgaaagctaaatcagcagaatataaaaaggaacagtgaaacaaaagaagaaacaaggaaagaggaaagtggagtggggaaggggagggatgacaaaaccgagcatctaagaactatggaacagtatcagtagtctaacacacatgtaattggaaacccagaaggaaaagagaagatactgtccagaaaaaaatactagaaggcacagttgctgagaattatcccaaattaatgaaagacaggaaacaactaataagacaaacagatccaagaatctcagagaaccccaagcaggatttttttttttaagaaccctccaagttctagaaacactggaatcaagttgctgaaatacccaaggtaaaggggaaagtcttgcaggcagccatagtttaaagaaaatgaaacattacaaacagaggaacaagggtaagaataacagcagacttcttgtcagagactatgaaagtcattaagacagtgaaataacatttttaaagtatcaagagaaaaagctcaaatcctgtcgatgcataattctatacccagcaaaaatatatttttaaattaaaggccaaataaagaatgtttcagacaaacaaaagctgagggaatttattgccacagatctgcactgtaagaaatgaaaggaagttcttgggcagaaggggcatcagatggcggttgggatctaaacaaagaaatgaagagaccctgaaatggtaaaagagaataaatatgttatattttttcttatttttaattacattaattgataattgtccagagcaaaaacaatagtaatgtggggtttataagaggtaaaatatatgacaacattggacaaagcatggaagaagaaaatggaaatatactgtttatattagggggtctccagagaaatagaacatataggatatatagatttatgaggagatttattatggaatttggctcacacaattatggaggctgagaagtcccacaatctgctgtctacaaactggggacccaggaaagccagtggtgtaattcattgtgcctagctgatggtataactcccagtccattgccaaagactcgaggacctgggattgggaaggtggtgcaggtgtaagctttggagtctgaaagcctgagaaccaggagctccaatgtctgagggcaggagaagatggatgtcccaacttaagaagagagagagagagagaaaattcatccttcctccactcttttgttctgttcaggttctcagtggattggatgatgcccacccaccttggtgagggtggatctttttttactcagtccactgattctagtgctgatgtctttcagaagcaccctctcacagactcacccagagataatgtttcagcagctctgggtatctcctagcccagtcagcttgacacataaaatgaaccattacattattctaaagttacagtgttctcacactatgcatgaagttgttcagtattattcgaaggtaggtgtgataagctaaaaatgtatatatctatagtaagctctagagcaactactatgaaaaacgtaaaaagaataaaaaccagttgtggagatgaaatgacatcataacaaataactgaaagaaagcagaaaaagagcttttggaccaaagaacaggtgggacaaatagaaaaccactagcaggatgtgttaaagaaaaaattatttaataagacttgttaaagcatggtaaagacttttattcaggaccattgcagaaggtagaggagccactgcaacagcatcttgcagtaggggagagagattgggttcaactctgaatacagcatgggcaagtggggacttatagccaaggatcagtgagagggtcagtggatggaaaagtactaagaggaggacgtcaggggttaggagaattctggctgacgcctaagaggattcttgctgaagatagccagggtgatgcgatgtcatctgggggatggtggacagttaggaacctgatgagatattgaggataaacaaattttgaggatggcaaggaatgttcttgctaaacacatttagcaggggtctttgctagaaactgaattttacaaagaaggtgcacagatgggcctagcagaaggttcagaagcctgactgaagtttggccaagcaaagaatctttgtcagatggaaggtttaaattcagccacatcaacaattacattgaatgtaaatgatctaaacaccctagttaaaagtcagagattgtaaaattggataaaaaagcaacacaaccgtatgctctccaaaataaattctctttaaatacatagaaacagaaaggttaaaattagaaggaaaaacttgtaaacactaatcaaaataaggaatgaccgttatatcaaagtagactttggaacaaagattattattaggggtaaatgggacattacataatgataatgggatcatttccccaagaagacttaataatcttaaatatgtggctacattcaacaacagatctttaaaatacagaaacaaaaactgatagaactcaggggagaagttgacaaatacacaattattgttgacgtcttcaacaactcctctctgaggacagtaggaagtaaaattcgctacccagtttgctgtaaacacatataaatgctgaatagagtataaccaagaaagtagaaagtagaaagcacattgatatgattttgaaattctttaatcatttggctttaattggaagagtaccaattggagaagttcagtgccagtattcaggcatttaattgtacaacatgtaaaattagaggagaaatttaggtttagattaattgcatgagaaataaaattagaggacaaatgttagtatcttattttggtaatataaaattaattaaaattatattactatcaacatcttatactatacttttttttttattttcatgtgagcctctcaacaacctgtaaggcaggcagggaaggtgtaactagtattactgcacagggactcatggagttattttgatagggtaatatataaaatcagaggtggggtgtacatttattgctgtgcatgcaacattgtctaccccatttcctgtaactaatatcctcaatatctatctggttctttgttttggtttttcacctatacctagtcaaagtttatatgtgtcactgtttattcattcagaatacatttgaggatacattggggtgggctggggggacgtgaaatgtggtaggtgttgtagtaatgaagggacaattaaaacgaaggctaagaattcttaagagaatcctcgcaaatggcagtaggaagtaaaattagctacccaagttgctataaacacatacaaatgttggatagagtataaccaagtatgtgtgtatgcacttatatatgtatatatttatatttaaaatagatatacctaatgctagatgacgagttagtgggtgcagcacaccagcatggaacatgtatacatatgtaactaacctgcacaatgtgcacatgtaccctaaaacttaaagtataataataaagaaaaaaaaaccctaaaaaaaaaataaaataaaatatatatgtattttaaaacattgccatgcttgaacgaatcagcaatcttccctaggtgttaggagctgagagagttggagggaagatgcttagagctagaggccagggtttaatgctgcccgtacatggaaatgtgtttcaggccaacctgatggaatgagctagaactgagacctcagaataaatgctgggatgttcaaagggctgtcaaatcccgtaaaagttgggtagaaaacctgcgctcgccaatcctgagaaatagcttgccatctgcctggggctccaaatagtaagaaaacaaaacaaacaaatgtgttagggagaaattagaaccacagtcttggccaggggcacagcaaaagaaaacataaaattgttctacaaggaaacttttctaaaacaaggtgcagagaacaaccccctacccccaccatgagaaagagtttgcagtaagaggttagacacactagcaagtgtcagcaggtgctgcacatgtgtgagggcacatgcacacagagaattagcacagcaagtatgaattaaggtaggtaattaagctacctggctcctcccaggaggagatgccaaggtaggattacaagttcaaggatcctgaatggatcacctgggttccttcctgcctcctttgcatgaacacagtcttacctcttcctgctggctggagtcagtttcctctgccagtacggagattcctcttttcattttctattccatggtaacatgagtccaaagtaccgtggtggcatccagaacttgcagttcagtgggatctttgccttgttcctgctaagtgtgtgccccatttcagacccccagccctgcagtgtccactggtgcagaatgggaagcacaaagttcccctgggctgttggtggtgatcattaagtagggcttttcttgcctccagccctaggcgcctaagcccacatgtcctcctccttgggatcccactgccatctagaggcctctgatgtataagtgtactgtgttgtggagtatgaccatcctttcagagtgtctggcaagcttgtgcttcagtgtgccttgaaaaggctggcccagcgttcattgggatggacccgcgttgggtggtttgatatgtgatgtgaccattggatcctgtcgatgggcccacgctcgacgtccttcactgtaaagtgggtcccctcgtcagatgcgatgatgtgtggggtccatcaggctgataattctgggtggacttatcgatgatgcaggctggcggattttgcctgctttgtgttcagtgtctctttggtgggaaactttccagtggaggttaacaagtgatacagaaatcttcaccctgtgcccactcccgaatttctacccacatggcctttatccagatctccttgttcctcatcttccagttctttttatttcagtaccttgaccatacaaccaggctgtggccactgcccacacatctgcacgcatttcagatcaagctacgcggtgtcatgaactggtgtcctgcccacagctccacctgctgggaagattttcctttccactgtctctgagggccatcctgagtactgctgcagcacacacagtccatttttgactaacaccatgtgctgagctgatccgtctgaaaaaccaagctcaggctttccttcctccttcccctggatgtatgagtctgctgcctgtgtaacctaggcacacaggggaggggcactacagctcttgggggtgacttggaggtctgggcttcctgctcatgggactcacttgtatcctgtggttctactgtggttcaatcttgaatgtcccatttctattttatggtcaactgctgctagtttgaattaataacttgactgacagaacttagctcattctggggagctttgcatgcctggacccctggttctctgtgatctctaccaggtcttggtaatatagtacatttaatactctgatgtgatggcaggtcctagggccttgcctttgattctcctgctggagcttgccacaaactccatattgtcctgttttccttattttttaaatttttcttttatttttatttatttattttttgagtctcagggcatttattttgtaaggaacatgtttgaaaaggggcattttaattatcctgtaaatgtttttacctcagcaataatgtttacatagctagtaatcatggctctcaggcatgatgagttttactgttgttaagttttgttttgtttttatacttaaagttctagggtacatgtgcacaacatgcaggtttgttacataggtatacatgtgccatgttggtttgctgcactcactaactcgtcatttacattaggtatttctcctaatgctgtccttcccccagccccccaacccccaacaggccctggtgtgtgatgttccctgccctgtgtccaagtgttctcattgttcaattcccacctatgagtgagaacatgcagtgtttggttttctgtccttgtgatagtttgctgagaaggatggtttctggcttcatccatattcctgcaaaggacatgaactcatccttttttgtggctgcacagtattccatggtttatatatgtcacattttcttaatccagtctatcattgatggacatttgggttggttccaagtctttgctattgtgaatagtgccgcagtaaacatacgtgtacatgtgtctttatagtagcatgatttacaatcctttgggtatatacccagtaatgggaccgctgggtcaaatgctatttctagttctagatccttgaggaatcaccacactgtcttccataatggttgaactaatttacactcccaccaacagtgtaaaagcattgctatttctccacatcctctccagcatatgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcctactttttgatgggttgtttttttcttgtaaatttgtttggttcattgtagattctggatattagccctttgtcagatgagtagattgcaaaaattttctcccattctgtaggttgcctcttcactctgatggtagtttcttttgccatgcagaagctctttagtttaattagatcccatttgtttattctggcttttgtttccattgcttttgatattactgcacagggactcatggagtcctgaagtccttgcccatgcctatgtcctgaatggtattgcctaggttttcttctagagtttttatggttttaggtctaacatttaaatctttaatctgtcttgagttaatttttgtataaggtataaggaagggatccagttttagctttctacatatggctagccagttttcccagcaccatttattaaatagggaatcctttctccatttcttgtttttgtcaggtttgtcaaagatcagatggttgtagatgtgtggtgttatttctgaggcctctgttcggttccattggtctatatctctgttttggtaccagtaccatgctgttttggttactgtaggcttgtagtatagtttgaagtcaggtagcgtgatgcctccagctttgttctttttgcttaggattgtcttggcaatgtgggctcttttttcgttccatatgaactttaaagtagttttttccaattctgtgaagaaagtcattggtagcttgatggggatggcattgaatctataaattaccttgggcagtatggccattttcacaatattgattcttcctatccatgagcatggaatgtttttccatttgtttgtgtcctctttcattttgttgagcagtggtttgtagttctccttgaagacgtccttcacgtcccttgtaagttggattcctaggtattttattctctttgtagcaattgtgaatgggagttcactcatgatttggctctttgtttgtctgttattggtgtataggaatgcttgtaatttttgcacgttgattttgtatcctgagactttgctgaagtagcttatcagcttaaggagattttgggctgagacgatggggttttctaaatatacaatcatgtcatctgcaaacagggacaatttgacttcctcttttcctaattaaatacctttatttgtttctcttgcctgattgccctggccagaacttcgaatactatgttgaataagcatggtgagagagggcatccttgtcttgtgccggttttcagagggaatgcttccagtttttgcccattcagtatgatattggctgtgggtttgtcataaatagctcttattattttgaggtacgtttcatcaatacctagtttattgagagtttttagcacaaaggactgttgaattttgtcaaaggcctttcctgcatctattgaggtaatcatgtggtttttgtcgttggttctgtgtatgtgatggattacgtttattgatttgcatatgttgaaccagccttgcatcccaggcatgaagctgacttgatcatggtggataagctttttgatgtgctgctggatttggtttgccagtattttattaaggattttcacattgaagttcatcagggatattgatctaaaattctctttgtttattgtgtctctgccaggctttggtatcacgatgatgctggccccataaaatgagttagggaagattccctctttttctgtcgattggaatcgtttcagaaggaatggtaccagctcctctttgtacctctggtagaattaggctgtgaatctgtctggtcctggactttttttggtgggtaggctattaattattgcctgaatttcagagcctgttattggtctagtcagagattcaacttcttcctggtttagtcttgggagggtgtatgtgtccaggaatttatccatttcttctagattttctagtttatttccatagaggtgtttatagtattctccgatggtagtttgtattcctgtgggattggtggtgataccccctttatcattttttattgtgtctatttgattcttttctcttttcttctttattagtcttgctagtggtctatcaattttgttgatcttttcagataaccagctcctggattcattgattttttgaaggatttcttgtgtctttatctccttcagttctgttttgatcttagttatttcttttttttttttttttcttgaggcagagttttgctcttgttgcccaggctggagtgcaatggcgtcatctcagctcatcacaacctgggcctcccgggttcaagcaattttcctgcctcaacctcccgagtagctgggattacaggcatgtgccaccacgtccggctaattttttgtatttttagtagagggggggtttctccatgtgggtcaggctgttctcaaactcctgacctcaggagatctgcccacctcggcctcccaaagtgctgggattaaaggcttgagccaccacagccggccgatcttagttatttcttgccttctgctagcatttgaatttgttgcttcttgcttctctagttcttttaattgtgatgttagggtgtcgattttagatctttcctgctttctcttgtgggcatttagtgctataaatttccctctacacactgctttaagtgtgtcccagagattctggtatttgtgtctttgttctcattggtttcaaagaacatctttatttctgccttcatttcgttatgtacccagtagtcattcaggagcaggttgttcagtttccacacagttgtgcggttttgaatgagtttcttaatcctgagttctaatttgattgcactgtgttctgagagacagtttcttgtgatttctgttcttttacatttgctgaggagtgctttacttccaattatgtggtcacttttagaataagtgtgatgtggtgctgagaagaatgtatattctgttgatttggggtggagagttctgtagatgtctattaggtccacttggtgcagagctgagttgaagtcctggatatccttgttaaccttctgtctcgatctgtctaatattgacagtggggtgttaaagtctcccattattattgtgtgggagtctaagtctccttgtaggtctctaaagacttgctttatgaatctgggtgcatctgtattgggtgcatatatatttagaatagttagctcttcttgttgaagtgatccctttaccattatgtaatggccttctttgtctcttttgatctttgttggtttaaagtctgttttatcagagactaggattgcaacccctgttttctttgctttccatttgcttggtagatcttcctccatccctttattttgagcctgtgtgtgtctctgcacgtgagatgggtctcctgaatacagcacactgatgggtcttgactttttatccagtttgccagtctgtgtcttttaattggggcatttagcccatttacatttaaggctaatgttgttatgtgacaatttgatcctgtcattatgatgttagctggttattttgactgttaattgatccagtttattcatagcatcgatggtctttacaatttggcatgtttttgcagtggctggtaccggttgttcctttccatgtttagcgcttctttcaggagctcttgtaaggcaggcctggtggtgacaaaatctctcagcatttgcttgtctgtgaaggattttatttctccttcacttatgaagcttagtttggctggatatgaaattctgggttgaaaattcttttctttaagaaggttgaatattggcccccattctcttctggcttgtaaggtttctgtccagagatccactgttagtctgatggggttccctttgtgggtaacccaacctttctctctggctgcctttaacattttttccttcatttcagccttggtgaatctgacaattatgtgtcttggggttgcttttctcgaggagtatctttgtggtgttctctgtatttcctgaatttgaatgttggtctgccttgctaggttggggaagttctcctggataatatcctgaaaagtgttttccaacttgattccattctccctgttactttcaggtacaccagtcaaacgtagatttggtcttttcacatagtcccgtatttcttggaggctttgtttgtttctttttactttttttctctaaacttgtcttctcactttatttcattattttgatcttcaatcactgatatcttttctttcacttgattgaatcagctattgaagcttgtgcatgcgtcatgaagttcttgtgccatggttttcagctccatcaggtcatttaagttcttctatacattgtttattctagttagccattcgtctaaccttttttcaaggtttttagcttccttgcaatgggttagaacatgctcctttagctcggagaagtttgttattactgaccttctgaagcctacttctgtcaactcgtcaaagtcattctccgtccagctttgttccattgctggcaaggagctgtgatcctttggaggagaaaacgtgctctggtttttagaattttcagcttttctgctctgctttctccccatctttgtggttttatctacctttggtctttgatgttggtgacctacagatggggttttcatgtggatgtcttttttgttgatgttgatgctattcctttctgtttgttagttttccttttaacagtcaggtccctcagctgcaggtctgttggagtttgctggcactccactccagaccgtgtttgcctaggtatcaccagcggaagctgcagaatagcaaacattgcagaacagcaagtattgctgcctgatgcgtcctctgaaagctttatcccagaggggcatccgcctgtatgaggtgtctatcagccccttctgggaggtgtctcccagttaggctacatgggggtcagggacccacttgaggaggcagtctgtccgttctcagagctcaaacgccatgctgggagaaccactgctctcttcagagctgttagacagggacttttaagtctgcagaagtttctgctgccttttgttcagctatgccctgcccacagaggtggagtctatagaggcagtaggccttgctgagctgtggtgggctccgcccagttcaagcttcccggctgctttgtttacctactcaagcctcagcaatggcggatgcccctccccctgtcaggctgcttcctcacaggttgatctcagactgctgcactagtagtgagcaaggctccgcaggtgtggtacccaccgagccaggcacgggagagaatctcctggtctgctggttgctaagactgtgggaaaagcacagtatttgggcggaagtgccctgtttttccaggtagtctgtcatggcttcccttgacgaggaaagggaaatcccctgaccccttgtgtttcctgggtgaggcaatgccccgccctgctttggctcgccctccatgggctgcacccactgtccaaccagtcccaatgagaggaaccaggtacctcagttggaaatgcagaaatcacccatcttctgcgtcgatcatgctgggagctgcactgcagaccagagctgttcctattcggccatcttggaacagaacttatttttattttttaccaccaatatctctgctgggtcatacagccttagcagccaggctgtttgcaccacagcctagacctgctgaagggtcctttcttgccttgagccccactcaaaactggcagctgccgtgtcatgcagtctgtagaccagagccatatcacaggtgtgttgcccccagaacccaacctaatcagcactgggcttcctcagcattgggggatgcaagatataacaaattgtcttttccttaggaggagatacccagcatgcctctgagcactgggtccctcagaacttcaccgcagttgccagaccctgaatcttcacagggcttatctgccaccctctggagcatgtgtgtcttaccaagggctcctgtgtgctggccaccctgtgcttagtctgtccagtcagcatgacggtgttgctctctttcctctcttaggcccagcactttcacagctaggttgttgctggaattcgtattttgttatcaacttagcatccagaaagaagagttgcatgtaatgcctgcagggggagggtacctgctgccctgtaggggagaggcctctgcagcatattccagctcagccaagtgcaagcccagagagtcccaattgagggacttgcaggtaggttgtttagactcaacaatatcataggcattcatctagaattccccatcccagttttcagaatgctgggttttctctcttagggcccagacctgcatacttcacttgccttggctgagatttaaacatttccagctcttactctcacaactggaccttggaaatgggaaacccacagcttttcattctgtctgcccatccaattcagatggtggcgaagactgctttgtacccactaggaaggccctgttgccctcacatttagctgttaactgcttgttaactgcagttcagtatcccgttatccttatgcagggcattagtacaattttagcactgactagccaactccgctgcttttctggaatttttccactgaatctgcattattgccttggacatgaaaggtatcccttcatttggacattttccaggtcaccgtcactgtaatctttagcaatcgagccatgacctgtgccagggactaccctcctatcaggatggcatcctcaactgcagagtggtctgtgagcatgtcccagatcccccatctcaccacctgctttctcagatcattctcagggcacttgggtttgtctgggtctgagcaacagacaccaaggtgggatcacagctataggatttgattaaggatatcacctatgtgaaagaaaagggggtagaaactggggaggctgagagagccatcaaaccacagtgcaaacctgacccttgcagtggggaggagagggggttgggtgttagcgagctttcctagtctgccatgaggtctaagggagattcagcagagccgatgaggggttcttgtctttaattcacctttgtcagcttttctcggttatttcatcctgatttcttgctgcagactagttttgtcattctccatttcatgtggtgggagttatccatttccatagttgaagacagcagccagaccaagctggatagcatagtcccacctccaaattcttagggaaggaccctggcccagtttcagccatgtctgggatctagttcacagttaggtgaaccaggttttatctctctaaactgagacatttcccagaaaagctggacaaactacagacctaacactaatactttatataacctctaatagtcctaaacattttattagcaatcattgttttattcttcacagacagactgactttgaagaatgatttggatgggtcatagttcttccaataaaggaatcaagaggcgtacttaagtattctgttggtgactaactggatcagttcattaaatgtttgtttttgtaattgcaaagtattttcaagggtaatcactgacccagcattttttcctttgactcttcctcgctcttcaatttattcaaaactgagttagtgttagagacgataaaagctgtctgggagaagaatacatttgttagagtacgctatggtttggatgcagtttgtctccatcaaaactgatactgaaatttgatcccccagatgttgggaggtatggcctagtgggatctcttatgaatagattagtgctttccctatgtggtaagttctcactcttgtgggaatggattacttcctgtgagggtgggtggttaaaaagagtctggcttccttggtttctgttgtttcttctctcaccatgtgatctctttgcatacacccactgtcctcctattttccaccatgagtggaagcagcctgaggcccttaccaggtgcaggtgcccagaatcataagccaaataaacctcttctctttataaactacccagtctcaggtactctgtatagcaccactaaactaagacaagtaattgacactgaatttgaaaaccataaaaatcattactacattattagaactttaaagaagagctgcaaagccgtcttttctgaagttgtagacaggtagcatggcctctctctcttgtcttttgtatttatacaggcataggagttccaaatagaggtttaatgaacatgagaaatgaaggctggggattaattagtcaaagctgaaatactgcaacaacaatatatgaagtaccccaagggaaggccaaagagaaatatatatgtaaatgtctatggctgtacaatcagcaaacattttttgaataatcaggttgtgtcgagggctgttcagggcattgtggggaacacagaattcatggactcagtcccaaattcaggcagctcatagttcatctgggaagaagacaactgtgagtcctgcctctgccaggcacagagacccctacagtttgcttgggatggttaatggggaaatgaatgaagtgccgacatgttttcccttccaaatccctctcagagctccctgttgctctaaaatagagtgtatttatagaaaatgtgaggtatagtgaggtcaacagattaggagacaattgccatagaaaagatagcttgttacagttcccaagaggagggggtcacagcacaccacgcagggccacataggaagcacagggtccttgaggaggcagagcgggacggggagctgtgggccggagtcttttttgtggtttctgtgggaaggagtggacaaaggggaagcagagtcaggattggcgggtttgaataatttcagtgggctctcagcttgggggctgtttctacttgtctagtagtttggccatggggtgatgtgcaggtgggtagtggctaggagtgtgagagccacatcgaggaggtgataggtgtgataggtgtgtgggctctggattggttggtttgcattttgaagagggccctcttgggtgagctgttttccatctattggaattagtaaccttgggaggatggcaccaagctgtccacccccatgatccaaaagtttcccactgggccccactttcaatacctgagatcacatttcaacatgagatttggagagaacaaacatccaaactatatccctaatcttgtcaaaatgaaaatatattccagtcattggattttctagtattgtatgaagatgaggctggttgtatgattaggaggtttgaaactctataaactccttaagtaggaagttaagattttatttatcatctctttttttttctttttttttttttaagacagtctcactctgtcacccaggctggagtgcagtgccacgattttggctcactgcaatctctgcctcctgggttcaagggattctcctgcctcctcctcctgagtagctgggattacaggcatgtgccaccacgcctggctaaatttttttttgtatttttcgtcgagatggggtttcaccatgttagtcaggctggtttcgaactcctgacctcaagtgatccacccaccttggccttccaaagtgctgggattataggcttgagccactgagcccagcatatcatctcctttttgaggagaggggtgaaagggatgcctaggatgttggagaaggcttttctgaagtgtttggtgatccttgactcttatttaagtctgaggcactaaaagctggtgcactctgggtgcttggggagattttgacaggtgttactgcctgggtggcagtttcagcaggggaaagcctccctccccagtgttcatatttgtagatcttttctcttcaaacattccccaggaaggaatgctccagtgtttttggatgggagtaaaagccaggctgcctgtgttctaggagccaagtggaacaagaggttggggagctgtctcaccagtcattgtagactttgatttagtattcctgtttccagtacatttcctcccctacctttagctatgcctagagtcccaagttcaaattctttaatttacctttcttttccagagagtaaaacatcctgggttgggtggaggaagacagcccaggaagggagaaggcattcttaaaaggagttttaaaagccaccccacctgttttatctcccctcaattcccgtttcgcacttacctggtgcctcctactcctgagccttttgtagggagggagaaggttctgtggctcaggtgggcttacttgcttgggttggtaaatggggacattcacctgctgcccccagttagcagcctaggtgtaccaaaatgccagaggtttgtctaggtccagttgcgtgccacacagaaagccaatcactgagacaatgagtgttgctagggaagaaagctttgattgggtgctatagctcaggagatggagataagcctcaaatccatcctcctgacctactaaaattaggggtttatgtagcaggaagaaaggtaactatatgtgagaaaacaggaattagggagagataaggaagaggagttggtcaacagggaacaggtggtcttaagcagtcatgatgggtgaggagtctgacttctcatggtccagatgagatgatctagtaagttttagttttttaatactacctggaaggccggatggatggttgcctgagaaagcaattcagataagacaaatgtaacttgctcaggcttcaagactcggagggtcaatttctacgtttattcaaagaaaccataaacaccagttctgtgggacaactggggtgatgtcataatggtggcctttcctgtctcttaatctggttaagtggtcttcaggtttgtggcttgtgtctcctctcttgctcttgatacatgtggactttttgcctttcctctctctcctcatttcagtgaagagagaagtcagaaatatggaatatattatttttctatgaagtgagattatactatacatgtaccttcaggctctataaaactcactaaagtaattcactgtttgttgcattttagctgattctgtcacatagaaattttaggataatgaaaattcctggaaaatagtcaattttcaagggaattaaaattccagatttgttaaaatgtgaatatgagcttataaagaatgtgttttcaattttcagattgtgaaccatgcctttagtgaagaggaacattgagccccggcacttgtgccggggagctctgcctgaagggattaccagcgaacttgaatgtgtaaccaatagtactcttgccgctatcatacgccagctgagcagtctgagtaagccatcttttttctgattaccaatgacattaactttttgttagcaaattgattttaatagttaaatgattgtccaaagaagagattgcagctttaaggaaaagatcctttctccttctgtatttcccagtatgaaattgaccactgcacctgtactgggcttgtgatgcttaactttaggcaatgaagatgtgatgctcttaccaactcacaaattattagatgagatcaaatgtacagatttaaaatagtgttaatttttaaaagcttttgaaaatgaagataattggtaattttttaaactatcaattattatgaattattttgttaaacttgaataggaccaattgttttgttttttaagtgtaatagattgaaaactagttaacacctgtaatatgcctggcacatagtacctacttaataaatatctgttgattgaataacatcccaaatgaaccatagtataaagccaaacaatagatttgctgattttaacctactaaaagttaaaatgcagatactgatttccgcattgaggtgaacagatcagctggttattttatgtatatggtaccacgtatatattggcatgcatagatgtatggcaaatgcaagctaggaagaaaaggctgcttcttattctcattttgaatattaatattaaatatctgaagaatattttataagactcaaatatgcatgaaaatgctttttccttcaaagctttttgaagttgcactattttcccccaaacttttacatttattttctgatcttgttttctcacttcatcctgctccttttcagtttaggtggtttatgtggcatttttggtgacaggttttcacagttaaatttttcagaaactctgttaataactagaaaatcttccatgaaatgtcccatattggtagcctcaagcgaagggcaaatttttttttaactcaactacttttatttatcttgaagaaacgctgcaggtaagtatcggtttctttaatagagttgtactgtattgttacggatatatttttaataatatctataatcattagctaaggcaaaagtatgtaaagaaattacataaaatgttttttaaaataaaattttcctggaatctaagctcttatgattgacttttggtagtggtaattgataaaaatatacaaattcacataattacatgaagactgcttgtaaattattgaagggtaaaattgtttttgcgtgtatttatttttgtaggaatgcttttagtctcttgtttttatggctgaaatgcctgttggcacaaagtgtaagtgatgaaagccgacataaactgtcagagttttaataatcaatctgtatctcatgctgtaataatcggcggagtgttgtgttagttgtgtttatggtgtttgcttggccacagtctcctgtaagtgaatctgcccacacagtatgccttgttctacatggcccttgtggtaaatagaatagtaatagcccctccggatatgtccatgtccttatccttggaacctgtggatgtgttatgttacgtgtaagagggaattaggattgctagtcagcttactttaagagaaggagattaccctggtttatctggtttggttcagtgtaatccacaagggttctttaaatgggaaaggagggaggtagaagaatcagtgccagggtgacgtgatgtgggaaggacccaactgccattgctggctttgaagatggaagaagaggggccatgagccaaggaatgcaggcagactggagaagctggagaaggcaaggaaattggttctctcctgaagtccccagaaagaacacagatctgcccgtacattagttttagcccagtgaaattcgtttctgacttctgacatccagaactgtaggatagtaattggtgttattttaagctgttatgtttgtggtaatttgatacaacagcaataggaaaccactctagctttggttgtgttttgtaccacccaatccactgtagcctcatgattgggccggggctgggaacctgcctagtggatagtcagttctgagttacgctactgcagtgcatctcaacctggcttctctatcagagtcacttggtgagctttaaaacaggatgctaggaatcacccgagagattgtgcttccggtaagcaccagagatgacccacaaaattagacacccatgtgtctggatggaaaagatgagctgggtgagtcagatcctttcaggaagttcgaactaagaaatgcagtgaatttgctagtctcttatgagacctactgctaaaatgtcatctgggggtgaaaaagccgtaatgaccaccggttaggcagagttgtggagggggctgaacccgggaggaagcagaaggaagccagttgatgaggaaaggcaaaagaaggatgtacaaagagaagcaagaacatgagcgagaccgcaaggcccacaaggtggaggcagcagctgcttcttgacctgcccaggatggctttcccctcccatttgtggtgcagggcttgggtgtcctcacagtgacccttcctcacttcaggttcgttgagtgcatctggggcttacaacccaaagagcattacagaaagagaagcacagtgatatatactgccaaggatataattttggaaaacgaagataattgagtgcaatgaactgaatgtttgtgtctcccaacaattccgcgttgaaatcctaatcctcattgtaatggtctttagagctaggattttggggaagtaagaggtcatgaggtggagtcctcatcaataagattagtgcccttattaaaaaggcctgagagagacaccttgccccttctgcctagtgatgccaaagcaatgaggcactgtcttgaagaagagagagcaaccctcactagacaccaaatctgctggcaccttgactttggaattcccagcctccagaactgtgagaaataaatttctattgtttataagccacctactctgtggtcttctgtcatagtagctcaaattgcctgtgacactgaattactgattggtgatagaatatcaaagtagattatctgtagtttattagtgtttattcattcattcttctttgtatttcatagaattatatctcgtatcaggtacatgattgtgattatcagcagcctaaagtagtagtcttccttaaaagatgccgttttatgggagtagacattctctgttttaatctactattcttttacacacgttgtctggcaaaataaataaaaatataaatataaatgtgagacaggtggaaaaggaaaaatatgtgacctgtaatcaagagaaacagaagtcagtcagtagaagcaagacccacagatgaccccaattttggaaataactgatgagtactttagaatagttatgaaaaatttattgaggggtcatccagtttctggtctggcttttaaagagtttggaagtcactcctgtctacacaataagaggaagttcaataatctgaaaaccagccttttgaaagatccatgtaagaactgaagttacaggacaaactgatgcccccaaatttggaaagtaagtacaggggacagcaaataactttgaattgggttctgcttagaagttaaccacatttataattttaaaaataattgataagtcacatcaacatgattataaagtaggaaacagatatgcagttattacaacctgctacaagacaacactagcacatagtaaatgatgtcaatgttttgcatgaatctttagttgttcgtggtttgccactggatattaatatattacaggggatgaggaaagttatatgcaaatatatatgagctaaagttgttaggaagaataagagaatgtaaaggaatgtttttatgttatttttaaattttgtaatcattcatcaggtatttaaaaattttaggaatgtatgagcctatagtattaaaagtcttcttttacagagtgttcattcctgtgacaaagtcaaaacataatctgtttttaaattcctttgggtacttacccggccattattcagtgggtccaaatgagaatggatcatcttaatcctccccacttcactgctcaccccccacacctgtgtcactcccctcccacccttacctccactccccacagcagaaaatcattttcaggtacagattgggatagatgatgtttaattatctgcttcctgtaagtgatacagagggggactagactttctctacatatgtatcttaggggaaacaccagtgcaacttagggatttgccttgagcctgccctggtcatccctgcttgagcagcaggaacttgccctgggagacctactgtgaaaacccagggcaactaattgttctagggaaggaaaaacagaccaggactccacagggagtttctttggtcttttctaaataggaagagagttacctgatcattctgattcttgtcacacttatggagacagttcagggtcatgaggatttaaatgactttgcataaagcaagaaaagaatctggtcttagatagcaaatggaattctgaaggccctacaactttacataacttttaggaaatctgtaggtttttagctctggatatgctcttactacatccaaatcagacacttcacttcaagggccagaaattttgtcaccgttaaatttttaacaggctttttagggaattgaaatctttccagtgagactatattgaatttggtaacagtcatagaaatgaaagagaggaaatttgtaacatgaatgacgatatagtttaaaaagatcaccacattcaaaggtttgtccaataattttttttaagtctgttttaattttcagatttttttctttgagtgttacttctgatacagtacagtgtgagcaatcagagtggctgggggaggatagccacttggcaaacagttttaggtgtgttacttggttttccagctagggaattttgatttttttttcttcaaataatgacagtttagtgttaattaacattaaaccgggagtgctttttcatcattttccttgattaataatctgaatgctcttgttcctgtcagctagttgatcaattaaaatcacagtatcttgtaatcagattcctactggtattatgatgtagtttcaatataatttgcttaaaaaggagatgacatttgtgccaaggatgacaaaacttctttttaatacctcatatgtatggttttgctactttttttttctttgttcttgtgataatagctgtttttcgctcctcccccataaaattcttctcaggatgtcacaaagaaaggagttagaaatttagtgagccctgccgaaaaaaaaaaatttggcgacattaatggtactattaagataatatagaaaatttagcatagaaacacacaaaagagtcaactttacaaaattccgttaatcagaaaaaattgtaatactttgaacatatttttatacagatggtatttcattgtacatatggttttatagcccatactcactgtacagtaaacatctgtattcttataagacacatttttgaatagctggagattattatattgatacaccataattatttaaccattttactaatgttggacatatagttatttgtgggggaacgctattataaattcttactcaaaataattacatacatctctggttgtttttgatttttttaaaaaagatttcttatgtcttaggagtcatcaggcttcttcataatgagcagggatagtcgtcataaatggcccaaaatcctgtgactccattaattttaaatatgcttctctctttgcaaatcattataaaatctatttaattttcatgtgtggagtaattgtacaaatgagaaaggaagtctgttttcttttcaaaggtttttaagtgattgtttttattaatactccttaagacacacattgtgtttcccagtcaaccaaatgcactctaattcagttgctttatataattggatctgaaatttggaggtgtgttaattgacataagtgcagttctactcaggataaagatttaagaattttaaaggcatgcgctgaataactttcttggatgtttttagccaaacaagattttttggggaggtgaggaagatagaacacagtttatgaaggaactagattataagtaaatttctgtacagtttgaggctagggttgtgggtaagttaagataaaatatattgaggtgtccgaccgaagttgactgggaggaacacagcaagaatttaagaatttttaatgctgcaaacttatttttgcatctctcatgaacaaagaaagccagtgcaggtaggtaaaaagtaatgtatacttaggaaactagaagatagaagttctgtcagcaggagaattgatggcaagtataagagccccaccaccccgacaaaaggcaggattataggggattcacactctcattacccattgacccggaatgtcagaaatactttcttaagggtattgtagaagtaattattagttaggttttttatttctccttcctccatatggattttaatatagcaagatttaatgcatcataattcttaggagcacaagttagagagtcagccaaatctgaattttcagttctggctatcactaaatttatctggttttatcatctctcttctttgtatttcatataattttatctcatatcaggtacatgattgtgattatcagcagcctaaagtagtagtcttccttaaaagatgccgttttatgggagtaaacattctctgttttaatctactattcttttacgtacgttgtctggcaaaataaaaatataaatatgagataggtggaaaaggaaaaatatgtgacctgtgatcaagagaaacagaagacagtcagtagaagcaagacccacagatgaccccaattttggaaatggctgataagtactttcgagtagttatgaaaaatttattgaaggggcatccagtttctgatctggcttttaaagagcttggaagtcactcctgtctacacaataagaggaagctcaataatctgaaaaccagccttttgaaagatccatcaaagaactgaagttacaggacaaactgatgcccccaaatttggaacagaaagccttgtgggaaccgtttcagggttgcagaaacttggtgagttgctggaggctcattgaggacaagtttgagagttaaaagctccagaagggcccagtcagaggggcttccacacttgtgtgtttttctgccagcaaccttaccaggttcttacattgaagattggagaaaaatctctttgttcgtccattcaggagaggggaatggactttaaaacaagcccaaaacatctgggcacggtggctcacacctgtaatcccggcactttgggaggctgaatcatgaggtcaggagttcaagaccagcctggccaaggtggtgaaaccccgtctctctaaaaaaatacaaaaattagccaggcgtggtggtgggcacctataatcccagctactcggggggagaggcagagaattgcttgaacccagcaggcggaggttgcagtgagcagagatcacaccactgcattccagcctgggcaacagagtaaaactgtctcagaaaaaaagcgcccaaaacatttgactctttttaacatgcctgccctcaaaagaaattatttcaacagagcctaacagactgagattttaccagagcttaacagacctggttggagggaaatacccaactccagtcccttctggtcgtcctgcctaacctgaggggaagcgggagtgagacccagggccccaggctcactagaagactgagaccccagtcataggactgtataacactcccttttcactgcccctcacccgacaccctaccagcacagcattaaaggcctgtgtagtgggattcctttcaccttgtttgtcatgtctggttttcatcagaaaattacaaagcatactaaaaggcaaaaaacacagtttgaaggtacagagctagcatcagaacaagattcagatatgggaggagtgttggaattgtcagaccaggaatttaaaagaactatgattaatatgctgagggatctaatggaaaagtagataacatgcagggactgataggtaatgtcagaaagatggaaattctaagaatcaagaaaaatatattgaatgtactgcaaaagatgaacaacgtgtgaggaaatagcagtttcagcagagaaatggaaatcatttttttaaatgccagaactgaaaaatacagtatcagaaagaaagaattcatctgatggacctaatagcagacaggacccagcagaagtgattggtgaacttggaaataagttaatagaaattatttaaagtgattcacaagagaaaatgaatttagaaagcaacaacaaaattttagagcattcaaaatatgggaccatatcaaatcgtctgacacatacgtaattggaatctcagaacaaaaggagaaaaagagaaggaatagagcagaagtagtaatggaagataagttttgaatattgatgatagatatcaactaacagacacaagaaactcagcaaattcctgaaagtataaagaaaaccacgtcataataaaattgctaaggaggccaaggcaggtggattacttgaggccaggagttcgagagcagcctcgccaacatgatgaaaccccaactctactaaaaatacaaaaattaggctggtacagtggtgcatgcctgtagtctcagctacttgggaggctgaggcatgagaatggcttgatcctggtggcagaagttatagtgagctgaaattgcaccactgcactccatcataggcaacagagcaagactctaaaaaaacacaaaaaacaaaaaccaaaaaccaaaaattttgctaaaggaacagagatgaagagaaaatcttaaaagaagaaagaggaaaaatatacatcatgtaaaagaagggaacaatgttaaggatgacagctgacttgtcatcagaaacattggaccagaaaacagtgggtaagtgctaaaaggaagaaacttgtcattctataattctatagtcagtgaaaatatcttttaaaaatgaaagacattttgttcagacaaaagtctcagagaattagtcctccagcaacctgtactacaaaaaattcttaacgcttcagggaaatgataccatttggaaacctggatctgcaaggagtccagacaaagtaaatatgggattaaatagaaaaggtcatcaataattaggtctgtatctgcttaaaagactagtaactgtttaaaatttatggcatttataatgtatgtgacagtaaaatatgtgacagtaaatgctgagtgtgaaagtgataaatagacttacactgttgtgttttacattgtttatgaagtactatgttatttgaaagtagagatgagttaagggtacatagtataatttctagtaaccatcaagaataacatagatatcaaatgaaatcctaaaataatgatttgattatcccagaaggcaagaaaggaagaacaaaggaagaaggaacagaagggccaaatggaaaacagtcagatgatagattgaatcctaaccacatcaataatttctttaaatagaaacattttaaacttcctcttaaaaggcagagattatcaggttaaattaaaaagtgagactaaaatacatgcattttgaggatgaagacactgatttaaggaaagttaatgaaaaaatatgccctgcaaacacaagttataagaaagctggtgtggttttgtgaatgtcagataaaatagaatataaaacagataagccaggacctttaatggtgataaaagagtcaagaacacagagctttaaatgtatatgtacctaacaagaggactgcaaactacatggaataaaaatagaactgaggggagaagtaggcaaactcaaaatcatagttggagattttaacaagtaccgctcagtaattgaaagaacaagtggacagaaaatgtgtaaggatatagggggtttgaacaatataccagccagtctgacttaattcatctttgtataccaaactcccaagttgtagaatacacattcttttaatttcccgtgaaacatacaccaaaacgggacatctggtaggccataaaatagtaagttttaaaagattaatatacagagagtgatgataatgagataattataatctttttagataatgctcaaatattggaaaatcaaacagtatttaaaaaataatccttgggtcaaagaaaaactcaaaagggaagttagaaactattgctaaccatgtggtagtgaacacaaaatgccattgtatttgtgggattttgttaaagaagtgtatagagaaaaatttgtagctttaaatgttatgttagaaaagaagaaaggtttaaaatcatgagcccatgccttaggtagggcccttggtgttgctcagcattcccgttgtaatctctgtgttaattaatttttgtgctcttagttgcctatttcatatctttccacctcgcacctccccactctgctgatgactgtgcttcttatttcactggtaaaagaaaagcaatcagagcagaagtaaaggtctccctctgacacattgcacgctgataggctctgcatccacgtgtcctgttcaccctcccttaaatggatgggctgttcatgctcctatccatgctgtctcctccaacggagcactggatcccatatcctcagggtgcttccaggatacatgtaccttctttcttctctgtattatttttccccctctttctgtgtcattctcatcaagtataaatatgcaaagaagtctcccaatttgagtaaatttcagatcatcctctccctgtcatcccatttcttgctcccacagcaagattccttgaaggatgtattcatatctccatggcctctatttcccacattgtttgttgtccccattgagatttcatcacactcaacgcttttgaaactgtgcttattggcatgaccagtgactcgcatgctgctaaaatccagtggccaggatcagccttcttacttcatctgttactggcatgcgactcacagataactgtctcctctggagaaactctcttcacctgcacagtggtccgccacctcactctggtgtttttcctacctcccaagctgtgctttgtctcctcagtgatcttccccacttggctcttctctgcctgttctcatttactaagtgacctcatcaggttccatggctcaaagtaacatctttatgctgatgatgttcaaatgtgtgtcttcagttctgacctatctcctagtttcaaacttatatacaactgtacaactgtccactcggtgtcttcacttggatttctaataggtatctctaatcccacatgtctaaaatttcacttatgatttctttctctctttgccagccatcccctatctgtcttagcaagtggaagctctcctcttacagtgcttttgattgtcttctttctctcctatcagagacatccagtccaatagtgaaatgacgtcagtcatcttcaaaatgtgtagcaagtctgtatgcctgttagctgccctgatgtcactattccgatccaagtcactatgcctcttgccttctgttggatttccagtcactccccaccgacccccgccccaacacaaagggaagggcatctatttctctgtcctcttcttctacccttttccccatcactcactagcctttagccacactggcttccttgatgttgctgacatacaccaagcacatatttgtcttcagcctggaaggttctttccctagatattcatcttccccctcttcagtcacttgataccatcctatcagagagggcttttgtgaccactgaaataccaccacccacttccttccactctgttctctataaaaaatattgctttattttccccatagcacttattttcaccagacatattgcttgtttattgtctgttttcctcaaccataatacacccttcatgagaacaggggctgtgtccacaagtatatttcttcaagcaacaaggacaaggcctgatacacagtcgatgcttgaatatttgctgaaaaaatgaatatgcttaataatcaatgtctgttatctaagttcttaaaatgcttagaatattgtaaagaagtattttaaaagttcattatagttaattatggttgacttttctttctgtttttcttaatttttcaaattttctatcatgagcatgtgttagttttataatcaggacggtagcagtagagtctttaattggactttgggccatttttcctaccgtttactttcctgtattttctgtatttcttacaataagcatgtgttgcttttataggagaaaaaataggtttaaaaaagaggaaaaaactttaagcccaatattatgacttgttattttatggaattcaataggaactgacattacagatactataataaagtttcttttttaacttttcattttgaaatgattttagactttaaaaagaccaaaaacagtacaaagaatttccataaactttcacccagatttcccagattttgttttacatttcttctttttctcagacttctcttccactttcccaccatacaaatgcatgtatgcatatatattaaaaatgatctcttttttgtctcctttaatctgaaatagttcctcagtctttctgtgacttttatgaccttgacacttttatgaccttgacacttttatgaccttgacactttagaagggaaacagcatttatgttatggaatgtccgttggtctggattttctaatgtttcctcgtgactggatttaagatattgaaagaaatatcacacggtgatgatgtgttctcccctgtgcgtttcattaggaagctcatgtgtctgcttgtgtcataactggtggtattgactttcatcagtggattgattaccccaagtttctgtaatgcaaagatttttttccctatgtgattaaaaagtgtcatatggggagacactttgagactatataaatgttctgtttcccatccttctatgaacccactagtctcagcatccattgatgatccttgacagaaacagttgctgtggtggttgcagaatggtgatttttttgtcatgccataatttcttcaacattagttagtaagcattctgctgcaaatgctttcatttatttccctatttatttacttgctcatttatatcagtatggactgatggattattttattctgtggtttataatccattgacttattttgatccttacgtttttccacatttggctggtgggagccctttcagacaggcttctgtgtccttttgacatctccccaccaatctcggaagtaaagtcctttgagtaccttactctttctagcacagcaatacattctaggttcatgtggttttctgccctcagccctggagtcatttttccaagaagcttgattccttttagtggagtacaaaaagccaaaatcttgtcaaaccaagatctaggttccagtgtgtgtgctaaaatttatgaaagccctagttatgactgctcttttgttccccagaaaggactcatacaagataccttgattgtttccagtaaatctttacttttaaatacagctgaaaatccacgtacagtttttatgctttggcaatttagaggtgtgagacaaagtcaaaacattagtgattttctttatactttgttttccaaagtaaaaaaaagtttcttttaagctattcgtgtcttaaaacaactgagtaaagtgtagtttcataaacaaatgaaaacatttacctttctctttacctaaactctctttacttaaaactctctttacctaaattctctttacctgaaactctccagaatttagaaactatttatcagtggctaaggccaaaataattgtcactcagttactaaaaataattcattattcaaaaaataacatataatttcatgtcgtgactgaccccatattactaacaatctggccagcctacaataaataacaaaattgtttttcccccaccaagaaacatgacttcctggtaataaaccttcccaatactaagaaataaaaaaaagtcttatcattctaacccaaacaaaaattcatcgtcaatacttccattaaagtttttaatttaaaagtacagttaatatacaaatatatcccaattttgttagttatgttttctccgatctgtaactcactttcatggtatttaaaattatttattttaaataaatactaccatatataatctatagttccttgtaatagtcccattaaaatagattaggtacagaaaaagactacatcaagaaaaaaacgagatcatactaattaaagaaataaatacagtccaaaacatgttttctaataaatagacaagtatacaccccaaacctgatactcattccttatgactatgacaactgtgactaaagactatggactttcctagagaagagccttcccaactacataatacaatcactgctggtcttgtatatacaacagagggttgaattacgaccagaagggggaacttgtgagacaaagtaacaaaagtaagaagccctttgcttgttcgcttggcttgccagcagaatttcaacaaaatcccttgtcaacaaaacttcacaaagtgcctgactcaaggactgagagcagccctctggaagaatgccctaaagatgatacacggggtagagcgcaggttctaaatcactgcattttccaaatacagaagataatgtctaaggattttgcttttatcatctgtaaccagatgtatcctcacattttactctattgtaacttgtattaggttggtgcaaaagtatctaatgttacttctaaacacatttgatgtacctgctagacacaggcagggccgccatcacttatatataaactgtgggccaaaatactactttaaaatagtataacaactcttgagaagcctctcccgggttacattcctcagtaagacttacaaataaagctaactttaattcttcaaaagcctgatttttctttagttaacagaggcatttatctcaacctgatgtatttggacatgagttcatgtggtactaataagtccagaagtggaacctttgtcaacaaagaatgaataaattgcatttacctcaatgtgctccataattcagaattagtttagctattaatggacttgctattgaaagagtgagtagaattcagcttttcaaatcatttgctgtttgcaaaactgaagattgtaattataacactattcttattcatcagaaaatatagctctttccatttttttctcttcagacacttgtcagctttcagcagctggcaaaatattaattatgcaagtctctaaattttatgtccctttataaattgagaacttctgagtggaaatgtagtatcagttgcatgtttttcaaatagggttaggcatcggacctagaagcaaatgttgcttgtccttttctgcttatgcagcatcgagctgagagtacatgatgttgttctcaacaatagttggtgtgctttgagagtattgctgtcacttttgcaagaggctattgtgtacactcccatagtcttggtgtatatgctgtccctattaattagttttctgtacagccgaaggggatgggatgggagcttttaaagttggactggagtatgtgtgtatatataaatttattttaaactatgaatggtcaagcagaaacacaataattggtttcattttgtgactatgtcagacattcagaaataaagaactgatagacttgaatatgaagcatttggaacgtggtgctcatctacaaaacacccagcatttcaccaaatggattctataaaacagtagttctgaaagatgttattaggcgtttccaggcccagtcactatgagaacatgatatgttagatgcttctcttgcagattgccagtgcacattagcttattaatgactttaagacaccccaaggcatagaaacatgtttaatccttctagctcctcattgcccagcctgccttgagcaggaagcatttgttggctttgtgcttgttaacaagaaacactggcatagatcatgtgtttttcattcagctgatagttgttgagcactggctgagcacaagcagtgcagaggtgaaaggcagaactccaactctcctagagcttagatgaatgaaggcaagattagagttccctgacgagtcctgtgatccaggtcagcttagggcattgtggagcacagagggggtcaaatgctcttacagagcccagtctacatcctgagttagccaggactcagttcttatgtttttgttcacttattccgaaatcttttctgagtacctactataagccaggcatgctctagacattggagactgatatagcagtacacagagctaaggggaatccttgtctttgtggatcatatgttctagtggtgggagacagatgagaaacaagatgaatacatacaagtgcataatttattacttggtgattagtgctagtcaggaaaatacagcagagcagggataagaggggtgtgtgatcacatgtgtgatgaggtgatggcatttagccagggctgctaggaaagcctcacttagaaggtgacatttgggtgtagagctagaggaagtgagggagcaaaccatgtgagtttctggagcagaagtggtctacgcagaaggaactggaaatgcaaaggcctggggagaagggggatgcttgggtatgtctgagaaacagtgaggaagccagggtagttggagtgggacatacaagcgagaggttaataggagatgaggcccaaaggtgaacggagctaggtcgtgtaggagcttataagtggtcatctggcctttagcttttattctgagtgaattggcaaggcatggaatggatttgaacactcagaggagtaacaggatctgagactggtttggacaagatgactggggctgctcggttgagagtgaactgagcaggggcgtggatggaggcaaggttgctggaagaccaatcccttggcggttagggaggtcgaggtgagtggtgattatgccttgggacagggtaggatcagggcaggtggtgcgtgcagagcagtcagaccctggatatattctgaaaatggatgtgtatgacagtttgctggagagccagtgtggagtgtgagtgattgagagatggcaaggatgaccctaaagtctgtgactggagcaacgggaagaatggagctggctcttccaagaggggaagatgggagagaagcaggcttatgagggggtattaggactccattcagggcaagttatgtttcagttattagacacccagtgatgctgtcagtaaggagtttgatacatgcatcaggatctcaggaagaggcccatctggaggtagaaatttaggaatcatcagcatagaggaagtgtttacagccattagaccggatgagatgcctaaatgaatgttgatggaaaagagaagaggttggaatatttaacacagatctttttttctgtgtcagtagcttttaaaagtggagtttttggaaatattaaaacactaggtttagaagcagaagtaattagcttttgttttttgtttggttttttttttttttttttttttttttttttagcaaaaagaacttttgttaaataaaaagaaaaagccaagacctcgagccctggactcctgtggaattttgagtctggggagggaggaagcagcagagggagcagagggcccacgaggcaggagggcacctgcaggctcttggcaggcaggcttggcctgggcatcatggtcagcactgggccatgccagagagaggccggatggatgaggcctgagaactggcccttgacttagcagggagaaatggtctgctgagttgggtcagccctttcatagagtgatagggcaaaaacaggactggcgtggggttgggcagaatggggaaaggggcgaggacagagcagcatggggtactctggggaagctttgctgcgaagggaggagagtaagagtgtagggtgaggagcaggggaagagggagggtttttcagtgcagaattctagatttttatgattttcttctccaggtttttaaaaaaaactgtgataaaatttacataacattaaatttaccttaacagtttttaagtggacagtccagtagcgtctttgtgtgttgctgtaaaggctgggtaacttagaaagaaaagaagtttatttagctgatgattgtgcaggctgtacaagaagcatagcacgagcatctgcttctggtgaggcctcagaaagtttccgctcatgaaggaaggtgaaggggagctgtgtgtgcagaggtcacatggagagagagaggaaacaaggagtgggaggtgccgccaggctctttttaacagccagctctcacaggaactactagagcaaaaactcgctcacccagggagggcattagtctattcacgagggatccacccttgtgatccaaacaaattctatcatgtcccacctccaacattggggatcacatttcaacatgagatttggaggcaaccagcatccacgctgtagcaagtaatgttaaccactgtgtacacatggctgtgcagcagatctccagaatgttgtcatcctgcagaagcaaaactctgcgctcgttacagaactccccatttccctcttcctctgacccctggcaaccaccattctcctgtctctatgaaatggactactttacatgcctcatataagtggaatcgtacagtatttgtcttttgtgactgattaattttgcttagcctaatgtcatcctcaaggttcatccatgttgtagcatgtgtcagaatttccttcctttaaaggctgaataatactccattgtatgtgtgtaccacattttgtttatccgttcatgtattgctggacactcaggttcttccacctctgctactgtgaatagtgcttctgtgaacataggtatgcaaatgtctcttcacatccttgcttgcacttctttacgggtatatactcaagtagagttgctgggtcatatgtttaattttggggggaaccaccacacagttttccacagcagttgtaccattgtacattctcaccaacagcgcacagggttccaatttctccacattcttaccaacacttttctgcgtttttgtttttgttttttaaatagtagcatcctaatgggtatgagaggtggtggtgagagggatttcagtcattcttaaaactgttaaaatgattgaaatcatggcagatttgtaagaggagaaatggtaggtaaagcacttgggctttggtctgcccctgtgagtgctcaggagtgtcagtcagctactactgtgaggaagggggtgcccatgcctgaggcagagggagcagagcagctgtgcagaagcacagagtgtgaggaagtgggagagtgtggggctgcaagtagtgcattctggctggagcaccaggcaagggcagaaatgaggtgcggccagttagaaaggctactattaaaaagtcaaaaaataacagatgttggcaatgctgcagagaaaagggaatgcttacttactgtaaacatggtgggaatgtaaattagttcagccactgtggaaaggagtttggagatttctcaaagaacttaaaacagaactaccattccgtccagcaattccattactgggcatagacccaaaggaaaatggatcattttaccaaaaagacacatgcacttgtatgttcatcacagtgctgtttgcagtaagaaagacatggaatccacctgagtacctatcagtggtggattggataaagaaaatgtggtacatcatgggatactacgcagccataatgaagaatgaagtcatgtcttttgcagcaacatggatgcagctggaggccattattgtaagagaattaacacaggaacagaaaaccaaatactgcctgttctcacttttaagtgggagctaagcactgggtacgcatagacataaaaatgggaacagtagacactggggactactggatggggagagaggaagaggggcaaaggccaacaaagtgtctcttggatactgtgttcactacctgggtatgggatcattcattccccaaactgcagtcactcagtatacccatgtaacgaacctgcacatgtaccctctgaatctaagataaaagttgaaattattttttaaaaaaccggggaaaaaagaaatgaagtgcagtgcacagggccctctgtgtcatacacatacacatacacatacacatacttattagattttatcttgaaatgacgaggagcagtaaagaatttaaatagaaatgacgtagtcagttctttctgttagatcatttggcagcagtgtgatgcatgggttcgggggtgggaggtgaatctaaaagctattgatgtaattcaggagagaaacgagggtctggggcaagatggcggtgggtgtagaagggacaagacttggtgttgagttagccgtagagagagggagctgtcacaatgacaccatttctggcttgggcttcattttggatggtgggtgcttttcaacatggggatgcaggtttgaggtaaggtgaaaaggagttatatttcagcttgtacaggatttgagaatcttaacagacgtcaacatggagatgttcagtagctagttagataacaagtctggagctcaggaaggtgttcataaagcaataaacgagcattaattctggatgctgcagctagttatagtattttaaaatgtatatagtttgtgtgaaggctttatttttttgcctttgtggaaccattttgcatattatgggaatgggaactgttgacagaattttaagtgaacccagaagaccatgctgtggatattgagctttaagagaagcaatttaatgcttagctgaaagctgaaatctgggtttttctctccttttttggtgggggatggggtacatgtttattgatttattcttattttctaagaggaattcttcttgttaaaacagttacacagaatctatgaaattatactaattttaaattcataagaattcattcccagtgtctaggtgtaaccatttaagcagtaaaatattttagtccatttcattaagtagataagaaattatcgagtgtttcatggcatgaaataattcatgaagattgcagccaagggagtccagggagctatgtgataaaagcagagaactaaaagttagaagaccatatttttgtttcatctatttctgccatgtactagccatgggatttggacggatcacctttctgatcctctgtttagtcagccagagaatgaaaacattaacttcctgtttacctcccgggctcacttattcattgaacaggtgtgtgcaggaggcatcacacagggctaaggctaaaacatggaacacacggagttcacagtctcatggattatagcaaagagtacagaaagtggctgtgaaagcagcgtataaactataaagcaccatgggaactttagggttattcttaactctaatgaagttttcttcctgggaggttcaggttctctctctcatttgagtgataaactgatagaaaatgaaaataaaaagaagtggtaggtatctctgtcagaaaagttaaggtgagatgtgccttgcacactcagagtaggcagctatttaatatttgttgcatggataaagtaatggtgttaggatttggaaattcagtgtaagcagataatgattcttatcttgcttgctgaattttcagaaatgttacattttaagaaaagtgggagttatatctggcactcagaggaatgtggaaatgagccacgcagaaaaatttaactcagaattcaaaatcttggtttatagagagtgcctgagtcagcgctatatacctagatttcacaatattaattagaagaatttaatgccattggaaagtgttaggcacaaataaaatatctaatgtttctgattgtgaatgagataaaatcccagatttaaaggccaacatgataattgaattatcttgaggaataagtgaaagtttggttcctgagattgtatttacacttaaagcgtgaaaaatgagaacttaagttgcagttagtgggaagcaacttgagcgatagctcatgtagcaataaagattctatactgtctgggatattttaaaattctacaacattgagtcagtttcagatttatatgagtatctctaataaacttcaaaagttctaaaggccttggactgtgacactttattttcatactcgtttgcacaaaatcccacatgttgacaggaataagcactggtgaggatgtgtgagggccgcttcatcagctccctaacagatggccttctccattcattttattctacaggcaaacatgctgaagacatatttggtgagttgtttaatgaggctaacaacttctacatcagagcaaattctcttcaagacagaattgatcgccttgctgtcaaagtcacccagctggattcaacagtggaagagggtaggtaattgcctgaaagcagtgagctagaagtgatgttgacaagatggtagtaattaattgcagtgtaattactgctttttccttgggatggcatgctgatatttcatcttgtctttcctagaagaatagcgagggggaaaaacctacaactttgtgttaattcacgatgaaaagattcatatgtggtctacctcataactctatactcttttttaaaaaattacaaatatagtatttgttttaaaggcttctttgaatacagtcagtattagaagccccaatttaggttactgacagttattttaaaaatagtttcttacctaaaacttacagagccactctagagatatggtccaactgagacagtgttacacataccttgtgtgacacaagcacctggtgttcttaggattgatgcctgtaaaatcctggtgattctgctgatttaaaaattttgttaaccttctcagaaatagcatttaccgaaagcctttaggctgcaggctttaaaataatgttaatgtcgacaagcattgtatagttaactgatagtcatttgatgatacaccctgaaattgtcagtttcaacaaaattgaaactatcaacgatcccttttttaaaattttactttcagtatcttgaatgaaagactcagattgagctggagaaaatatgcttaaaaagtacaaaatataccacttcatatttattttgagaaaaatatttaggttaaaatttagttttacctttaaataatggcagttaacaattgctcttgttgctttgaaaagatcctagtgtctgatttttgtgctatatctatagagtagtattggtaaaaataatgcttttattttttaaaaaaagtagttgtggaattcatctctcatcatttaaaaaatatatgttatctcatgttcagtctttttcaaaggtcaaaatttgattagtgaattacaaatataacaaaaatgtaaaacattgattttaatattcattatagaagcattcttacttttccaacaataagtattagttggtctgttcaggtaaggaattcttaacattttaaaccaatcattcacgttttaaattagctattcatctttcttcaactttttgttggctgttgccgttagaatgcttatgataaaccttaccctagaaaagattaattggtaaattaaattttatgagattttatagtacatgtcatatctttaaaatccttttccaaacaagattttaccttattactttccttgccatggatgttacagtagaaaaaatacttgactgacaggaagtctgtattctgttttggtcttgccacttttttgctggagtttttggaatcttaacatttctgaagctcagcttcagtggttgaataggtaggttaatagcctagtctgtccacctcaaaaagtttgatgaaagtcagatgagttggctgggcgcggtggctcacgcctgtaatcccagcacttcgggaggccgaggcaggcggatcatgaggtcaggagatcaagaccatcctggctaacatggtgaaacccggtctctactaaaaatacaaaaaattagccggtcgtggtggcgggtgcctgtagtcccagctactcgggaggctgaggcaggagaatggcacgaacccgggaggctgcactccagcctgggttacagagcaagactgtctcaaaaaaaaaaaaaaaaaaaaaaaagaggtgagttaataaatgaaatgtaaagtgctgtacaagcacaagaaagaactttacccagccccaattttctgaatccttagtgtaattttgtatcatcgatcaagctacttaatttttgggactagatacatgttgaaaagctttgccatttgccatctttccttaatgtttgtttcagaaaaacttaatgtgttatttccatttgtgtaatttttgcagaagtatttcccacatgcattatatttaaactaatgttgtttgaacggtgttttccttaggatattcaaatctgtgcatttacatgcctgttacattcataactatattcctatgtgatttctgagaaatgctatttaaataatgttactctagtattaggttcagtgaaataattagattactacaaaaaaaaagccatgatttgacctcatttcatagtgatagctattatctgtgaaaggaaaggaatgcacatgctcttaaacatggtttttaaatggacaataaaaaatattatttggttgttctaggaggtgtttttaattgtgagtcaaatggtatttacttctaaacagttaaaaatatttctatataactcaacttgggggattttctctaaatagtctcactacaggatatcaacatgaaaaaagctttcaaaagttccacagtccaagaccagcaagtggtttcaaagaacagcattcctaatcctgttgctgatatttacaaccagagtgataagccaccgcctctgaacatcctgacaccatacaggtatagcttcatgagtcccagagcctctccttgagatgaggggagagctgggcagagctgggagcaagctgatgcattgtgtgggaatgtccttgatggttcatctgggttaaaatcagaattgcttcaaactttgaaaataatgattgaattatatacaatgaaactactcattggtacataattattaaagttatagtatttcagcatattgatacgtttaacagtagaaatgtgagttctgattttaacttttagatgtagctaccttaagtagaagtgagtaagttgcataacagtattgtgtgtggttatgttgttgtttttagattcgaagtcaattaggaactgcataattcatttataatgcagcaaaatacctgtttcagcactgcagagacatttgatatttaattcagaaaaaaatgtattctgtagtgttaggggttttgaagagtgaaaatatagtcagcaaattaaccttctgttactggaaaatggtaggacacgttatcaggacgagacttccaagaaaaacaatggaaaataaatagtgcaaaaaaataatatgaagagactaactaaaaatgctctttctaaacacccctcctgccttctcccagctcagcactttcttcccatacctgctgtcacctcttgtcccatatccctctttcacacactgtctctccatcccttgtggtatgtcctgtcctctccccacctctgtgccctcttgtggagctcatcctttggcctctgacaagcacaggctgtggtgaccagtggtcctcacagccccgggccagctctctggtgattctcctgtgagaaccttccaggagcctgcgagttctccacttccattactaccctctcagcagtcctaccctcaggggccctttggcccatctcagggagtgcatagaatttttcttggtcctaattcctgtcctttctcagggtccacagggagatgtttggagccaccctttgttgcagctgtgctaggaaagtgcagttcaaactacaccactttctttccgcacagacagggagaggctctcagaaaaacaggccaaactgatggcagaggagcaagatgccacgcctttttatggaaaaagtagacttttctggaggttttagcacacttatttaaaaaaattaagaatatgtatgaatatagcattatgagccaaatattttaatttatggctttgcatttgttcaataggcattttcctggggcagtttcatttttacttagcagtgaagcctcaaacacaatgtaacatgtaggcttgctcatgaaaactttctacctgccgttgctaagaaacctcactggaaattctgttctaaggaaaaaaaatcagataacccaatgaaccactacattgattagatcatgataaaatatttgtagtgatttatagttgtagtgatttatagtatgaaaactgatttgactttcacatatatatgtgtgtgtgtgtgtattcagtcttatggaaaataaagcatatctttgacttttttttttttttttttttttgagatggagtctcgctctgtcgcccaggttggagtgcagtggggtgatcttggctcactgcagcctttgcctcctgggttcaagcgattctcctgcctcagcctcctgatatctttgactttttaatagtgtgtttaaggatagcagtgccagcccaaatttgctttttcattaatatagcaatatttggggtatataacatataaattttcacatttgaacttaaatatggcactgtaacaatattgtcttaatataagaagtacaaagtgactgaaaaaaaaatttttttttttgagacgaagttttgcttcactcttgttgtccaggcaggagtgcaatggcgcagtctcagctcattgcagcctctgcctcccgggttcaagcgattctcctgcctcagcctcccaagtagttgggattacaggcatgtgccaccaagcctggctaatttttgtatttttagtagagatggggttttaccatgttggtcaggctggtctcaaactcctgacctcaggtgatccacctgcctcggcctcccaaagtgctgggatcacaggcatcagccaccatgcccagcctaagtgacggaaaaattaagtgtttagaagctataggaaacaacagatgctggagaggatgtggagaaataggaacgcttttatactgttggtgggagtgtaaataagttcaaccattttggaagactgtgtggtgattcctcaaggatctagaactagaaataccatttgacccagcaatcccattactgggtatatacccaaaggattataaatcatcctactataaagacacatgcacacgtatgtttattgcagcactattcgcaatagcaaatacttggaaccaacccaaatgcccatcaatgttagactggataaagaaaatgtggcacatataccccatggaatactatgcagccataaaaaagaatgaggtcatgtcctttgtagggacatggatgaagctggaaaccatcattctcagcaaactaacacaggaacagaaaaacactgcatgttctccactcataagtgggagttgaacaacatatgggcacagggaggggaacatcacataccgggcctgttggggggtgagggacaagggggagggatagcattaggagaactatgtaatgtagatgacaggttgatgggtgcggcaaaccaccatggcacatatacctgtgtaacaaacctacatgttctaaacatgtatcccagaacttaaagtataataataaaaaagaacgtatctgtttatattcttgtcaaggttaacatttgcttacttaagtgagttcccgccttcattaaggtactggctccattttttaaaaaacaaatgtacctcttatatgtcttaaattttgcagctttttctagacctctacctattcaaggccttggtatcttagggaaacaaattatctttttcacaataatgttattaataaaatctctatcatgcaggttgcctatcaattaggaaactaggaaaagaaaggaaggacattaatagtcaaaggttaaggtatagtgtgagttgcactggctcttcagtgattttcagacatagcgactagaatagccccataggcacccaggcctttgtatttgatggtaagacacttaacaggagatggcatagcaggggctttaatgacagacctttgttttcttctgaacaattaaattagccattgactgtttgggcataaactctcctatactcatttaactgattttgcttcccctgtgttccttaatgactcattgaaatgctgatatgaagtaatataaaatgttctgcctccttttgaaggtagtcttcaaaagcattaatagaaaacagtgtttactttgtatcatgatggttttgatcatgacttgatttatatgacagttttggacctctgctagctccatcattggttttatgataaatgagctacttatatgaagacttaaaatattctttagaccacagtaattgcctgtgacagtgctttaaaatgaaatggccacaggtgaataaagtttctgtgtaggttacttccagtttgaaaatacgtagttcatcactatttttccttacattgatgccccataaacattttgcttctttcctaattgaacttatagatgttgggcaaaccttattgagaaaaagagataagagtacttactaatttttatcctaatgatattgaagctccagtgtagaagtgaatgtgttcttagtaagaatccatccatctctgtgtatggccccatgttggaataagcaaaaaatttcctgaagtgattgagatattataaattgctgaatatgagtcatgttgtgattttttttttctgagcaattttctatactcaattctaaatttgcaagagtacttttaacctacaacaggttattctacaacaggttgctattttatgttttcacattttttcaaataaggaaacttaaagacttaatatgtgtaggagagtttaagtgccccatgtagatgttataatttcatgagttcaaatcaagttaacattaacctacatataaaagtctctaacaatcttttcttccctgacttacaatacattgatttgtagagatgacaagaaggatgggctgaagttctatactgatccttcctatttctttgacctctggaaagaaaaaatgctacaggacacagaagacaaaaggaaagagaaaaggcgtcaaaaggtaaataatttcagtatgggaaatgtgcatatcagtgttcaaaggagattcttgtttagaaatagtaaattatttaaatggttgagatactggatatagtgctgaagtttttttagaggttgcatttctcacaagagatcctgacaattcagtcaaacacagtaatactatcttcaataaatactgatatgttctccagcacttgctttgctttaacaaaagtagttcctaaactttgttttgttaccatgttttagtaactcctctcctgcgttctcaaatttttgtaaagcagtcagtattccatatcagatacaatgatcatgcagcacaatgatgtgcttttgtcttcttaacatttttaattgtttggttgccttctagctgtaattaaaatcttgggaagatgttcacatgggattgagaagcatatgtgatttgcacgttcagcggataggatttactgaaaatgagcctccctttaaggggtaggggtaggaagagaattgcaagtttgaaggttgagaaatatctgcatgcattacaagcagtcttcaaaggagaagcccactctactcaggttaagggatttgtgttttgaaaattgttcgttttgggcccagaaattagacttaggccactgagaggaataattctctaagggcaagtatttattaatatttttatatgtcagctgtatttaaaaatgaccatccagtttgctttacagattagagcgctttatttaggagaaatgcttagcattttgtgagttgatagccttagggttttgaggcattgaggtgtgttggcccagtaggagtgacagtttggtctggaggagaatttgaaaatcgaaaacagcattaaagggaagagaacatgagaacagtttgcagactgtgctgttgtaagacaccatggctggttccgggaaagaggatgcaaaggacttggtcacacacagtcttcttgtgctcatggctttgggagatttaattgggatatatcttggaaaagttgctaggttttgcagaatattcaagtgaagaaaaaagaaagataccaatcttttgagtggaaaaggaacaaatatttaaaaagcatatttaccttaatcctcatgcttttttatagttacaggggaaaatgctggggcttacctgcctttaaaatgtgcctgtttttttaaaaggccttctaggtttcctttctcaatgatgcttttggcaaaactgtttaattttttgccactcttcttgaaggggaaacaatttttatgtatgaatattatgtctttaaaatcatttgttatttcctgtgctgttttgtctcattctaccttcctcaaacacataaaattctgataagaatttctttcattcacttatataatgacttgatgttgaatgccttctaaatgctggataaacagtggcagaaaaaaacaggattaccaccctcatggagaggacaatatagtgagggacacaggccttaaataatcatgcagccctcggaaatgcagaaagagggagagaagtttcaaaatgttcatataggtccgcttcatatggaaatagaaaatgaggcaagatattctttatttcccaggatttcagaaacccaaatcatgctcaatttgcagttgacaaatctgaaggaaaaattagtttagaaaatttggggattaaaaaacccatgtttttgaacttttgtctcctttagtttaatgctttaaaagcattaaaaacttaattacacaaataaatatgaagttttaaatatgtagttacactgttggtaagtttagtgaaggacaagtacagagcactctgagtgagatgacctggtgtgtgacagtgtacacacagtgaggggtcaaggaagacctctctaaggaggtgtcatgcaggctgggttccaagggagggtagcagaagttagctcaacagtgggaaggtgctacggggaggctggagaggtgtggggggcagatgaggtggcgtgcttccgaattgaggaggcttctaggtagcagtgtctaagatcatcctgggggaggaaccagtttggcagcttctaaggattttaatgtaggccagtgtagctggagcctggattcatcactgttcatattctttcatgtttggttcgcatgcgcttgtgtgtcctgtgtgcatgttgataggtagatttggaggctgaaccatggtgaagaaagttgcaaatatcataacacttcatccctgaatttgtcagcatgcatcttttaaaaagtaaggggaatagttattcattatttttacacttgatcttagccaaaaggccgagaagcgattattcattatttttaatacgatggttcttaatcaggatgcatattggaatcacattgaaatcttcctcccccacttttttcctttggtttttcaaagtacacacccaatacatgctggttgtaaaatactcaaatagcactcccttccctgggagtacctagccacggttaacagcttggtgtgcatcttttaagaccttttagcattcataaatatttgcataaacattttacgaagtatttgtgtatacatagttgtactacatatgacttacatacacacactgacattattaaaaatgtacttcattctttttaatagttgtgtagtattctgaaatataaatgcttcataaattacccattactgttgctcttacaatactgcagtggttatccctctacttaggtgcagataattcttcaggataaatttctagaagttgaattgctcttattgaagagaatgtgaattttaaattttgaaagatagaattatattgcccgtaatctttaaaagactgaagaactagtttatgttcttaccaggccttctccagtcctggatattactttcttttgatgaaagattgaatgtgttacatcgtctcatatgcttattaaccatttctttatcttctgtgaatttcatgttcacatcctctgtggatccatgcctaaagcctccgggatgcctctgaaaacggtccagttttctgtcttcaccacacccttgggccacctgctgttctttcaccctatacccacttagtagctttctcacttgtgtccctatcttccctcttttaatttgttttctgtaacacagagagatcttctccaatgccttctcagcatgtcagccttcccttcttgttctttaatgggttcgcattgctgttgggataaaggcctctaaggtcttcctgcctttcagatcttgggccattcaccccaatgtaccatttacattcttttatttctttgagtgcagtgctatcctcctccccagagctctcacacagtctgtcctctcctcttggcaggcacctgacccatactcctctgcagaattgatgccactgtcaatacactttcaatactctcagtcattccaggatgcctccctgacttccagactagacatccagactagacacacatacacacacacacacacacacacacacacacgtatatatttaaacataaaaatatatttgtgaaaataaatacatttatttttatggtacatttataatagtacctttatttgtgtcctcttgtggactgcaggctccatgagcgcagatgccatgtctgtgtgtgtgtgtgtgtgtgtgtgtttgccatttgtgttgtcagtgcctggcgcagtacctcgggcatagcactagaagttcatgcttgctgcctggctgtggatttgatcatttagccagcatgtattgagtgtgtattctgtgtaaaaacagtatgttgagataccataagacaagagggaaacgtaggaaataaagacacatgattctcatccttaaagatcataaaattttgtataggaggcaggaaaaacttagaggcacacatagaaataacttctcacgtttcaagaagcacctgtttaagaactaagtatttgttgaatgaaacattttctggccaagtagggctagaggaagaatggtgctttttatgagcaggtaagtttttatcttgcttaattttgtgttaaactatttacaggattcacttattccgtaatcttttagaaattgggaacagaatgttttgaattattttctttgaaagataattgtacgttaagaagtcagtcaaaattgtgtggtggcgggaaataatttctctttatggtgtttccaggttgttcacccatgtaatatagatctgaaagaccttgtttaggtttaaaacaagttacaagcatattcaagtgaaagtttttttactttaatgaaaacgatggtaagcaactcttaacagttgtagcagggtaactttttgttgattctgttttgttggttctgttgggtaagaggagtgcactgctttagagtttctgtaacattagggtaatcgaaatgcgaatgtgtcttgtctgttcatcaggcatgggccttgtgcattataactgcatttaaccagctgttttcctttcccttctgtcttggcatgctctctttcctttcctggacatcaggagcaaaagcgtatagatggcaccacccgtgaggtgaaaaaggttagaaaagccagaaacaggcgccaggagtggaatatgatggcatatgacaaagagcttagacccgacaacaggttgtctcagagtgtgtaccatggagcgtcttccgagggatccctgtccccagatactaggtgtgtgtgtgtcactgctccctcagccctgatgcttgggcaactgggtactacctggttttattatcatttgaaatgcatcaatagcttcggggtttatatggcccttgatgtcttaagattttccttaaaaattgtttatctgtattttgattttgaaataatacttgaagacagtgttattttacattgggttcctttgattttagaaaatctctctgacttaaaatgtattgttgagttcatctagatgtagtgttttaacactgattctgaatttggggtaactgcttatgacttaagtttttactttaataatcatttaattctttctcttagcatggaatgttgaatttcctttgccacttggtatctaaaaatgattggcaggtggtaaagtaactaaggagtaccttcattgttcctttagtaaccctttgaaaaaatgatgaacaaaagagagatttacttcttatttcagataacttatatattctgatttcaggagaagaattctattggcgtttacttaaaaatttattagcagttaagtaaaaatatttcttgcaggcgtgaatgatgtggtcattaagtcacacttgtcaccaaaggcattcattgaacaacaggaaatgactagtcaattttaacgtttgattcagttttctatttctgcttttgtaaagttgtagtcttccatttgcataaactctcatcggcatttaaaaatttgaatagagaattcttacaatatgtgatcaagaatgtttcaaaacaacagcaacctggactttgggttgtatctgtgccctttttttctacctttgtaaaactcagtgtttagcacaaactcttaacgtattacgtgccttcaatgttcccaccccagaaggtctataagtcattgggaggatgtgaggcaagttctggtaatttttctgtacaaacttctatttgttaaatattagagaattattggagctttaactgagttttagcctcatttgaattttagtgtgagtttatttctatagaaagtaggaattataacacagttctgctcatagttctttgggtggggaggaatgtatgaacttaatagctcccatgatgtcaatctgcttttttgttttttttctaaataatttagctatgattgtttactcgtgcaaaacgtatactttgtttttatcctatatagacttttcaaaaatagatgcagatgggaaaatgatggatttttaaaaatctctcagttgaatgatactccttctagcatctgagattattccatgttggatataaaatggatggttattcagatatagtctgcctttgtatttatgttgcttacatacatctgcgtttctcttaattttcaaaaaataagtctgattgttttatttcttcagaattccttttgttgtctcctactatttcccatggcttcttactatttgcatacattatttactatcagataaatagattataactcatcattgtattggattataacccttaatttagaaatttttatttttttttactacagtgtgtcacttttttattataaaataagacatgcttattatatctggaagttacaggaaaaaattaaaatgaaatatgatctatagtttcaccatgcagagaaaccgttgtatgcattttagtgtatttctctttagtctttttctatacatgtgtttcttttttcttttacaaaattggagtcatgccatgttttctttcttttgacttttagaaattatatcccatgttttaggtattatttcgcaacatgatttttaatgattgtatccgctcatctgagtgcatccaagatactgagggaaatttaaataccaggtttcatggtgtgtgtatatgctattatataagtaatataccgtaacccatcttacatttttgctctctctctagattgttaggaatggcttgttcctgagaataaatttaagatgagcgctgggaagtgcttgcctgctgtatgaccagctctctgtcactgccactcagggagtcgcacacctccatgcccaattgtccttgttttttctcatccagttctgggccctggtgcagatctctggctgcccgcctgtctacccaaaaaaccctgggggatatatcgacctctcacactgagtctctgctgctgtgcctacttcctcccgtgtggtgtcgcctctggccctcccggccctcctcctcccatgtcagcgttgtctccagccctcccagccctcttcctcctcctcccgtgtcggtgtcatctccggccctcccggccctcctcctcccatcgtccccggccctcccagtcctcttcctcccgtgtcagtgtcgcctctggccctcccagtcctctcttctgtaataggtgatcactgaccatcatgaggcctcgggatctccactcacctccaccttggccgtgcgtctgcagctggtttctgcctccccactgggagtggggctcatctccaacagctgcctgctcctccctcctcctcctcctgcctgctggcacatcccttttctgtggtccttccctcttcaactgaccagtcccctcttcccccagcccccgtcctcctgatgggcacccttcatcagggttctgccctgtagaaatctctggtttctacttcagatatttatcgagtcttccttcacttctgcctccatctggttagccccttttccttgcttcctttctaccctgtgttgcaaggctccttgatagggatcgccctcctagttatgccacagtatttatagtttcctaccctcatctcatcagaaagctgtccatgtttggctggagaactctgtttcctttaaaaggttgcactgtaagccagtgactcgtagtcatgcgcagagtcaagcacacatcatcagtgtctccaagggttataggaatttacatttttaaaatactctaaatctaaatacaggtcaggtccttcccccattaaatatatttttaagtcatttgctagcagctcacctagttcaaaagacataatcagaagtgcaccataatccagaattcatactgcaattagggaagaaaataatgagtagttattagttgttacacttcaattaaggaaggaaaaaggaaaagaagctgtctcttctcatttggaaggcttttctgtgccacatggtgccccagttaagaaaagctaccaactggaatcccaaagatggaaatgcagcgtgcatcttccctgctccctcagcacccccaatgtgtgtttggtatttccttcagagagagaaacacaagctgaaccctaacagaaaccagcaagtaaatgtgagaaaagtcagaacaagaaaagaagagtgggagagaaggaaaatgggcattgagtttatgagtgacgcaaagaaactggagcaggcagggagcgccaaagaggacagagtgcccagcgggtttgttgttttgctttctttgggttcccagactcagactgcccctgcttctgccgccatgagaggatgtacagcccctcctggccacatgtcctgtaacctgagccaggagcgtgtgactgtcttactaacgcccacggcactgccgggctgccacacttgggtccttcctctcctcctgagggcttagcaggaatcccgtccctgcaccccatgtctcagctctgctccactaatccaagatccctttcctttcggagtttcacacccagtttgtgtgcaaagaaaactatggaaagaaggcctttccatagtgcaccgcattgctttctgccctttttgttaagtacatttcttctgtttaagaaaaatatgattcactctactgcattctcgatttcttttcctgttcttactgttaatatttatccagttaacctgccattttatattttctaattatatgctgtcagtttcattgccactgaaatcttctgtcttatatcctgtttctaaatggaatggtttctttcatagccttcttagagaaaacgtatgctgaaatactgtgaaaaggaggctctgctgtttcctgcttgccggtctgtctgacttattcacttcaaagctgtgaatctgaatccatgtaacactggggcttgctgccgacttataataattatgttgttgcttggaatctctcacggggctatacctagttgatagtaaagcaaattaatgtctgatttttgtgtattagcaatgttattattcaaatacatccatgtgcctgttagccgacaatttttaaattaatttaaatttctcccacctcttgttttcaaatgccaggtcacatgcatcggacgttacggattactcttacccggctactcccaaccattctctgcacccccagcctgtgaccccttcctatgcagctggtgacgtgccaccacacgggcctgcaagccaggctgcggagcatgagtaccggcccccatctgcctcggcgaggcacatggccctcaacagacctcagcagccgccccccccgcctccccctcaggccccagaggggtcccaggcctctgcaccgatggctccagcagactacgggtaactcagcatgccttgtaccctaatccctcctggccttgcatttgaatcttgctctatgtggtaggagaattttaactccggtattttagaggccaagatagagtcaaggatgactggatgtagatactagcaactctaacattctgtgtgaaataaagcaggtgcagcataagctcagacttacagttgagtctcaggccacactgtgcatgcatgtgtgttccctcacacacactctgggtgtttgaatggctctttaagccaaggcattgataaagggtattaagtgctgattttgtgaacctgtcccaaaccctcaagtttctggacacatcctgagtggaccacagaaaattgttatcacagacgagaagaccacaccatgcagctcctgtgcctcatttctcagacttgaccaaaatctgctttcgtgacctctgaccacccagacatcattctgccccaggccctcctgttccctgagaagtagaattcagagacttcatgttcaggcgtttatcaatttaggcacccacctctcttttttttggctttactctagtctttaaagacttcattcctcagagttggtgcccaggaaaattaccgtgtgttggtgtccactgctaacacgtgtctgcacacccctgtctgaatgacaatcctgctctcagaagtgctctccctggccatgcatgccaagtcaggatccccagagtggcttgaggctgtgtcaggccaagagagggcccatggtccagttagtttggaagaccctcggctgaatagaattcagcagatttcttggctgtgtgacttttcgaagcttttgatacacacctgggcactgcaggcatggggcatttccacggaggtgggttagagaatgtagaaagctcccaatctggttgaccttaggacccttaaaagacaagtttgtgagctaccgccttgagatcccagtgtgaagccttcactggcgctgccgtcctggcctctgcagtcagctgctttattctgcctttcttcaggaagtgctgcactttttgagtggtcctccttttggcacatttcagtagcagatcttgacttctgtcataatgaataatgtcaaactgtgaaaataactgacccaaggtgtgcatgtttgcatcctgccatgattgaagttcaggtgacaatacgtgttgtgtctggggatggctccgttaggtgtctaagagctcccaggacgtgaccctctcttgttcccttggtgactatgtgcctcatatctctctcaggatgctcccagcgcagataattgagtattacaacccatccggaccacctcctccgccacctcctcctgtgattccctcagcacaaactgccttcgtcagccctctccagatgcccatgcagcccccgttccctgcatcagccagctccacgcacgcagctcctcctcacccaccctccaccgggctcctggtcacagccccgccacccccgggcccaccacctcccccgccaggccctcctggtcccgggtcttctctttcgtcctccccaatgcatggccccccagtagctgaggcgaagcggcaagagcctgcacagccaccaatcagtgatgctcgaagcgacctcctcgctgctattcgaatgggtaagtggagcccccagacacacagcctgcctttcagcaagaggtttcttcatgtctccagccagctacagcctccttgtcttcaaatgactactcactacgttttttaaaatagagttaaaggggtcttacttgatttttttgttttgttttgaatagtagttgtgtttttgtccagtgtaaggtaatcaaattgtgataaagattgggaaacagccgggcgcggtgggctcatgcctgtaatcccagcactttgggaggccaaggcagttggattgcttgagcccaggagtttgagagcagcctgggcaacatggcaaaactctatccctacaaaaaatgcaaaaaaaaattagctgagcatgttggcctgagcctgtagtcccagctactcaggaggctgaggtgggaggattgcttgagtgtgggaggtcaaggctgcagtgagccgtggtcacgcccctgcactccagcctaggcgacagagcgagacccgtctcaaaaaaaaaaaaagaattgaaattaggaagtttttacttaccttgaaaccagaaacccaataactgaagtgatcgactaattaattggatctcttctctgcattctgctctaaggggaaaagtataaatgaaagaaagtgagctcatattaatgatttctttaaaaaaaaaaaagagtttgtgctggacttgtcatatttgcttgatgtcctaagccagtggtttttcagaatctataatattcaacagcataacccttttgtcagatgaaagtcccgcgttgaccccctgaccacaaaacacatggaaacagagcatctcaggtggaattgggtggggagtctgccctcgcctgtcttgggctgcccagagagcccctgggaacctccagcccacaccatggattcttaaccaggtcccaacccaggttggtcgagggtccctgacatgttatgggaatatccaagagcttctcgcctgtggggagctgcacagacttggtcacagtttagtcatctcatctggaagtgaccaagcaaggagcctggctgcagcccgccagctcagcatcagggatgtccttcagaggagctgtgatgctgctgcctctgcgtttttcttgtgtgcccatgaaccaggcccacggtgtggcccacgcacccttctaaagaccccagggtcctctgtgtacctggacatcattgacacacttttattttgtcaagataaaaaagtcctagaggtatattagctcatgaatatcaagttcggggtcattgtaggacggtgttggatttgccttttttttttttaacaccttataagccctgtctaccaagagtagatacataacctgtatctaatctcgaggaaacatctgatacacccaaatcgacagacattctgcaaaatagcttcctatattcttcaaaaacgagaaggttgtaaaacacaaagactgtgaagaactatccagattaaaggacattaacaaaacttgacaaccaatgtcacggataatttccactggattctgaaccaggggataatcttttccatttgcaattagattgggtctttttgcaaaatttgaataatatttgtaggatagatagtagtagtgtatccaaactaattttgtgattttgatattttgggtgggcgaggcgggggcggtaacacatgaactattttaggggtaaagggacattatatgccattcactctcaaatggtccagagaaaagtgtctgtgtctgtctgtgtaaagatgataggggaagattgggaaataaatgtggtcagatgttagcagttggggaatccaagtatatgggaatgtttttctgctggtctcatagctgttctgtaaatctgaaattatttcaaaacagttaaaaaatgaatggataccatcttgggcaacattgcaagactctatctctacaaaaaagaaaatacaaaatttaaccgtgcatggtggcgtgcgccggtggttccagctactcaggaggctgaggtgggaggattgcttgagcccaggaggtcgaggctgcagtgagccatgatcgtaacactgcactccagcctgggtcacagagtgagacccaatctcaaaaaaaaaaaaaaatggataaacattaaatcatcaaatatcttactttgttactaagctagaaagtagatgattgtattttatgtttgtttccacagtaattgttgaaataaaggtttctcagttacttcttgggttagctgagagtgagtagcatagaacactgtttccaaggctctggatgctgttgctgcctagtagatgtcctgtggtgatagaaatgctccagcctgcagcgtcccagagagtagccactagccacatgtcagttcatgcttttaaggctatatgtgcctagtggctgctgtctgggatggtgcagctccacagttttctctaatggtgttcaggtacactgaaattaggaatttttaatattttaacacattactttgttacaaaaaaacttctcactttgaatgcatgttttttctcatgaaacttttaatattccctgagcttttctcccctcaaatttctaaaactttctgtccttagtgtcagtagaaaaaaaagtccaatagacatatttgttcgtttatctttaatttggagccagcaaaaggatgtgattctgaaccacgtgttgtgtctgcaggaattcaactgaaaaaggtgcaggagcagcgggagcaggaggccaagcgggagccagtggggaatgacgtggccacgatcctgtcccggcgcattgccgtggagtacagcgactctgacgacgactcagagttcgacgagaacgactggtccgactgagcaaaggccggcggagaggccgcgtgtgggagcgtgttgaagattttaagtggtctctacacccaaatagtggtattctaatcccgtagcatagcaccttttgtataaacaatgtgatattgcttctgcacatccaaaaattctgggtcttttcagtatttactgtgtaatacttaagtgccactaaacatagcaaattgtgctgcacatgaggaaataggctgtcactatcacattgtcctgaaaacagcatctgctttcctcttggccatgagagtatttagtgcagtttgggtttactcttactgatcaatataactctgcagacttgctgtgtgtttgtgaagctgcctggtgttaggtctctgcaagactaatgactatgtcagagtgatgtcttccaaccagtaagtgatattgtttcaccgctttggtttttccttttgtttttttaaaggatgtgtttctgaataagttggttttagagggaaaggttcaacaaacagggagaatccagtgtttctgctttcagtttcttggcttggtagcctctgagtgaatctgatgctctgctgaataatttcattacctctgcacatgcctgtcaaatatgaaattggaagggcccttttcaggctgggttccctgtgggcatttgcttagtaaatgcctgttgatggtttttgcaagagaattcagcagctcaacagtaatgaaagtgaagaacagagtccattttccttcctggggccattggggatgacactcaagatacttgccagtctctccagtgtgggcaccagccggccagaacagatgcgagcagtccatgactctgggagctacaccgctgagctgggcagagctgcggcacagggcctgggctgcaaaggagccctgctcctttagtttcctgacacctgtgtcctgagtgagccgcaggagttcttagctcctcagcgagcaacagagagcactttagatggcacctttcaccacttggtcagaattttaaaagcttaggtttaggtgaaagtagatattgacagctattcacctttcacggtgctggggccagattagggatcactcccgtgaggagggccttcaccctgttctagaagcacatggttgtcctcctgttgttggcacattaaatgataaaaagcacctcatgagattcccttgatcagccctgcagctgtagtacagtgctgtgccctcacctccacccttcctgttgttcccacgtgggcaataccagggacccatggggaaactcaagaatgacagcttctatattttgtaattctggatgaaagataactgtgttgaacaaacaggtgctccaggctttgattatagatacgacttcaaaaatatgctaagacgcttgacttattaaggactttaacctactcaacagtatttcatatccattgtggttagttactcagttatgttgagaagaatctggagctaaaagcagagatgtttgaggtgacggtaggaatgtgagcaggatggtgatgggggtttttgttaaaatgcatctgagcaagtcagccagccccgaagtcccctcagtgtgtgtgtctcgagtggctacctgttgggcttgtgggcagtgattgtacagagcctgtccattgggtgcagtcatgtagatctgaagccctgaaaagcctcatgtctgcatcccctttccaaggctgcttccctggtgtgtctgttctctcctctgtcccaggtgctgggagcgtcctcttcagcgtcttttcctagagctggtcaccactaggctgtcactataaattccttgaatataagtaacagttattaatgaacttctaaatttctaatttctctctctctctctttttttttttttttgttgttgttaaaaagggcctactacattggcgctattcttaggacttctgcaacttttaaagtcttacttgtctttcttgttgcttttgtattaggagttccccgtgtgggtctagaactcccctttggtaatgcttctttgtttttttatggcccttctgttctcaggatggagagaacacagaagctactatccatgtcaggatttattctatttatatcttattacaataaaattagtggcactttattcataaatattcatgagcctgttaattgttagttgtcttcctgtagctgaatcaacaagttattttcaactcaattttatgacttgcgaaaaagcttttgccctgttgtgtaccataacatttaaaagaatggaaaatgactgaaatccaatttagattatttttagagtatttttccagcaaattcaatttattctgaaatttaaatccagatcttttctaatatggtattacaatgaaaagaataaagagaagatttgaattttcagtttcattttcaaaaactatttaccaaaacaaatggagaagaaacatccaaaagcacatttcatttctccaaactttgtgttttaaattatagttataaattgtaaggtaattttaaattgtccctcgtattatttctccacgtctgttttagtttaatgtctcctaagcttttctctcatagcgtagacctagggaagggatgggaagattgcccagtccccgatggctgcgcacacaggaggcggcggagcacaaggcaagtgagtttgcactgtcagccccagaccgtaagcttggctacactgatgtttttctttactaaggatactattcaaaaattaacattttcatctcagtaagtttttagaacatcaaaatgttttctgagctccaagtggctaggttgtaaaagttttataataatttgcaattaaaatacatgatacatattaatccattaaagactagtgggaatgtatcagccagagtagcaagtaatttttgttttataaatcatagtatctgtcatcttgcagtattaccaatgctgttgtaaattgaatttaaagtggtattaaaaaaaactgttaaacaatttttatctgtttgtatatcttactatagattatgtacaagtaacatctaaataaaattacacttttaaccctaagaggttttgcttattaataacagtgttgtatgtttggcttttttggaagagaacttggtgttaagtggttttttgtttttgcttttgtttagcattttccttattagacaacagaagacactactttggtttccatttaaatttctacataatttttgtgtcaccaagagttcagattgaattcctgaatgactcggggcagcactagtctggttagaaagaaaaggccatgctgggagtagggcagccacctgttgagaggatagagcctggggcaagagggtcttaaccacatttactctcaacggtaaaagtgaataacacgctgtagtatgtatgtattgcttatgagatgttttcatttaatccttacaataatccttaacattctgtttcatatgtgggaaaactagagtgaagctaagttactctctcagggaccttggtcgatagaaaactcagttctggggcagaatcacatgttggggtaatgagagtcgagattgggtgggtaagtgtggccacatacttcagagacagccagactggaggtcaggcttcctgtagaagctgctttcaagttcctgatgcacacggtgtgtacctctaccatggcacgcatcatgtggtatgatggctggttctgtgtgtagcctttcactggactgtgtgctccttgtagatgtaagtcatctttgcatcctgagagccttggcacagcacccagtctcctagacaatgagcagctgctttttgcatgattagatgagtggatggattcctgagtggttttctttagcaaaaagtaaagtgtgagcaacttttttaaacatggcaaattctaccaaataccttgaccttgcatttcctccttagtacttgtcatctgatgtgtggctccctctttatggtgtgtattccccaccagactgagctctgggaggcaggaaggggcctgttctgctgtatcctgtgtgttgagcacagtgcctggcactttctaggtttcaaatagttatttagggattgttgttcatagggaaaaaggggaggcttcttcaacaactgtttgtgagcctaataagatttttaaatacatggatatgtgtaaaacacttggaagagtgcctggtgctaagcagacacccagtggttgtgacccacctctttcgtctacaagccactggctgaaaaagagtggcaggctgggccctgccctcatggggctgctcatctaatgagaaaaaaggacattaaatattgtcgaataagtaatttagatcatttgacatgtgctgaagtttggggcagaatgagaagtgcccaatctcagtgggccaagagaagctgagatttgagaatgaacagaagttagctcagggaagggaaaggagtttttcagtagagagaacagcctgtgcattccctaagatgggaaagacaatatggggtgagaatggaactaaagtattgtggaatggaagcactgagaggaagaagtgtcatgagatgggatacaaagatgctggaaacctcccatgcccagcattcgggatttagggagctttctgaaccaacaaaccccaccatgatgacatgtctgccatagctgcacacctatcaaaatattcatatttacagcctattggttttttaattgatcttgatagcctcatgccttagatggcactaatcttagaaaggatcttaggtccgttttatttatatgtatttagaaggcatcttagtgctctgctagtctagctcctacctttaaagatggggaaaaggccattgcttccattgatgggggctcaaagcttggtctcttgactcttgaattttcaagagttcaaggtcctcctgttccacctttcagagttaggtaaatatccctcaccctctgtttcattatgaaaaaaatttaaatctacaataaagttgttcagtaaacactcatatacccctctccatctgttcatcaattcttatcttttatgcatttcaaagtaatgtgta

SEQ ID NO: 15618 - DNA, 52865 bp, Human
ttcccattgtgcagccatctgtattagtccactctcacactgctataatgacatacctgagactgggtaatttataaaggaaagaggtttaattgactcacagttccacatggctggggagcctcaggaaacttacaatcatgacggaaggtgaaggggaagctggcaccttcttcacagggctgcaggagggagataactcgcaggggaaactgccacttttcaaccatcagatctcatgagaactcccttagtaataccagaacagcctgggggaaaccgcctccatgatccaatcacctctcaccaggcccctccctccacacttggggattacaattcaagatgagatttgggtggggacacagagccaaaccatatcaccatcactgccaagatttttacattttgatttcacagtagcctactctattatttaatgtttttgtttacatgtgtcaatgaagagcttatgttcagactgaaatatatttgacaaaacaggaatatacatgtaggagactaacacctggctgagcacttgccaagcactgctctgaggcactttatatgaatgaacatctcctctataaggtaggtgctatcatggaccccagcttacagcttaggaaactgaggcacagagaggtttaggaaagctactcaaatgcttgccttggcccactggttgctaccgtttattgagaactttaccatgggccagggctacacgctctttggttttttttttttgttttttgttttggcggtggggggtgggcgggggaacagagcttcactctcgttgcccaggctggagtgcaatggcgcaatctcggctcacagcaacctccacctcccaggttcaagcaattctccctcccgagtagctgggattacaggcatgcgccaccacgcccggctaattttgtatttttagtaaagacggggtttctccatgttggtcaggctagtctcgaactcccgatctcaggtgatctgcccgcctcagcctcccaaagtgctgagattacaggcgtgagccaccacacccagaccaaaggctacacgctcttaagctccttgctcatctcacagcaacctgacgatgtggtatcaagacttagagaagggaagtgagtctggatttggatccaggtttctctgactctgaagcccgtatcttaagcacgtgtactgggctgcgaagctgttatgggacagcagacgcaataggtggattttgttccggctgtggagcaccatgagaaggaggacgaggaggattgggacgcccagttccggagtgctggcctcagagcatgcaatttatatgttgagaagagacttaagaaagcaagccaaggagcagagccgcagtggccaccgagttggggggtggttgagtgctcatggagcccgtggattttggacaggagttcctgctgcttattaatcgtgtaacctcagaaaactgacgccgctgctctgcagagtgccccggccacactcacgaagtggagataatcctccgcgcccccagatggttgtgaggggtaaactgagcgatagttgtgaatcatagagctgggctgtagagcagcgattctcaaagagtggcccctgggccagcggcttcctagtcaccgggaacttggtggaagtgcagactctcagctctcacccacgctgccgaatcagaaactctagggtggggcccaacaatcggagtttgtttgtttgtttgttttttgtagagacagaatcactgtgttgcccaggctagtctggaactcctggccctaagcgatcctcccacctcggcctcctaaagtgctgggttacaagcgtgagccaccacctgggtttgtttttttccagccctccaggtgactctgagcaccctcagatgctctgctgtgacacagcgggcaaacacatgtaaatgtgatgctgtcacctgtcctcacagccagtcttgcgggcagaagtgcctttcccacaggggcactgacatctttgctggactcttttaatcctcataaacccaggctgctggcacttgaaatttgagaagggcaatcagtctggcctcctgcctttctggcctgcaggcccagcctggacaaacaatttaggtggagctcctggaggctggaagcagagaggaggtacctcaccatcctctcctgccagctgttgcagactctgcctggggaactgattaagggtgagcagaggcatttatctccatgttaacaagcaggtgagagagtagcggaaaagaacttcccatccacttcccgctgtggggtcgagctcagaagtggggtgtggggctgagcttggaagtgaggcatggggtcgatctcagaagtggggtgtggggctgagcttggaagtggggtgtggggtctcagaagtggggtgtggggctgagcttggaagtggggtgtggggctgagctcggaagtggggcgtggggtcgagctcagaagtggggtgtggggctgagcttggaagtggggtgtggggtctcagaagtggggtgtggggctgagcttggaagtggggtgtggggctgagctcggaagtggggcgtggggtcgagctcagaagtggggtgtgggactgagctcggaagtagggcgtggggctgagctcagaagtggggtgggggtgccgagctcagaagtggggtgtggggcttccagcatctgcaggagcaggcaggccttcagtcatatctggggactcttgtcccagggcagtcacacccttttcctcctgagtccaagcacggaaggcctcagaattctctccctcctcctcatggggttccgcaacccctccagcccactggagctggacatgaaatgaaacccacttatttcttccttcgataccagcccaaagttgaggaaagaaatcgtttcccaggctcaatgtcctgacttcctaattgcaggggttaagtctatttcggctctgaccatgtcacacccccagttacacactttgatgcctccccactgtctcaggtgccccctcctcagcactgcgcccccagcacctctcccagcggcagccccattgctggcctgcatttgctcagacccagcctccccacccccgcgctgcaagctcctggctccatctccgcacaccacagacaggcatgacctagcacagcgccttccaccccatgcctccccttccctcctctgctgggcttgctctacttggccttgaaagctcagctcagtcgtatcctcccgggggccctccctgacttcccagatttccatctccctgctgcaacttgcagcgctggctttagccctgatgaccctgaattgagcttgctggttacatgggggcctcccccatcctctgagctcccccataagtgacgctgtctgggtctgcccatgcatctcccctacagtgcccagcatggcatcaggctcagagtgggcaccaatgatgttggctgaactgactctgggccccaggtccctgaggcaggcagagtgagggctgatttgtgggtccacgctgagaacagaatgcaggacccctggttggatgcccaccccaggaccagagttacagagcttcagccctgcctcgggctgactgtgggacgctaagcaaggcgcgcttcctctctgagcctcagtgtccctctctgtccaaagacaggtctgaaagctctgtgccagaaagcggacagtgagcagggagtggagctgccagattttcagcctcctggaggtgtcttggaaaatccccagtgatccttgtcgctcgaaactcccagataaggagattgtggggcaataaacctgtgtggagttttggtcagggcttgatttgggggattaaacagaaagaagctctgctctgtctccagaaggtccaggcaggacaagaccttctcaggacagctgatggctggacagctctgtcgcccttgtggtcctgtgtgtgtctggtgtgtgcaagctgcagcaccctccacagaccgtcctaacaggtgggcagggcagggctgttactattatatggatagaaactcagaaagcgggagaggggacgagatttgcccaaggtgacggagcgaattggtgtcagaattaggattctcggccaggctcagtggctcacacctgtaatctcagcactttgggaggccaaggtgggcagatacctgaggtcaggagttcaagatcagcttggctaacatggtgaagcccctttgctctactaaaaatacaaaaattagccaggcgtggtggtgcacacctgtaatcccagctacttgggaggctgaggcaggagaatcacttgaaccccagaggcagaggttgcagtgagccaagatcacgccattgcactccagcctgggtgacagagcgagactctgtttcaaaaaaacaacaacaataaaagaattaggattctccagcctgaccagcacaactgctatgacagtgatgggcccagccccttggctcctaccacctcaaggaggggttcagaagaagctgctggtgtgagtgaaagctcaagctgggagtcaggttggcctccccctgggtacccacagggctgtaggtgggcacagcagaaggggagaaccatctaaggttgacagtcctatgggtgtgttggtgggggaggaaggaagagaaggaaaaaacacagtgggcaggaaaggagacgaggggcgcttccatgggctgagctcctactttgtgccagacacatgcaaggtcttttacatacattatttcatttaatcttctagattctatgagaaaaatatgaggatactctaatgctacggcacagagacaaataggggtccagggcttgaacttggtgccttctttttccctgcctttggctacctccccaaatgtcaggatgggacctcatgggatggagagactgctcagtctgagagctggggaggctccttggaggtggttctgttggagctgggccaggaaggtggggtgacaggaaggggcattctaagagccctgctaagagccacccagcgacttacctgagctggcttagttctaggcagagggaaggggcatgagcaaagacagattatctgggaaaatgatgcttttttattttctttttgcttctccccttctcttttgaaaagcacgatgctttgaggggagagcagacagaccagtttgtctcagagaacaggtctgtggagatgagaaggaggtcaaagactcagggggaacgtagggacctcaaaacccaagtccagcagaggactttatcctgaggacagaggggacccggggtgcattttaagggaaagtgcagggccagagttgggggtggaatatgcgaggcctgagtccccaagagagaaggctgctgaggccttggcatggcctgggagaggggtagagagcaggtgggggccgtgggggcagggctggggaggaggcagggcaggaggaggtggcccgcccagggacggtggctctgggcagtgtcagatgtggggaggaggcactccctcaggcctaatctcatcaggaagaaagaggccttgtcttggtttgctctctgactcaatctgtacttcctgtgggcctgcagagatgcatctgtgctggaccagaaggatgggcggcgcgggggcggggaaggcggaaacctgaggacgggactctttgcatttgctgtttgcatttgccggctgcagacggcttctgcctcgctggtgatggtcaagccccaaaggagggtccctggatggctgcgctctgcttccctgcctgggctgtgctgatggagaaaaagcaaagggcttcttcccccacccctccaccccgtcccaggtccctcagcactagggcagggtggggccttctggcctccacctaggagaacccagcccggagagatgcacaaatgcactctcttggattctttttgatcagtaggaattgtcagctagccttctgcatgtgtgtgtctgtttccccatcatcatggtttgcaccaggggttggaactctcacgagccacttggcccctgggaggctgcttcatgctttctggtttgggatttttacttagatacccaaaatgctggcctcccagcatatacctgttgtgtgttaaatcacatctcagtgtcttgtacacattgggaccacaacaatcttactagccaacgtcttttgaacactaagtatgcaccaagcatcactctgcatgctgtgtgtatcaccttatgtaagtgtccaggaacccctgcgagagagtgtggacctgtgactgaacagcctggcttcagattccagcccagccactaactagctatgtgatcttaggcaagttatataacctctctgtgccctgtttccttatcttaaaaatggggctatgacagtacttgcatgagggttgagttggtatgtggaacatacttaacacctagtcagtaatataggcgttagctagtatgtgtatttgtagtgcctgattttcctggtgaggaaatagacacattaagtaacttgcccagagtggcagataggaaatgatagggtggtgctgtccatcagaactttgttcagagatgggcatgttgtttaattacactgttcattgggtgttgcttgtatggtttcatctgtgattatgaagcacatgtggcttttgagctcttgaaatgttgctagtgtgactaaggagctggattttacactttatttaattttaactttaatttagaagccttgtgggactagaggttctgtgttggacagggccgtttagagccaagattagacccctgacagtcaagctccggggcctgggccacctctgtgctctcctgcttctttcttgcttaaatcttttacaatggaaatttaaagacacatacaaaattaaaggaaagattcaaatgaatcctcttgtaccctcacccactttcagtagccatcagcagcctgtttcatctctacgcactcattccctcctcctctgtccaacaaccgcaagttattttaagataaatcccagatgttatatcatttcatctgtgaatattaggcatccgtctctaaaagataaagactcttgtctaatataagcacagtattattaccacacctaatgacaacaattctttaatactgtcaggtgcccactcagctttccctgattgcttcctgatgcctttttgcaattggtttgtgtgaatccggatccacacaggatccacacattgcacttcttgctgtgcctctgatctcttaagtctcttctgaactgtaatgacccttgtccctttttccttgtcatcttaaagaaaccggatcttttaaaaaatatatgtatatttcattgtactaaaatacacataacatagtatttgccatctaaatcattcttaagtgtacagttcagtggtattaagtacgctcatactgccgtgcagccatcaccaccatccatctctagaactctttatcttgcaaaactgaaactctatatccattaaacaataacttttcattcctccctaccctcagcccctggcagccaccattctactttctgtccctgtgattttgcctactcaaagtaactcatataagtggaatcatgcgctgtctttttgtaactggcttgtttcacttagcataatgccctcaaagttcatccatgttacagcatgtctcaagactttcttcctttttcttttctttcttttttttttttttttgagacaggatcttgctttatcacccagactggagtacagtggtataatcatagcttactgcagcctctaactcctgagctcaagtgatcctcccaccttgacctcccgagtagctgggactacaggtgtgtgccaccatgcccagctaattttttttttatttctagcagagatgaggtcttgctgtgtcacccaggctggtcttgaactccagaacccaagcgatccacctcatcctcccaaagtagagttttcttccttttgaaggttgaatattattccatggtttgaatataccacattttactgatccgttcatctgtgaacggacacttgggttgattccacatttaagctattgggaataatgctgctatgaacatgagtgtgcaaatatctcttctagaccctgctttcatttctttaagggtgtatattccagaagtggagttgctgaatcgtatgatcgttctatttttaaatttttgatgaactgccgtactatctttcatagcaactaaacccttttgcattcctaccaacagtgcactaaatcagattgtttcaaatcaaattgtttgcttgcttgttgttgagttgtcagagttctttatatattctcaacattaacaccttatcatatggatttgcaaatatttcctctcattccatatgttgccttttcactctgttgctagtatccttaaatacacacaagtttttaatttccatgaatacaatttgtctattttttttcttttgttgcctgttcctggtatcataaccaaggaatcattgccaagcccaatgttgtgaagattttgctcttcgttttcttctaaggttttttatagatttagctcttctatttaggtctttgttgcattttgagttaatgttagaaaccagaaaacttagcatgtaggatgtcctgtgtttttttcctgattgtatctgtgtggctgttaacatgtttctccatactctgtgtgcacagttacatacaaagactcggtcaacagtgggtttcattttttggcaaggccactttataagtagtgtttcctgttgcttcatgttagcagcacataatgtctggttatctcttttagtgatgctaagattgggcagtgggttcaggtattgccaacccatccattacaccactgagtctcaaacttgaacctggggggctggttaaagcagagtggtgagccccacccccagaatacctgattcagtaggtctggggaaggaggcttgagaatttgcaaataaaaagttccctagtgatatggttaatgggggactgcactttgagaactactgcatcacatccattatgtgtttctgttatccttgctcctaacatgcgctggaatcacatgcactggaagcttaagcagtgctggcatctgggtcccccacccagtaatctgatttaagtgattctaatgtgcaaagttgcaagccactgccctgcatgttagcagtccctcgaggtcacaccatctcatctctttctgctcttggtcatttccctgagaggtatgaacatgtggagagcagtgactgaattattcatctctgacccctccgagccctgctcctgacacggcttggcgcagaataagcaccaagtcaatatcagatgaagattggagattgaatgaaatcctcttcacctctctctataaagcttcctggattattctgctttgaaatttctattctatggttcggtatgttgggctctttaagaaatggattctagagcctcctctctcgcagacaacttgacaaagtcagggctaccaggaatttacaatagaattgttacgtgtaagccaggcacggtggctcacgcctgtcatcccagcactttgagaggctgaggtgtgaggatcgcctgaggccaggtgttcaagaccagcctggcaacagagtgaaaccctgtctttacaaaaaaattagccaagcacggtggtacatgcttgttcttagctatgcaggaggctgaagccagaggattgcgcaagcccaggaggttgaggctgcagagagcactgatcacgcctctgcactccagcctgggtagcaaagtgaggccctatctcaaaaaaaaaagaattgttacacctagaccctggtggtggtggtagtggtgggagagtgaccaacttatccctgtttgcctaagtaagacttcccccagtttagcgctgtaagtcctgcctccctggaacccctccacaatccgaggcaaaccaagacagttagttgccctacttctgtggagagcggcaaggaccctttttgctttgaaggagggaggaaaaattaccctgtggggtgagactgttaggtcctagcacactggatcccactgtatcacttcagaccttgttgctggccggtgcaaggcaaaagttaagacacctcgtgccaagaggtggtggtttaaaccagggtctggccttagattcacagagcccagttgtgataaaacccttacagaggagaagtagctgagccttgtatttttttcttcctgcctggtgagaaaggaagatgctgtgggaaatggttacccagaggcctaggttggcagcagggtggccttatcctccatgggctttgatttcagagccagatatcccactcgcaatgggtggatcagagaccccataaggattctggatgactgaaaagagctttcccagcaagtttagggccaaggccaggatcaagataaactgtgatggataatagtgggtcagggattggagtccaggtgagggacccacccatgatgagacgtgtattgtgtgaattctcagcctttgtagagcaccttcacatagagcgttctttatcctgattaacagtaacctcttttcggtttttgaaataactgggtaacttgtggttctaatcttccctaactgtggctgtgacataagtgtggtggttcagaccctctcaccaggcacttacaggtggcagctcactgtgcccacaagtcaaattttaagagagagaacagataaaacttcaaatattatatgtgaaaccacaaatttacgaaggggcactggtagccagcaatgcctacccatcctgttcaaagaccaaatcaggtcatttcattctttccttaaagccacaaacagtacaattaatgaataatctattataatggtttgcaccacgcccagtttgggttcagtttcagccaccctgcagctaacccttgtcctgcaatgagtttagggctgggtaaagaagaggggcctttggaacaggcaggaaactctctctgtctctttctctctctctctctctctctctctctctctctcacacacacacatacacacacacacacacaccccgcatgtatgtcaagaaaggagcatattgcatagcaggaagaggggtctctcaactagtcctcagactacttcccacctgcactgctcatcataacatgacttcagtctagtcacttcccttgcaccccagttttcccatcatcaaatgggggaaaataatccccacctaccttgcaggagagttgtgagccactgtcaggtgttaagaaataaactcaaggccgggcacaatggcttacgcctgtaatctcagcacttagggaggccaaggtaggcggatcacctgaggtcaggagtttgtgaccagcctgggcaacttggcaaaaccctgtctctactaaaaatacaaaaattagtggggcacagtggcatgcgcctgttatcccagctactctggaggctgaggcaggagaatcgcttgaacccaggaggcagaggttgcagtgagctgagatagcaccactgcacactccagcctgggcaacagagcgagactccgtctcaaagaaaaaaaaagaaataaactcagtgcgatgcaaaacccagagatgactacatcctttctgggagttgggaattcacaggccccggagcctaatcccatggcatcaggcccaccaagcctgcatgggatcacagcagcagaatggatgccacctcccgccttgtgcccagcaggctgtcccagagtgccacacctgagaatgcctgttgtggctttgatgtgggcccagccagatggaatggggcaggataagatgagtggcctgggatagacctggctcgaatcggctgttctggcccagcctgtaggcgaagggcccgctacagtactcacttgtgggcaagtgcctgcttgtagggaaaatgaactcctgttctctgaattactgagtcattaaagtcatgcatgcacggatacacgcatgcgctcatgcatgtgtatatacacagcctcagttaaacatccaaagggatgcacacgtgcatgcacacccacaaaacgacacaggcgctcatgaacttcctgatgaatgcagttcttgtgcacacacagtacgcacacaggccagcacgcatgcacaagcttcacccatgcatatacacatacacttccatgccacatacaaagggagaggtagctggccttgctagcggctgccccaccccctacttgtgaagtttcccttcatgacagcaggtctggaagaatcttagcagtgcaaataagagttagggtggggagaggattgggggacggacagaagggcactgatgttcacgctcttttgctgtcagctggcttcatccgtggggaagtggggagcctttccagagggttctagctagcttcctgggcctcattttccttctctgtagagtggaagtgatcatgatcatgacagttcctcttagggacagaggtgagatccagggctgtgatgggtctgaaagagctattgtcatcatgggtattgtctgtgaggacctggagctgcaggctcaaaagctgcaggcttgagacagctgagtgcagcccccaggcctgctgttcactagctgtgtgacccggttactggcctgaacacctacatctgaacgggggagcaaggtagcacccacttgctctattcatgcatggaaagcatttggaatggcgcctggcagcttgtaagcactcaaaaaccatgacttcttattgccacagaggtgactgtgagctccaggggaggtgttgcccaggcctctcacggcctcctcactcctcctggatggagagtggctctcaggagttgggccagaccccaggtaccccctacaggtgcacagacaggctgtggagggagacagctcagagggtccggaaggggccagggctgttgttaatgtaagctcatgtcgatttcagcgactaccccaggcccgccacatgcactcaggcaccacatttggttgatcccacctccttggtatttcagtaacatcctctccccaccatcccgtccacttcactgccctactccagcccgggtgaccattgcctcttacctgctctatcctttcctctgctcaggaatcagaggaaaacctgaaaattaaatctggtcctctatctcccctgctttatttattagaattattattaattatttttgagacagattatcactctgttccctaggatggagtgcagtggtgcgatcttggctcgctgcaacctccgcattcccggttcaagtgattctcctgcctcagcctccagagtggctgggactacaggcgcgcgccaccacacccggctaatttttgtattttcagtagagacggggtttcaccatgttggccaggctggtctcgaactcctgacctcaagtgatccccccacctcagcctcccaaagtgctgggattacaggtgtgagccaccgtgcccagcttctcccctcctttaatttctccagtagctccccactgccctcagagtccgggtatctgagatgatctgggtcctgcctcctcctctgtggccacaccaagcacaggcagccacttgccatctccatgggccggacttgcataggctgtatgaatcaggatgggtcgctgtcctccatgacaaataaccccttatctcatggttcactctacaagtgtatttctctgttgcactgtatgtcagtagaagaaagtgctctgctacacatggttcctgagggaccaactaccttatagatgcaccatctgaaacatgcacccttctcatccctttggccaaggacgagagtcctagagggtcacaggcaggtctcatgtgctttggcctggaagtgacacacatcactgcctcccatgatccactggctaacgggtcataggaggcagtgatgtgtgctatggctgcctgactggaaggggcctggacatgaggggagcaatgggacgtctggtgagcatcaccagctgccacagacaggtgcactcccgccacccccagcagttgctcaaggtgagggaggagtgggggggcctggagcggagcctgctgatttgctccttgctttcccacccgagcccaggcccaaggtggctcctccactgccaccaagttgccaagaccctagggaggtcatttgtccttgttgtttctttccaaggggacccccagtacccatttctctcaaaactcactatagagaaaagatgtgctgctccttagcaacttgtggcttttatcttatagacaccaaataaatccctttctgattctcttttccttgttgaattggccactaggaagctcagacccaaatctgaggtctacctcctctgtgtggtggacctggccgcacacctagcttaactcctcctgcgtttcaggtgatctctttttacctgcattttccttgtgtccctattttttctcttgtagctttttcatttccttctatcttgtgttctatttttgtgagtcttcttaaatcctttctggaatcacatgggcattaattagtcagtccatccctacattctgtgcagcttcctgtagctctggcaaatgcagccagggtttagggcaaagctcccgaaaggagagttggaatttctgagctttatgggatacacaagcccctgcaagactgacgtgctacctggtgctgtctaaagggcttgcctcaggggtcaggcccttatcgctatgacttgcctgaggtcacacagtgtaatctcgttctgaggaattgagcacagagaagagcctcatgggtcagccgtgtgggctgggtgagcatcttctttatcttgaccagcgtaggcccagccaaacctgccttcccctaagtggggaaggtgggggcccaagggggatagacactgtgctggacactcctggagcagagccttctctgaggaagctccaagccagcagagaaaatgagaactgaccctgaaccccaaatcagggtagacagtgtcaagggctaaaggcaaggggagaggtggctgtcagggaacagaggagagcgagatctctgctacttgggatatcaaggaggactctctggaggaagtggcttgggagctagggaaggggcggatttggatttgtggagatgggaacaggaggtgggggcatgggaatggcaagccaagcagaaggagagggacgggcaaagagccagagggctggagatgcaagagcaggtgctggggaagctggaaggtgccgtttagatgagctagaagaaaagaatcttggaatatggaatgagacccagccagaggccttgaatgccaagccaaaggatttggccttgatcctgtagggcagcaatgaatgggcagcatcagagggtgatgtgaggccaggggcagtggctcacgcctttaatcccaacctttgagaggcagctacaggagaattgcttgagatcaggaggttgagaccagcctgggcaacatggcaagaaaaaaaatttttttaattagccaggtatggtggcatgtacctgtagtcctagctacttggaaggctgaggcaggaggatccttgaggtcaggagtttgaggctgcagcgagctatgatcacaccactgcactccagcctgggtgacagagcgagatccttcctcaaaaataataataaataaagggtgatatgaggtgggggtggggtggtgagggcttggtattcagaagggtccgtctggccaagaggaggccccctggtattatgggtatgggtttggccatgaaagaggcctagaccctctcacaggccacttgtgatctggctctcctcgcccctctggcttgtattctcttcattcacgttacccaatatacatggtgtgtgtgtgtgtgtgtgtgtgttttcttctttttaatttctctttgataatcttactaaaccacatgtggttcccccaaactgttctatctgcctaagacaccttcccccagctctccctcatcctgcctacatgaccaactcctactcatcctccaagtcactgtttagttgtcacttcctttgagaagccctccctgactgtcatgtgcgaatctctgttattacccatagtacagtcggtcccagtggcccagactctcctagtagcctcacccagaggactcttcactcctgtaaaggctgggctcaggcctactgtttccaaactccctggtacctggcacagggcctagacacacagtgatgctcggtaaatattgagtgaacaaatataaggctggacgaggagcaaagcaagctgaagatgcccagatgatactagtggctgtgattgccactgttgatcaagtatctgccatgcaccaaggggtctaaatacatcatctaacttaatccttatgacaaggctatgaggcagatacttttttcaatctctctctcttttattttttttttagagacagggtctcactgtgttgcccaggctacatttgaactcctgggctcaatcagtcctcctgccttggcctcccaaaatgctgggattacaggcatgagctgccatgcctagctgagatggatacttgtgttacctcattttacagatggagaaactgagactccagaggttaagtcacttgccatccagctgataagagacagagctgggattgaaacccaggcaggctggctccagacagcacattggtacctacttagtcgggctgagggtactgggctgtctggtgaaacagcagatgggggtcaatgtggtggattctctctatggttcttctgccttgttatattcacactcaaagggatgaaaagccttaacacatcagcaagcaggtcagtaatagctatgcttcatcccatcttatcttaccaggtctacagaagtaactgtaattagagtcttttcacttgtttgcccttcacagtgcatcaccgtccacgttgaactgaccactgtcctgctcgtaccctcttatgtactcttaagatgagagctctgtgtgtcccatgatcagggcagtgagcctcataccctttgtcccatttgtctcctgcagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccaggtaaggacacccccaggcccaaacagctctctggaggcagggcaggacagagggaaagtggaaagagcctgggtttctagaaagtcctagccctgcccattactagctgtgtgaccttgagtaagtcatttcatctctttgagccttggtttcctcactgggaaaaatacacctgtcctgaattttagcctctagcagttggcttagctactcgtagcacctctcctcttctctgcaatataattctgcgaatttatttcctcctgaataaaatataattttttaatgctttactgggattacaggaaattgggaaagtctccaaagccaccttccccaccaaaaaaagggaaacaaacattgagtcaaaactagctaggagaggcaaacagtaagcaagcaggaagaacaggcttttgtccttagtgcaagtgttgctagcgtaggttggaccatataaaattgtggatattcaactggtttgaccccaaaaaagcaacattttcacatagatcaacctaatagtagttccattcaggatgccaaccctgagtctctaccttaaggcagaacacctgaaggggctagagggatcccaggttagtagtgccactggctcacagcagaaactgacatgaagcctctccagaggaaagcatccacaatgtggacaggatccccacagattaaacatagagaaatatgaatccacaaagatcacaaagcatgtacaccaccatgagtgagagtcagctgaaacacaaatagcagacttagacccccagaggacttcagaagttaaaagatcacgcagattagaatctcatagaccaggtttcctgaacacaatgcaattgagttagaaatcaataacaaaagataaatcttaaattcccattcatttggaaacttaaaaactatttctaaataatttataggccataaacaaaatcaaaatggaaatttaaaaatccttggaattgataaaatgaaatatatcacaaaacttacgagatgtagggaaagtggggcttcaagggaaatctatagcactaatgcttatattagaaaagaaggaagcctaaaaattaatgattaaacattccatctaagaagttagagccgggtacagtggctcacacctgtaatcccagcactttggaaggccaaggccagaggattacttaagcccaagagtttgagaccagcctgggcaacatggtgaaaccccatctgtacaaaaaatacaaaaattaactgggcatgagggcatttgcctgtggtcctagctacttaggaggctgaggtcagattacctgagcccagggaagttgtgagccatgctttcaacactgtactccagcctgggcaacagagtgagaccctgtctcaaaaaaaaaaaaaaaaaaattcaaacaaagagcagcagaataaacccaaagaaagtttgaggaaggagataataaaaagcaaaaatcaatgaaagagaatataaggatacattagagaagataaaagggccaaaagtttgtttttagaaaagggtgatagacaagcccctgcagagactggccaacaataaaagagaaagggtacaaaaagcatcaggaatgagaaaaacaatatcacagcagagctttgaaatctaataagaactaatacaagcaactgtatgccaataaatttgagaacattaacaatatgggcaaactccttaaaaaatataacttgtcaatactgatttatgtagaaatagaaagcctgaatagttctttaaaggaatagtcctttatgtactttaaaaattgaacaataggccaggcgtggtggctcatgcctttaatcccagcacattgggaggctgaggtgggtggatcatgaggtcaggagttcgagaccagcctaaccaacatggtgaaaccccgtctctactaaaaatacaaaaattagccaggcacagtggcgggcacctgtaatcccagctactcgggaggctgaggcaggagaattgcttgaacgcaggaggcagaggttgcagtgagctgagatcatgccactgcactctagcctgggtgacagagccagactccatctcaaaaaaaaaaaaaaaaaaaaaattgagcaataaaaatttcccttaaagaaaatagcaaaaggaaaggcgagctatagagtggaaaaggatataataaacatgacaaaagactcatttcttgaatgtataaaatgtaccgaaaaatccacaaaacactgaaccagcacttcatagcaaagaaaatccaaatggctaataagcatttgaaaaactactcaacctcattagtaaaccagtgcaataccactacacatcagattgtcaaaaatgtctaacactagtaaatgacagcaagtatacagagttgtgtaaacgatcagacacttctgatgggagtgtaaactggcacacctgttttggaaagaagaagaaaatgcatatacctgtgacccagaaataccaaccataggtttataccacgcagtgttcaccactggtgctctgtccaccagaacagaagcataagaatgtgcatagtagcattgtttgtattattgcaaaactgggaaaacctgtatgtccaagaacttcataaataaattatggcatatccatacaagtgaatgtacaaaaccacaaaaaggaataaagtgtagttatatacaacaacatggttgagtcagaaagataaagttgagtgaaataagccaaacaaattttaaactatatcatttaattaaccttaaattaaaaacagcctacactaaaccatactttaacagttgcataattacatagtgaaattttaaagaaaaacaaagaagagactaccatgaaaaacagaatagcagttacccctgggggatggagagggttacgactggaaagcatctcgtgggagacctcctatgtgctagtaatggttcatgtcttggcttgggagggtagcaattatgggtaatttattttccagtaatttgttaagctgataattttcattctttacactttttgcatgtttcttatattttacatacatatatttaaaatatatatatatatatgtatttgtgtgtatatatatatatatatatatatatatatatatatatatacacaaacacataagaaagactctaggcctagatggttttacaggtaattcctacaaaactttcaaggaacagattctaatcttttacaaacatttccacaaataaaaaagatgaacaacttctttcctcattctgtgaggccactgtaaccttgataccaaaaccagacaaggaggacagaataagaaagaaaaaaatattgatcaatctcactcatgaagatggatgccaaattactagcaaattacagtaaataaaagatacattctgaccaagttggatttattccagaaactaaaggtgatttaatattagtaaatctataaaggtaaatcatcatattagcaagtgaaagaggaaaaaccatatgatcatgtccatagatggagaaaaagtgtttgataaagcccaatacccagccatgagaaaaactcagcagcaacaaaaagaaaattagcaaatgaaggataagggagaatttcactgacctatagtaaacagcattttaaaacctttttatcttgaagcaatttcaagcctacagaagatttgcaaataaaactgaactaattcctgattaaccttcacctggtttaccggttttaacattttgcctctcggggtgtgtgtgtgagtgtgtgtgtgtgtgtgtgtgtgtgtgtgtgtgtgtgtgtgtgtttggaaacagagaagttacagacatatagcctgggcagtatagcaagaccccatctcttaaaaaattgctttttagttagctgggcacagtggtacacacctgtagtcccagctacacgagaggctgaagcaggagaattgcttgaggccacgaatttgaggttgcagtagctatgaaagcaccactgcactccagcctgggtgacagaataagaccccatctcttaaaaaaaaaaaaaaaaagttatcagccggatgcgctggcttacgcctgtaatcccagcaccttggcaggcccagacgggcagatcacttgaagtcaggagttcgacatcagcctggccaacatggtgaaactccgtctctactaaaaacacaaaaaattagccaggtgtggtagcgggtgcctgtaatcccagctactcaggagtctgaggcaggagaatcacttgaacccgggaggcaggggttgcaatgagctgagatcgtgccactgcactccagcctgggtgacagagcaaaactccgtctcaaaataacaaaaaaagagaaaaagttatagagatgaccctttacccccaaatactgtacttcggtctgtatcttctaagaacgagaatattctcttatataaccacatcctagaaatttaacattgattcaatgctaattataatatacaacccaaattcaaattacatcagttgtcccaatgatgacctttataatagcttttttttctgatctagaatccaattcaggaccacacattagttgtcatctcttagtcttcatcacttcatgatattaacatttttcaggagtaaaggtcagttgttcagtagaatgtttctaaatttggacttaccaaattgtttcctcattattagaatcatttatgtatttttggcaagaatattgcatgagtggtggtatatcatttttaggtcattacatcatgggacacatgatgtcagtttgtcacattattcatgctattaacttgacttatttgttaaatagtgcaaatatcattcataaaggggaaatgttagaagcatctacaggccaggcagggtggctcacacctatgggcccagcactttgagaggccaagatgggtggatctcttgagcccaggagttcgagaccagcaacatagagaaaccccatctctacaaaaaatgcaaaaattaaccaggcatagtggagcatgcctgtagtcccagctactcagaaggctgaggcaggaggctgccttgagcccaggagttcaaggctgctatgagccatgaacgtgccactgcactccagcctaggtgacaaagcgacaccctgtctcaaaataaataaaataaaataaaatcaggaataagataaaaggtcatggcctgcacagtaagactagaaaaatgtaacttgtcaataccaattcaagtagaaacagaaagcctgaatagtcctctaactactaaacattgagcaataaaaatgtcccttaaagaaaaaacaaaaaaaaaaaacagcaaaagaggccgggtgcagtggctcatgcctgtaatctcagcactttgggaggccaaggcaggtggatcatctgaggtcaggagtttgagagcagcctggccaacatggtgaaaccccatctctactaaaaatacaaaaattagccgggcatggtggcgcgcgcctgtggtcccagctacatgggaggctgaggcaggagaatggcgtgaacccgggaggcagagcttgcagtgagtcgagatcgcgccactgtactccagcctgggcgacagagcgaaactccgtctcaaaaaaaaaaaaaaaaaaaattagccgggcatggtggtgcatgcctgtaaccccagaggcaggagaattgcttggacccaggaggcggaggttgcagtgagccgagatggcgccattgcactccagcctgggtgacagagcaaaattccgtctcaaaaaaagaaaaatagcgaaagaaaagttgaaagtgttaggatggaaaaggaagaaataaaactgctattatttacatatataattgtctacatagaacccaaaagaacatgtagtcaaattattagaaaaataagagtatttggaaggtagtggatacaagaatcagaacacaaaaatgaattgcatttgtacatactgggaatatttagatgatataattaaacatttgcaatagaataaaagaagattggatacctaggaataaacaagcaacgcttagaaggaaaatgatagaacattgttaaaagactaataaagatgacctcaatagatggaaatatttactatattcatggatagacacttttacttcctccctcaaattcccacagcattctctttttttaggacatattccaagcctattttttccttagaaccatgccctgactactttgaattagagtcctttgtgcttttctgctagtacctcctaatgtagttgggtgcataattgttgctcataaattttcattaactccacaaattatctcatggttgttcatccaaataaatagggagggcataaatggcaaagggaagggcacaagcaaaggcatggaggtgcaactgtatatagaatgttcaggaagcaatgcagagagcagctgtctggccagaacaaataatctgtgaaggagaagaagggaagtaccctaaggaagtggactggggctagctgagcagagccttgaatgctggggtgaggcatgtgacctgtatcctaaagagagagagaatgtttcgagctagggagggacaagtgcaaaatggaatttgtagaaagacataaaaaggtcaaaatgggaaggaccccctatagatggccgattttgctacttgtttcttccaagctttgcatgcttgtaaaagattacgtccaccaaacaaactgcattcttaattaattcaataattagttggttttccttttattactcaaactctcagaactgtcactgtttctaacttgcatgaactgctcggtgtaaatgggtactaacaactgatataaagaaaataaattggtgtgatgtgatagagtgtgacgtggtttgggagaggggacctagtttaggcaggatggtctgggaaggcattcctgggaaggtgatctttgagccgagagccacttgaggctctaaagggagagtatgctggcagaacaaatagaacatgcaaacattcccctgagtgggaatgggtttggtgtgtctgtgcattgtcagcacgtggacacatgtgctgtgaccacagagtggtgggaggaggtgaggtcagattggggagtagggcctggactgtgaaggcgtcgtaagcccaggcaggagtctgggctctatcctgagtccagtgggaagccactggagggttgaaactcacttgtcagccaggcgctgtggctaacacctgcaatctcagcactttgggaagccgaggcaggcagatcacgaggtcaggagtttgagaccagcctggccaacatggtgaaaccctgtctctactaaaaatatgaaaaattagttgggcgtggtggcagccacctgtaaccccaactattcgggaggctgaggcaggagaactgcttgaacccaggaggtggaggttgcagtgagtcaagatcgcgccactgcactccatccagcccaggcaacagtgcgagactctctcaaaaaaaaaaaagaaagagaaaaagaaactcacttgtcctacacagcctgatcctagataaaatgtgtgattctctttgggctttttgaaatataataaatagctcaaagatacatgttaattgctatcatcacagactcctaggaatccagatccaacaggagctgtgatacagtttggatgcttgtcccctccaattttcatgtggaaatgtgatccccagtgttggaggtggggcctcatgggaggtgtttgggtcatgggggcagctcatgaatggcttgatgccctccctgtgataatgagttcacctgagatctgattgttgaaaacagtctgggacacctccccgtggcctgcggcacacctgatcccccctacactgtctgcatgattggaagctcccctgcagtccttaccagaagcagatgctggtgccaggcttcttttgcctcctgcagaactgtgagccaaacaaacgtcttttctttgtaaatacccagcctcacatattcctatatagcaatgcaaaatggactaacacacccaggagccactgatcagagcttctcatactttagtgttacaacacagattctgatgtagtgggtctgaagtggggccagggaatctgcatctccaacaagctcccagagatgcctgataaaatacaggatgcccagtttaatttgactttcagataaacaacaaatcgttatttttgcttttttctttttaattaaaagttttattttgacatcatagtagattcacaagcagttataagaaatagtacagtgcaattctgtgtatcctttaccctgtttcttccagtggtaacatcttataagactacagtacgcagtacagcatactgttgtgatactggcatcactacagtcaagatacagaacattccatcatcacaaagatctgttcccctccacccccattccctccttaaccccagatgacaattaacctgctctccatttctatacttttcccgttttaggaatgttacataaatggaatcatacaatatgtaaccttttcagcttggctttttttactcactgtatttctctcgcagttcagctgggttgttgcatatattgagtattgatcatttttttttgtgttttgtgtgtgtgtgttttgttttttttgtttgtttgttttgttttgttttgtttgagacaagctctggctctttcacccaggctggaatgcagtggcatgatcatatctcactgcagccctgaagcctccacttcctgggctcaagcaatcctcttacgtcagcctcctgaatagctgggactacaggtgcatgccatcacacccagctaatttttgtatattttttatgtagaggtgaggttttgctatgttgctcaggttggtcttgaacccctgggcttaagtgatccacccaccccaaacttctggaattacaggtatgagccactgcacctggcctcaattatgtgttccttctttctttttttaaatttttatttatttatttatcttattttttttttttttttgagatggagtctcgctctgtcgcccaggctggagtgcaatggcatgatattggctcactgaagcctccgcctcctgggttcaagcaactctcctgcctcagcctcccaagtaactgggactacaggcacatgccaccacacctggctagtttttatattttcagtagagatggggttttgctatgttggccaggctggtctcaaactcctgacctcagttaatctgcctgcctcagcctcccaaagagctgggattacaggcatgaaccaccttgcctggcctctttttttttttctttttttttttaatagaggcgaggtctcatgatgttgcccaggctggtctcaaactcctgagctcaagtgatcctcttgcctcagcctcccaaagtgccaggattacaggcatgagccaccactcctgcctctgtgtcctttcttactgctgaatagtattctatggtatggatgcactacagtttatataaccattcactcactgaaagccagtgggttgtttcgagtttggggctattacagattaagctgttacaaacatttgtgttcatatttttgggtgaatataagtaagtctccatttctctggcataaagggccaggagtgcggttgctgagtcataaggtagttgcatgtttagccttataagaaactgtcactttatttttacaaatttttagtgtaagtaaaatattgcatggaacctccttatgctaaaatattcgttgtttatctgcaatttgaattttactgggcatcctgtattttacttgctaaatctgacttccctcctcccaggtgataccgatctacttgtttgccaattgcattttcaatagcaaggctctaatctagctcaggttcataattatggaaaaatctcaagcacaaaagtagataaaaataatatgatgaactttcctcagcccagattctagaattatcaagtttgccctcttgcttcactcatcccttttacctgaagtattttaaagcaaatcctagacattttgtcatttcaacctctgccccccgccccctaccacatgtcagtatgcaattctaaaaccagggacattttctgacataaccataatgccaggatcacattaataataactcttgtgtcacctgattcctaattcatgttaatggtccctggttgcctcatacatgccactttgcttgtggtttgtttgcctcaaagtccagatggggtccacatcttgcatttgattgatgtttctttttaattttttcttattgtaagtagagatggggtctcactatgttgcccaggctggtctcaaactcttgggctcaagggatcctcctgcctcagccccccaaagtgctgggataacaggcatgagccaccacacctggccaatatgtttcttattaagtaaccacatccattactactgtgcaggcaccatgccatagcacttacctgcacagacaggccttagaggctctttattatgttgtaaccagggttggagtgattatgctgataccttatgaacattagccccatttataggggatcttgccccattgcacagatgaggtcgctgaggctcaggaagatgacttcccagaggaccctgtgcagtgtgtccaggacccgaatgggagcccagacctgggtgtggcctcgggccttgctctcacttcactgacatgaggcccctgaggtttggcactgatttgcatcagctcctacttgttaccaggattacgttctgtgccaggcacagagatgtatcagtaggtgagtgatgtgagaacaaggaagggacaagctagctaatgatttaattaagtacataaattgcattgagattgggagatgtctggccttgccacagcgtgcaggaagtccttctcagaggggccgggctgccccaggcagtttcagatgtcccaaagggagtgacactgcaggcagggtccctccctcttgcctgttgtgacccagggtgagctggttagagggaggctggaggtgagtttcgcaacctgcagccttggcaaccagggactgtactcagggaacaaaggcagcaggggaaggctggggagaggccaggactgtgctcctgagcctggggcccagcctgccacagagtcactccagggagggggtgaagaaggtggactttgctgtgaggtgtggagggtggggaggaatgaaagcaagggcaggcagagcccctgggggtcagccctggaaccctgctgggagtagacaggccagaggggacatgggcctgagggcctaatggacaccgtggctttcaggtgcctgggagagtggagaggagcatttcactgccatgatcttaaaggccagccttagccagcatggtggctcacacctgtaatcctggcactttgggaggccaaggcaggagatcacttgaggtcaggcattcgagactagcctggccaacataccaaaaccctgtctctaccaaaaataaaaaatcagctgggcgtggtggcacatgcctgtagtcccagctacttgggaggctgaggcaggagaatcacttgaacccgggagacagaggttgcagtaaaccaagatcgcaccattgcactccagcctgggcgacagagcaatactctgtctcaaaaaacaaacaaacaaaaaaccaaggccaacctgacccttctcaagccgatgtgtgtccacatcactccgctgctcagatgcctcccaggactccttgctgcctgcagataatgttctgcctctctcatcaaagccctctatgccctgtcctagccaactgtttggaacctcagagccttccatagcacatatctgttccctccatacaaattgcccttctagaaaggcagggtatgggctagtctggcattttggaagtctcttccagttctaggggtttgttcatcctggacaagaacatactcaaggaatgggtcctctgtcttcaaatatccaaggagttggcctgccacagagggcccagatgtgtctataggtccccaaaggacaacgccaggaccagaagtgggaagtgaggggaagcaggggccacctggaggccacactgggctcgaagtaggaaacattttctccaaattcacaaggtctgaaagtaggatgaattacctcaggaggaagtgagctccctgtccccacaggtgaccaagtggggacaccagctgtggttcaccgctttcatccctggatgttggattctacagtaaaccctccaaaggctcatctgggtgctcataaggagaggggtgatgaaggatgctctgccctaaatcatgggaatgtgctgtgcattttagaagtgctgccattcctagggtcaagaaatgctcctctcatctctccctctgctcaatcccagcctcctctgggcggtccctggtcccacatctcaccctctccagtcaggacatggctcacctatccatttgtccacctctctattgggtccagccttgcaccctgggcagggtgagtagactccatgccctcagcctcacccctcttgctcagcctcctctcttgccctgtcctccagcctaccgtgcccgctggctgcttcagcctcctcccacttaaaacctacctgtggccctgcctttctgacttgagattcctcccctccacctgacctggtcaaagtctccctctctttaaggcccaatttaaagtcctcctcctccagggagccttctctggttcatcccccaggtctcttgtgtgcctctcctctgagctcaaagtatattccttcctgcctcctccataaggtagatggctcctatagcccaggattgtgagtaccgcatctctgccatcacctgcatgcagtctggcacatagtatgtcctcagtgaaaggcctgtatgatgatgatgataaccatggtgtgaggacagcaagagcagaccaggccataagaggaaacattcccaatcctggctctgctgtccttagtacatgattgtcaacctctctgagccccagcctctgcacttgtaaatggggaattcttgtactatgtcctggggtggttgggaggtaaatcaaatattatgagcaacgcagctggcactgggcctggcacatatatgactccctagattatggtttctaaagaaaagctttttttttttttttcttcgaaacaggatctcactctgttgcccaggctggagtgtagtggcacgatcatggctcactgtaggctggacctcccaggctcaagtgatcctcctgcctcagcctcccgagtagctgggaccacaggtgtgcatccctacaccggactaatttttgtagagatggggcctgttgcccaggctgctcttgaactcctggccttaagtaatctgccttggacttccaaagtgctggaattacagacatgagccactgtgcccagccaagaagcatttaaaaacctatttcttatagacatgggaacatgtctgatccagctgcctgcattcaccagtaggaaaacaatcaagccactagttcattcatggagggcatgcctggagccactgctatgtaggaaaggatgggagtccccctgcagaacagtttgtcccctgcccagtgagtatatcccctggcccctgaaacatactgagcaacaatgaaactgggtaatggtaatgagctgtgatgagcttctcctggctaatgtactgagtacttagcaagtactgggcaccgtcttcagtgctttactgtgaatgaggtgctactactgttgtcatttcgtagataaggaaactgaggcatagagaactgaggtcacttgcccaaggctgcaccatggtaagggatgtggcagggattccacccctggaagccagagtctgcctgcccacttcacctctgctacactgtgtgtcctccctctgcccgtcctgccacccctgcctcccagtctccaccctgagctgttgggatgctcatttgaggccatgactatgatgctgttgtaggaacagctgctcccttgactgctgagggtcgtgacagtggcctcacaacctctccctttctggcaatggaggtcagccgtagagagtccccagtctggtcccccacccgcctgactcctcctgggtccttctgtcctgtcttccccctctgccccagggcagccccttggagacttggaggtgatgcctctccaggcagggcggcccaagccagggttctgtggggtctgcgaggggagcaggcgtgtctcccctgatttagagcttgtacaccacatccatcagaagcctgtttctggctgagtgctggcctaatgggcagaaggtggaaatggcctcctgatgataaatgtccctgacaggcttttagcagctcagtcaatagcccaccaggctggctaatgtccgctcctgcctgtggtcctcagcgtaaaaccttttagaagcagagcaatctgccagcccagggcagggcagcgcagggcagcgcagggcagggcagggcaggggaggtggggcggaggggagggctggggtgggctggggtgtgagtgggcagccttccctcatcagctgagaaggaagagaaggctgagaaggaagagaagctgtctagggctaggcccttctgagccacgcccaaccctaaggcgccttccctgagtctgtgggaggtgggaggtgtgtgtctgaatggggctcctgggcactttgcctcccgtcagcccgagggcagcctgactattggctcatctggcttttcttgggaaaccgcactgcggaaattggggcatggccctgggccagagtctaaaggcccggagagcaatcagtgccccacagccaaagacacagtactgctcatggcctttgacccaggaaatgatcccagagaaaggaaaggctgtgtgcaggaaggaggccagggcagggactcacagagcactcactggtgctccctcagagcacaggaagtacagcaccaggctcacacttggggaaccagaggcctgggctcaagcccagctctgcccctcacctttgcagtgaccctgggcaagtccctactccatgctggatttccccaagtctgaggtccgagagagggtgctgggatccattcgcaatgcctgccacaggtgcaggataagacagtgcagctgtgggctccattcctggtctctagagcccttcaagagctacagttttataacagaagtttttggctaatcctggatggacccattttttcagaaaatctgtatttttgtttttaaacaccttttttaattgcaaaacttacatagctaaaaataagacaaagatattaaagccagccatttattccaccatctagatataaccatgattaacattttggctcattccttttagtttttttttctcagttttgacatacaaatatacatacatatacatataataatagcttctgttactgagcacttacagtaacacctgactgttgggctcttcatgcatagtatctcatttaactctcaacaatcctgcaaggaagaaatgattattcattcacattttacagatgaggaaaaagaggcttgcaaaatgtgagcaggtgcacaacatgctcaggttttaattttcgaaaactcaccttgaggacagtgtacaggatgtcctggaggctaagcaagaggtcattggcagctgggcgcagtggctcaagcctataatcccagcactttggaaggccaaggcgggcagatcacctgaggtcaggagttcaagaccagcctggccaacatggcaaaaccccgtccctactaaaaaatacaaaaactagctgggtgtggtggcacgcacctgtaatcccagctactcaggaggccgaggcagggagaattgcttgaacctgggaggtggaggttgcagtgatccgggatcgcaccgctgcaccccagcctgagcaacaagacgagactccatgtccaaaaaaaaaaaaaaaaaaagggtcagtggtcccatggagacctgggccagggcctgtgggtgcagtgtccttctaagaccctagctccaggtaccgccctgccaggacagggcaggaagcatgcacctctctcccctgtcctgctgtagaagaggcagagaccacttgaaagagagaaaattttcacctccctccatgcacatcactaacaaaggacacaagtccacattctttcctttttttttggttctctttctccctctgaatgtgtaggtgtgtgtataattttttgttttcagaactctttgagggtaagttacatccatcttagcccttcatccctaaatactgtttcctaaaaatacaaatattctcttacattactgcagtacattatcaacttatataagtttaatgttgtgataatactgtaatctaccgttcttgtttagatttgttaaataatgtcctttatagcgttgtcccctccagtaggggatccagtctaggcggaggtgtctgatcactttttcctgaggggagagacctggattagccagagtatttccagagggaggcacaggaccacctcctctgtttgcagagctactaaaatgcatgcataggccaggcacggtggcccatgcctgtaatccctcactttaggagggcaagttgggaagattgtttgagcccaggagttcaagaccagcctgggcaacatagcaagaccccatctctacaaataattttaaaaattagctgagcttggtgacacatgcctgtagttcttagcctggaacttgggagggtgaggtgggaagattgtcttaccccgagttcgaggctacagtgaatcatgattgcaccactgcactccagcctggacaacagagtgagaccctgtctcttaaaaaaaaaaaaaacaagtacagtggtctctacacagatggggaggtgatggaagaagagaaggttgggtgttccctgagtccaccctgttcttgaaagtccctctagaaaaaatcccaagactattgattctgcaaagtcaaggactatgttgagtgttcaccttgcaatcagcccctccaacagcacctgtcccctgggcacctcgggaatatttgtgggatggatggatgttggccagttttcttctcagctgtctctttcacttagatataaaaatggctgggggagcattctggtgggtggctcaagaacctggaactagatggtggatgtgggaggtcgagggcctgggtcctggtccctgttctgccagggccatgcaatgtgatgtgcaaaatgagcagattggtcactgccagtccaaggttctgtgactgaactggtgtggtttctctatgaccccaagaaatccaagtctcttggtggagttggaaatagcttcagggctgtgtggcatgggctgggggacctgtatgtccctcccagcacctatacaggaattctcattaggaaaggggaaaatgagggaaatgccctttctatgtaattgaggtagaattcacataccagaaaattcaccgtgttttgttttttgtttgagacagggtcccattctgttgcccaggctggagtgcagtggcacaatcatagctgactgcagcctcgacctcccaggctcaagcaatcctcccacctcagcctcccaagtagctggaactacaggtgtgcgacaccatgcctggctatttatttatttatttatttttgagacggagtctcactctattgcccaggctggaacgcagtggcacaatctcagctcaccgcaacctccacctcctgggttcgagtgattctcctgcctcagtctcccaagtagcttggattacaggcatgtgccaccacgcccggctaattttgtatttttagtagaggtggggtttcaccatattgaccaggctggtctcaaactcctgacatcaggtgatccacccatcttggcctcccaaagtgctgggattacagccgtgagccaccatgccaggcctaattttttgattttttgtagagacggggttttgtcctgttgccatgttggaaaattcaccgttttaaggtgtatagttcagtggatcttagtatattcacaaggttgtgaatatactgtgaataaactgtcaccaccacctaatttcaaaatcattttgtcactccaaaaagacacccctcactcattagcagtcaccccctattgccccttctcccaagcctgaggcaaccagaatcttgccttctgtctccatgaatgtatcgttctgcatttttctttctttttttttttttttttgagacagaatcttgctctgtcgccaggctgtagtgcagtggcatgatcttggctcactgcaacctctgcctcctgggttcaagcgattctactgcctcagcctcccgagtagctgggactacaggcgtgcaccaccacgccgggctaattttttgtattttagtagagacagggtttcaccatgttggccaggatggtctcgatctcctgacctcgtgatccacccgcctcggccccccaaagtgctgggattacagtcgtgagccaccgcgcccagcccgttctgcatttttcatatgcattacttagggttccagataccaggtaccagggggatgcattaatgtgctcaggcaatgaaaccacatctggaacatcatctaagtggaatcacacaacgtgtggccttttgtgcctggcctcttcttctagtgttttctaggttaatccatgctgtagcagggaccagtacttcattcctctttttagggacagtagtattctgctgcatgaatatactgcattttgtatgtccattcttcacttgatgggcatttgggttgtttccactttctgatattatgaagaatattgttgtgaacattggtgaaccagtttctttttttttttttttgagacatagtttcactcttgtcacccaggctggagtgcaatggcgcaatcagagctcactgcaacctccacctcccaggttcaagtgttctacctcagcctcctgagtagctgggattacaggtgcatgctaccacgcccggctaatttttgtatttttagtagagacagggtttcaccatgttggccaggctggtctcgaactcctgacctcaggtgatccacccaccttggcctcccaaagtgctgggattaggtgaaacagtttcttgcggacttatcttttcattttccatggagatagacctaggagtggaattgctgggtcatgtgggaaccggttaaccttttgaggaactgccagactattttccaaaagagctgcaccattttacatgcctaccagcagtgtgtgaggggaaatgcccttttattgaacatctgccatgtgctaggcactgtgccatacctcctctcccatgatcctcacaccaacctgtgaaatacctgtgattgctcccttttactgaggaggacaccagagctcagagaagtgaagtaactcccccaggatcccacagggaataagaagtaaggcctagattcacacccagctctgtcccttatgttttcctgttgactggttgctaactgactatgtgactgtccagatgctaatgtggaatccacctcctccccaaccctcctgggcactgtcttgcagacagggaagttggacccccactacccaaaagtctgcgggcacagaggcaacgttttggatgtcaagtggaacccttttgatgattttgagatcgcctcctgttctgaagatgccacagtgagtgtcagcccctgaggggcttccccttcctgaagagtgggattggggtggttggggtggaatggtacctgttcttggctctggtgcccctgactccatcgcggaggtgaggtcactgtgtggggaggtgttaagttaaggtagaggaggagacattcttggtgctgtaggactagcggcaccacccctcctctctatgggccttagttcccccccatataaaatgggcataatagttccacccagctaataaagcccagtgaaaatgtatattccgatgggaaaacccatccttcggggagctataaaaggctatgaggggcatttttatggtgatcagaaaagatgttccacttaatcccatagtgaggaagcgagctataaaaggctgtgagggccttggatgaatgtggacactaaaaccattccagcagcttcagtctcactcacttttttgagcccgtgttctgtaccagggttatcatccctgccccaacaatgttcagtgttacttatttacaattcattttgtacccacttctaaaatatggtggtatggcttaagacaagaaccacagatatgccaggttcagtggctcacacctgtaatctcagcactttgggagactgaggtgggagaatcacttgaggccaggagttggagaccaacctaggcaacatagtgagaccctgtctctattaaaaaattaaaaaacacagatatgatcagatgattaaaataaagataaaagtcattgtcaccatttattgtgagcccactgtattcctaactgtcatcacacttatcatttcacagtctccccagcaaccccacaaggtaggatatttttctgatggagaagctgaggatcagagaggtacagcaatttgcctaatgttacacagcctgtgggaggcagagcaagacttcagactgaggcctgtctgattccacagcccattctctttccaatgtgctgtgacacatctttaaagagaagcagccacagatggagaaactgaggaaatactagaaatgatggctaagaagggttgcagcagctaagctgctagtttagctaagagctacctggcagccaaggcaaaatgggcaacagaatgtattgcaaaaccttcagttagatcaaaagaagcagaccagttcatcaggaaaggaaggcagaaaattcaaagaggatttgtgtcggtttccatatagcagatgctgaggaacgtaaaggacagtgtctgccgaggtgatttcaccaaagggacaatcaggtcctgtgagaattggccctgtccccagggagtatagggcctctggcaggatatcaaatatctgaaactgtccccacttttgtgatacctgccttttcaggactgctttgaaggctcccatcaagatctttataaatctcttgctagcctcattgcctgccactgccccttccccgatgccccagggcaggacgtgactgttgggggactgaagaaggaaggggctttcctccccgaagctatgcccacagtgaatttatggggtgttcctccctgccttcagggcctggagggcacggttgctcctctagcagtggggagtcttctctgcttcagtgttgcgggtggtaccttcatcttccaaacatacctcttcagagtgtgtcttcctcccggggttctatgcagtgacagccctcatcagaccgaagtatctggagcctgtcactactctcgtggggttggcttcctggttttaaatccaagatgaccaggaaataaatatttgctgaattgaaagcaaagtcgtctacctgaaaaacctgtatacctctaagggaaacagtgcatacaatcaactaggggccagagaaccttgcaggaccaataaggaagatcaagtcagcagcatcccaggatcaccttgtactccatttgtatacctctgtgacagggagcttactctctgccatggcagccccctccatcttcagacaacactactctggaaggaagtcccagcacctcttctcaggccctcaccatgaaatacaggcccatgaccccatccagcccagcctcctgaccttcagagtttcctcttgcaggccatccagggtgcacctccaaagcaagaagtttgtccctgccctgctgcagagacctcgccggctccctagtgcctgaggatgcagcctaaacccttcatcctggcatttgaggctctaccctgggtctttgggacaagaagaacactgtactttggggatatcctagcttaggagacaggcctgaaacccagccacctgcccaccacctcaggccagcaggatgacaaagatctctcaagggcagatttggaggcctagactcatccctggtcagcgctggcccctgctcaggctggaggagcttggggaagcccctgtctgtctgaggaccctcagctgcccctccactgcccctcaatgcccatagccactgagtgggaggtggctatggagagagctcccttggtccttctgctggtcactgccagatctgtggcttaggctggtgacggtgccaaggtgccctggctaatgctgccttgggccctgtctcccctgccagattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgagtctgggtattctttctctggggcagccccaacaagttcccacaaactggaatacaatggaaatgtattctgtcacagttctggagaccagaaatcgaaaatcaaggtgttgggagagccagctccctccagatgccctagggaagaatccttccatgcctctcccagcttctggtggctccaggcatccttggctatagctgcgtcactccaggctctgtttctgtcttcacacggccttctctctgtgtacctgtcttccttataggaagaggagagcaactatcattggatttagggcccacctaatccattatgatctcatcttaactaatttcagcagcgaagaccccatttccaaataaggtcacattctgaggttccaggtggacatgagttttggggggaaccctgttcaactcattatagcctgcccggagtggatgggatggcactgcccagaaaatcgttcccccgaccctgctccactgacaatcaagcatgcaggcagtaggccctgtagattgggacccacagtacaggagacctcaattctattccgactcagtctctgacctgcactatagcctgggaaagtgccttgacttctctaggcctcagtttcccaatctgtacacaaatggaattggtggcaccatagctatggcctttcagttctttccttttgacactataggggtttacagagacacctcgggaccctctgtgttggataaaagggaggtggggggccggacatggtggctcacacctgtaatcccaacagtttgagaggctgaggtgggaggatcacttgagcccaaggatttgagaccagccaacatagtgagaccccatctctacaaaaaaatagaaaaaattagccaggtgtgggaaaatgcgtcaagtagtcccagctactcaggaggctgaggtgggaggatcacttgagcccaggaggttgatgctacagtgagccatgatcatgccactgtactgcagcctgggcaatcctgtctcaaaaataaataactaaaattgttgtggggagcactgagggaacctgggccctcgctcttccgatccacagcgctttctcatctgtttgtatggggtgtctgcagagctgctgcgtgtatttgtgctggttgttctatacccaacttcagggggcactagtcacgtcctagtctataggaatggattgccctggacctctgcatgcacagcctgtgcagctaaacatacagccctgttgatctgtgggaggtgcaaactgctgctaataactgaaaccgcctggattagctggttccctggggtcctcccagcatggatgttttgttgctcagaggcaggtggcgttttcctttcaccactagacagcctggccctgggattccccctcctgccacaagcagcttcagcctgcacatcatcctcccactgaggcttcttggccaggctgccagctgcgccaccctcccagggatactgtgtttcactgcatcctggccagcatgtaactatgaggcccaggggcaaggtggcccctgtgctcagagctggctctctgccatgcaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggtcagttctgggccaggggctggctcaggctcagaggagcaaggagcagagtggggacagagagaggcttcagagaacaggacagtgatgctgtcagcgtctgggctgcgccttcacaggcagcatccctgtctgtcctctcgggattgctggaaggtgggatatgtcctttccattttgcagatgagaaaactgaggcccgtgagagatgaaatgactcacccccatggagagctgggatctgaacctggtctgactccaaagcttgttggcgtgcctcagctctggccagggggtcaggagagccgacgataccactgtttagccactgtgcagccttgggcaagcgcttcctgctctgagcctctgttttctcatttgcaacaatgggctgttagtccttcctctccaaggattagataagacaggccaggtgacagtgcccgcccctgtagggatgcccaatactctttcagcaagaacagggcgctgggcagaagtttgtttctgttcttgctcagaaaaataactcttaacaaagatagtggggagagactccatgtggatgagagggatccaggtggtgcccctgggaagaatctccaggcagagctggggtgagaaagggaggcctcccaggtggagcggtggcataagcaaagcagggaggccagaaaccccagctgcccccgatcctctactgtctctccaataccgaccgcacgtgtccctccaggaggccagctacaaagggcaccgggccagcaaagtgctgtttctggggaacctgaagaagctgatgtccacaggcacatcccgatggaacaaccggcaggtggccttgtgggaccaggtgagggctgcaccccacccctcaccatcacccctcagctgagagccagtgtcattcattcatgcatgcattcatttagacacccatttatgacacacacatttagcgtagactgccaggtgctggggatccggggatgaatagcagggagatgctgacagccccgggcgagcccagaccctgtgtatcttgccacccaaggagggagatgggtcaggacccaggggagtccgttggctagaggaggggaggtagctgagtctgggaccaggactaggaggaagggagaaggagagggccatctgggctgagggtgcacctggagcaaatgaggtactaacgggtatggggagaaggagctttcattgggacagctgagggtggagcagggtagggtgagggccaagctggcggtagtattttgagggagcatttgacagagtttcaaagactggacaaatcacattttctctctgagtctccttcttcatctattaaaataaattttaaaaaacaggtaggggaagattggaatgagatcgggtgtgtcaaaagtgatttgttatggccaggtatggtggtacacgcgtgtaatcccagcacttcagaaggccatggcgggaggatcacttgaggccacgaattcgagaccagcctgagctacacagcaggacccccatctctgcaaaaaatcagcggggtgcagtggtgcatatctataatcccagctatttgggagactgaggcgagaggatcgcttgagcccaagagtttgagactgcagtgagctatgatcgcaccactgcactccagcctgggtgacagttagaccttgtctcaaaaaaaaaaaaaaaagtgatttgttaagggcagaaagctgacaaaataggtggcagcagcattttagtgcctttaagatgtcatctccactagagagtagcccacacattggaactcaagaaccagggacatcttccccccgcacacacatataaaaaaatcacactttttctctgacacacacactctcgcccagagcaccatggcagcaattcttatctccgggagcaccactgagggcccccaggagtgacccaggccttccctgcctccccttcccctgcaggataacctctctgtgcctctgatggaggaggacctggacggctcctcgggcgtgctgtttcccttctatgacgcggacaccagcatgctctacgtggtggggaaggtcggcttggcacgggagggaggtgacctcctggacccctgagacagcggcagacagcagcctggggccattgggaacacagggcagggatgggcaggcctcgctggccactctttccctgtgagaaggaacccctcccaccctcctggctccctaggaacacctggagccagggctctggctggacaccttgaccttgtctcttcccaactccaggcccagatgtggggggaccattggtgtttctcagcaggggcacctgctaaactgggggcagaacaggtctccactgggtaggactatcccatgtctggcagccctggcccctgcccaccagtgccaagaacagcatctctccccctccatccaagtcattatgacaaccagaaatgttccccatggtaagaccttctggatgacctctgaggccaccccagttctgacttttgctgctgctctcagataggagcgggatttggacttgtcttcccagagcttctgtcttagaggaaaaagggtgggctttgggtcatggtgggggaggattgaatattaaaataagggcccaggcccagcacagtggctcatgcctataattccagcactttgggaggccaaggtgggagaatcacttgagcccaggagttcaaggccagcctgggcagcatagtgagaccccatgtctacgaaaatgaaaaaataaaaaattagccaggcgtggtggcacacacctgtggtcccacctactcgggaggctgaggcgggaagatggcttgagaccaggaggttgcaatgagctgtgattgcactactgctctccagcctgggcaataaagtgagaccctgtctcaaaaaaataagataaaatctaaaataaaatgaatatcccctcatcaccctcctgccttgatgacagggcccccagtttcctggtgttcccttgagtgagatgggtttgccgatcatcaaaaaaagccaggtctttgctgcatggctgggttgctgatgagctgatgagctccagctctgaatctcaccctcctcttccttctcctcctcctcagggagatggcaacatccgctactacgaggtgagcgccgacaagcctcacctgagctacctgactgagtaccgctcctataacccacagaaggggatcggtaagtgagggacactgaagttcatgcctgtaatcccagcacttcgggaggccgaggtgggagaatcagggtcagggcttcagtgcggggtctggggagacagggatgagtcagatgggaggagagacagcatagcaacactctgacttggtgggggctgtacttgacgtgtgcaacagcacaaaggaggaagtcagggaaggcttctcagaggaggcaacattggaggaactgaaagaggaagcagagcccagcaggggagagagggatgtgttctaggtcaaggttaagcagttaccacaagagcagagatggaaagggctgacctagaagagcctctaggaagcagtcctcagttcctttctaagtgtgcttgaggattaaaaacacagctatatttctgtaatctacaagaaacccactttaaacataaagacatggctagattaaaagtaagggactggagaaagatgcaccctgctaaccctactcaaaaggaatctggagcggtttgattaagagcatttgggtcacaggagctgtggggatggagatggggaaccttaagcagagcaaactgcctataaaagttcagctaatccagcactttgggaggccaaagctggaggatcacttgagcctaggaattcgagcctagcctgggcaacaaagtgagactcctgtctctacaaataaataaaaaaattgaggtgcatacctgtggtcccagctacttgggacgctaaggcaggaggatcgcttgagcccaggagtgtgagactgcggtgagctatgattgtgccactgcactccagcctgggcaacagagtgagaccttgtgtcaaaaagaaaaaaattcagctaaaataatttaaatctttgaaggtgaagagtctgattaattcaactccatttcccaacatagggcccagcccagtgtcggtatttgtccctgagctgttttctgggaggagactggtctctgttcaggtccaggtgtgcagcctggctttggccctaacactgtggccccagcctagccagaacctcttggccctccctgtctgccttcaggtgtcatgccaaagagaggactcgacgtgtcctcctgcgagatcttccgcttctacaagctgatcacaaccaaaagcctcatcgagcccatctccatgattgtgccccggcgggtaagggcagtcgggaccgcatgggaggcaggtggggaacctgtcctggagaagacagacccagggctgtcgggcaccagagcctggagcccacgttcatggggcagccacagagcggcctttctcacagccagtgtgacatcagtgggcgtcaggagtcctgggtctcggtccacctctgttcttgagctgctgcgtgacctcgggcaagtccctttgttctctgggcctcagtttcctcaattcagcaggggttggtgagagcctggactcccaggtctaagggcctttcccatctgagcagcctaccctaccaccctcctcactgtctggatttctcctgcagtcagaatcctaccaagaggacatataccctccaacagcaggggcccagccctccctgacggcccaggagtggctcagcgggatgaatcgaggtgaggaaggcagagaagaggcccaggcaaatgtgacaggaacatggcgtgcccagtggccccaagcaattgagaggggttgggcctggatttttcttctctcatgacctcagaagccatgcccttgaccttcagtccccagtgggtagcatggtcacatacaggtccagaaagtcagggggcttgacccaagagctcagaaaactccaactcaagggactttgccccacggaaagcttctttacactctggggctatgtggggtgcctggaccacctcagccagactccctgtccctgttccccacccctacctctgcaattcttttttttttttttttttttttttttttgagacagagtctcgctttgttgcccaggctggagtgcagtggtacaatctcagctcactgcaacctccaccccacccccaggttcaagtgattctcatgcctcagcctcctgagtagctgggactacaggcacgtgccaccatgcccagctaatttttcgtatttttagtagagatgggggttttgccatgttggccaggctggtctcaaactcttgacctcaagtgatccacctgcctcggcctcccgaagtgctgggattacaggtgcgagccactgggcctggccttttgcaattcttcttgacccaagaagccctccaggcagcaacccccacccaggtccctctgcccactctgcctgtcctgagccactctcccgctcctgccaacacgggggccagcccagcagaagcagtcaccccagctgctccctctcccttccacccccacaaacttccttcacccccaccccagtggctgagcgggcctcctggtgtactggaagagcctctgccttggggggcagcggaccagggccgagtcctagttttggataaccttaagtaggttttgctccctgggcctcagtttcctcatctgtagccatgatgccagcctcccctgctttctggaggtggtgagagaactaatgaacttggtagatggtggggtgcagtgtgggtgggactgtccttacaaagcaagggcaaggtctcatgtgagtttgaagtgtttgggggctgcttcagtgcacgcaccgtgctgttcctacaaaccaagcttcactctgagggtggcacacgtgggtatttgtatctgttagccctgctctgtgggtttgggcctgtccacaggtagctgtatttcccacacatgttgcatgggtctgcatggctctgagtgtctctgcatgcctgcctgtgtcattggtgccccatatgcccatcttcccgtgggcaccccgtcctcacatggctctgcttcccttccagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgaggtgtgaaggaggacggggtgggcctttcacatggggcagctggggtggaggggaacagatccaggctgagaagaagggagaaaatgaggcatgagaagaataaccagctgtgtggcctggcctagtcacttgactcattttgttaattcattcaacaaacaggcagtgagctccatcttatgccaaaatgatgggcatacataaagatggtgggaggctgggcacagtggctcactcttgtaatcccagcactttgggaggccaaggcgggcagatcatgaggtcaggagttcaagaccagcatggccaacatagtgaaaccccatctctactaaaaatacaaaaattagccgggtgtggtggcgtacacctgtagtcccagctacttgagaggttgaggcaggagaatggcttgaaattgggaggtggaggttgcagtgagccaagatcacaccactgcactccagcctgggcaacagagcaagactccatcttaaaaaaaaaaaaaaaaaaagatggtggggaccaggtgaccaggtgcagtggctcacacctgtaatcccagcactttggtaggccaaggcgggtggatctcttgaggccagaagtttgagaccagcctggccaacatggcgaaaccccgtctctactaaaaatacaaaaattagctgggtatggtggtgcgtgcctgtagtcccagctactctggaggctgaggcaggagaattgcttgaacccaggaggcagaggctgcagtgagccaggatcacaccactgcgctccagcctgggcaacagagtgagactctgtctcaaaaaaaaaaaaaaaaaaaaaaaaaatggtgggaaaccatctgtaaaatggagagggtttgacctagtgggtatcaaagtctttccagttctgacattataggactttctgtgctttcaaagtccacatttgtttagtgcctactgtgtggcagatcctggggtaggcactttgatacagcacgtgattgaattctctcaacagccctggaagtcagtctgtagtggctaagaacacagaggctggcatctcacagatggattctgatcctggctctgctgagtactaatttagggtcttagacccagagactgaatgtctctaagcttccgtttccacggtggtacggtggggacactagcactgccacccttataggggtgtcacaacgttccagtgggataacgaggcccttagggcatcactcaatatctaacacccattctgcacagagggcagttttctgaccccattttccagaggaaggaatggaagctcagagtgggtaagtaacttgcccaaggtcacacagttcagtggtggcgaaaacaccaatccccagacttcagagccaggcatcctttcctctatttcatggaggatctatggaagcaaaatacatctgaaacattccagtcttcttgaatttcatttattgggtgaagtaaacaaggtgtttgtaaaagatctatgcagtgacagccccatcaggcctcagccatgttaatgtgaccgcctccacctttctgagtcaaagagggatagtggtttagctttcagctggtgtcctgacaccatggtgatcctgccttccgatctttcttccccagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatacaaaaaaattagctgggcgtggtggcaggcgcctgtaattccagcgacttgggaggctgaggcaggagaattgcttgaaaccggaaggcgggggttgcagtgagctgagattgtgccactgcactctaacctgggcaataagagcaaaagtctgtctcaaaaaaaaaaaaaaaagaaagaaaccagcctggccaacatggtgaaaccccgtctctactaaaaatacaaaaattaggcagggcgtggtggttcacgcctataatcccagaactttgggaggccaagctgggcggatcttctgaggtcaggagttcaagaccagcctggccaacatggtgaaaccccgtctccactaaaaataaaaaattaaccaggcatggtggtgcatgcctgtaatcccagctatttgggaggctgaggcaggagaatcgcttgagcctgggaggcggaggttgcagtgaaccaagatcatgccacttcactccagcctgggtgacagagtgagactccgtctcaaaaaaaaaaagttggccagccgtggtggtgagcgtctgtagtccctgctattcgggaggctgagataggagaattgcttgaacctgggaggtggaggttgctatgagccacgattgcggactgcactgcagcctgggtgacagagcgagactccatctccaaaaaaaaaaaaaaaaagagagagagaataggggaagactaagcaggaaggctgtgtctcccttccccacactgtattccaaccagacagctcccttctattttatatgttgggctagtatgaaaaacaattctgctaggaaaaaaaaatttttttagaagtttgaaagctagtgatttgacccaagttcctcattttacagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaaccttgacctaagagaaaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatgttcatataagctccacaggtgatctgcagtacagtgaagatggaagactgcatgtgtacctatttgcaataaagatgaagaggacagcaagctccagacaggagctgggactcaacccagatctcttaagtcctgcctggtggctccttaaaagtccagaagtgttgccccaagccctccctcaacatctctgggaaccgcagctgcagcacgatgggggttcagtgcccctgtttgccccttacccag

SEQ ID NO: 15619 - DNA, 7700 bp, Human
aggaccgcgcgtctgtaaggcgctccactttatcaccttgactcggtggaagagaaagcacagatatgggatatccccacatacacacttcacagatagagaaactgaggcctaagaagggcagtggatggtttaaagtcgctgggtgggtcttgagcaatcttgggtggaaaccctcacaacactggtgctgccttacatggatgtcttctgtggtcagcaggacgagtgtgacttgggggcccccttttgtgacagtgtcttgctctgatgctctctagggccatacagcccactgacccagacagaatgcactggagtaacctaaacaggtcactgcgatgctgctgtaaggagatccttggatcagatttgcaagtgtggacgcctggagttttgttgttcagtaaaaagggcagcccaggccaaagaattaagtacaagtaaggctctgagaactcaagaaaagacagagaggctttggggccaaagagtaaggcccaaagacctgagtttccttctcagcccaaggcttttctctctacaagtcccttccacaatccaggcccagtctccttctagcttgaatttccatggtttctttaatagaagaactggttacctctgcgtctgcatgcaggggaatctccgtcaaggaatctggtggaattttccttgactccttggacccctctcgtttttatttacaaagtcgcccattcaaaactgaggaaagcagctgttgcagaagaacatcttctaaagattcccaatagcacctccagccccctatgcacataaaatggcctgctgcaggctggcttctccaggggtgctgggaatacttgaagggctgaagatcagtgggaagcagaaatcactggcctgcccacatcaacaccaacccacccctgctggattgggagaatgatttccaagggtctggaacctgcccttcctaacttccagatgattcataaacgttaaggagcactgtggcagagaagaggggaggacttggccatgaccatgttccttctcaagaaactgagaaggaagcaatgggaagagataggaaatgccccgaggagatttttgtgtatggttttgatccaaacgggtaaacttgtgacctgtgtactcaccaaatcatttaatgtgaactcaccgtggactcacagaatcttcaaatgcattattcgaagagaacatttatgaaatagaaatttaggggtccttggtttgcgaaaatcttagaatcatgatcttggaaattctaatctcatgatgctaggtatttggtctcggccacaggagtagcttgatattaacaaagtttgagaaaaccatcagaattctagaagaatgaggtcacagacacaagacactgaagaacagaaaatcctgagacaagaaggcttttagccatagtcgttgcagcttaaaagtagaggatcataaagtcatgggactaatcattacagcatataatcacaaacattagaagaattattggaatcagattatttgaactacagaatagcagatccagcactaacattttagaattaaggaaggagagaactgcggatttacaggattcaaattcttccaatcagacattcctaaacaggaattcaaattaaataatatataacttagagtggaaaaaataaaaaactggagaagtggcagcttcaagagtggcatcatattttcaggcacaaaatcttaggtccccgttttttgtttgttttgttttgcttttaagagaccgggtctccctttgctgcacaggctggagtgctgtggctactcacaggcacaatgattgtgcactacagcctggaactcctgggctcaagcgatcttcctgccttaacctccagtagctgggactacaggctcccgccaccgtgcctggtttagtcccagtatcttaatacataggtttttagactttgactagaagcttaagtcaaaggaatataagcatagtcaaagttagactcccagtcttggaatcttagaattacagggtcgcaggatcgcaggatcgcattctttagatttatggaatcacgttaggacaaccgtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacaggacgaaatctgggttttttgcttctccattacttgggaagaaggaaaccaggagttttgtttagcgagtgtaaagcccctctcccttcgttcgaccaaccctctgccgcagaaggttgtcaagcaaacgctttgagcgtttccacacaccgggtcgacggagcaaggatctgggctttgcctcgctcttccgaaggcagctgcccaacgcttggccgggcttagcctgccctcagctcaccgccacgaagaacgcgactaaaaccctggaaggcatgccacccgttaccggccagaactctcgtcttgggatctcccacactcacctggcaccaccctccgcgcggctctgcacccacagccccggcccgcccccccccccccaccccggaaagctgcgtccgggctggagccactggaacccgcgccaaggcccggaatcctatgcgtagcaggggcctcggagatcagcacacgccctccagctgctatttaacagagtagaacactgaggccctgcgaggggacaaggacaggccctggatctcccagtgaatggccagggaacgaacccgggccagaggggccgcgccgcgaggatctcaggttaggaccaagttccggctcagggacagcaggaaaggaactcagaaattggacacccatgaagcaaacgtgtcccgactgcccgccccttcccccggagacgcgcccacccggccaccgctctcttcccactcccccattacccacagccctcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagggaaagcggctacctctaccacacagttgggaagcgcagtcctaaaggagacgcaggttggagactccgctaagcggagaagccgcagtggggccatggcaagtcaccttccctttcgggcctaggaatactcattcgaaagatggggggactggagtgccgagtggctgtggcagccacgattggggtttggaaaccatcctgaaaggcccggggagccagtctcctggaacttctccctccctattcccacaaaaaccaagcgccctctcggccaattctcaccctctcaggacaaaaaagtgagatgagcccgtcctttcacctgcgagtccaagcccttggcagaggcctgaaaagtccgaaaactccgagttcgggcgctgaggtctcccgagccggttcctgaactctccgggcctcagtcgatcggggtgcggagggggccgacccgggggatctccaagcgccctccccgccctgacgctgtggggctcctaccgcgccgccacagctgctcctacctggggaggtgcgcccgggccccggggggcgggcagtcggggggcgggcagggaaccggtgccgccccacgcttcgtggcccctttaaggaggggaagccggcggagggaggagccggtccggtgtgtgcaggggagcgcctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccagcgcgcgccagcctgggccgctgggctctcggggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgcttgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctccgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaatggtgggccacccagggcctctgagtagccacccaaagcctagccgctgttctagggaacggaaaagagttcatggccaagcgtctaacctaaagtcccaggattggctccaggcagcaattatatcataacttattgaacttttgagcaggacgtgctggtaatttcatggctgttactgcccagtcataaatctgcttttccattataaggcagagagaagtacattcgttcatttgtccactgtttcttgtcatcacgcagccctggacccaaagggtgaactaaagtttaaggagatgagaggattcaaggagcccgttggtgacgcctttcagtagctggggagggctcttccatccccagcaccccctgctacacctcagcagcctcccccatgcaaaaaggaaagagaaaaattaagttagggcagtcagtaaagtgagctttagaaagaaactggaattttaacttcattttgtatcttgcttaagtagcaggctcactaaaattagagaaagtccaataactctccccctttcccttgagaaatctttaagtttcgattctggagcaaaaactttcagcattaaatatttcagaggctccattcacagctttcagataaactggagtgttcagatggactgttttaataaaaatctttgagcaagtgagttatggcaagagaaactcagcctctttctgtataaacttaacagggaagggctggggtgtgaaaaagaagattgtatgaaaaccattggtaatttttattttttatttttgggactgcactatcctgttcacgaagacatgtgaacttggttcagtccaaatggggatttgtataaaccagtgctctccattagaaatatggtgcaagccacatatgtaattttaaatattctagtagccacattaataaagtaaaaagaaacaggtgaggttaatttgaatgatatacttaacccaacatatcaaaaatattatgatttcaacatataatcaatgtaaaaattgagatgttttgctcttttacatgaagggtttacaatttggagtgtgttttacacttacagcttctctaaatgtggactagtcacctgctaggtgttcagtagcaacactgtgttgtgcagtgcaggtctaggtgctggcccttcctggctttggtggtggtacctggaagcacttgagcgctgaccctgccacccgtcggcccaaattccagacccagccttgtgac

SEQ ID NO: 15620 - DNA, 30364 bp, Human
gctagtagtgccctgccgatagagatgacgccagagtcagcccccagtccaaaactaggtggccgcttgggctggcctctggatccatcgccagagggggtctacagaaccggggcaggtagcacaagagcaatcccgaatgagcccccaaatttttaactgctcaactggttcaccatgcccactacctacacagctgatttatcaaaataggggaattgcaatagagagagtaattcatgcagagccagctgtgcagtctggctgagttttattattactcacatcaatttcccctagcattcagggatcagaggtttttggggtttttgtttgtttgtttttgaaatggagtttcgctcttgttgcccaggctggagtgcaatggcacaatctcagctcactgcaacctccgcctcccaggtttaagcgattctcctacctcagcctcccaagtagttgggattacaggcatgcaccaccatacctggctcattttgtatttttagtagagacagggtttcaccatgttggcaaggctggtctcgaactcctgacctcaggtgatccacccgcctcagcctcccaaagtgctaggattacaggtgtgagccactatgccccaccttggagatcagagtttttaaggataatgtggtgggttaagagaggccagtatgccaggagtgctgattggttgtgttggagataaaatcatagaaagtcaaggctgtcttcttgtgccaagtcagttcctggttgggggacacaagatcagatgaaccagtttatcaatctggtggtgccagctgatccatcaagtgcagggtctgcaaaatatctcaagcactggtcttaggttttacaatagtgatgttatccccaggagcaatttggggagggtcagaatcttgtagcctccaggtgcatgactcctacgtgtctaatcttgtggctaatttgttagtcctacaaaggcagtctagttcccaggaaagaaggaggtttattttgggaaataacttatcttattttttaaattaattaattaatttatttatttttgagacagagtcttgcagtgtcaccaggctggagtgcagtggtgtgatctgggctcactgcaacctccacctcccgggttcaagcgattctcctgcctcagcctctcgagtagctgggattacaggcacgcaccaccacgcccggctaatttttttgtatttttagtagagacggggtttctccatattggtcaggctggtctcgaactcctgacctcaggtgatctgcctgccttggcctcccaaagtgctgggattacaggtgtgagccaccgcgcccgcccaggtgattgtattttaagagcctggggctgggaggtccgggtactagtcccatctctgctttggctttctggatggctttggacaagccagtgcaacttctcgaacctgttgcctctcatataataggaacctccgccacttcttgaaaacttactacaagccaagtattgtgatcaggggtttctatacgtcatctcacagttctattttatttttttgcttcagagagaaacaaaaataacgctccggaagactgagtaacgtatatatgagcaggagctggtgactggcataggctggactcgatccagctctgtgattctaactctagcaaccctgttttttccattacaccatagggcgcgctctccccatgctcctgagagcaggacatagactatgccctgcgcaggcagccgtccgcctcctgcagggaatgcttgctcctgggtgcacgcacggataccgcgatggtccgagaccacgctctgggacagcaagcctcaagcctcgcacaggagagggccgcggagcttcctcgacccgccccgccgcccttcccgcgggaggccccgcccccgccccccgccccgattggctgtcgggagagaggcggggcctaggggattggctgcccggcgaccgcgggctgacgtggcggggctggcgtgtgggtctcgcagcgttgctcacagaacagagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggtgaggcggcagctcccgggacccgggattcgggcgccgggaggggcggggcggggccgcggggagccagggccacacggcctccgcggctgggtaccctggtccggcctcttcccgcccgccagttccgttttcggaatccttcggatccctcttcctcaccgtgtccgccaccctcgtgacctttctgcattacagcagctgcctcctaacccgacctgtttcctccccgttctggtgccagaataatctttctaaaagtcagacttgatcagaccatcccccctgcctggcaccttctgtggctccctcctgcccgcgggtagagtcgaaaccctttaacatagccttcaagattttaatgactgggccccttccagcccgtcataattcttctctgacattcttcagcgacacagagttactttcaggaatgacagttcctggaagttgctgtggtctctctcacccgccattccctgtatatgaaatatgaagtggttaaaagccgggcctttgagttcaaatctcagttccaccactactagctgtgtgaacatgggctgcttacttagcctccgtgaacccttttccccatttgaaaacggggcttgaaaacaacagttctttccacatggagttgttatggggatcaaatgagattctcagatagagctctgagcccagcacttggcacacatgagtcggtaaatgcgtgctccctcttctgttgggactgccatattcttcattacgaccccagcccccagcataaggcctggcctgcactatgattctttggtttagagatagctcaccccatctttcctttcccttcatcaatgctactcaactgattttgtatcatttgtgataggttttttaaatgtttatttatttatttatctatgttagagacagggtcttgctctgtcacccaggctggaggttttctcttactgtttttttttttttttcctggttttttttttttttttttttgagacagggtctctgtatcacccaggctggagtgcagtggcatgatcccggctcactgcaacctctgcctcccaggcttaagtgattctcccacctcagcctcccgagtagctgggacccacaggcgtgaaccaccatgctgggctaatttttttgtagagatggggtttggccatgttacccaggctggtctcgaactcctgagctcaagcaatctgcccaccttggcctccgaaagtgctgggattacaggtgtgagccaccaccctcggcccttgctgttccttcgggactggttttatggaaacctaatcactgaatcataaaaatactttacaaaaataacattgctaacattttttgagtgcttactctaccaggtactaagctaaatgctgtacatgcaccatctcatttaatttttacaacaacccaatgccatgatgctgccgatttcattttaaaggctaagagaaaataagtgacttaggcaaggtcacatagctagtataataaatacagtaaggggttttttcagtttttgctcctaagccacaggactccagcctttcttctgcaacattgttttctagagggaaattcccactcttaatttgaaggagcagtctgtttttcctcttggaatgccgaagttgtagaaatatctagagatactgaagccatagaaacaaagctgtactgaccaggtgcagtggctgattcctgtaatcccatcactttgggaggctgaggaaggcagattgcttgagctcaggaattcgagaccagcctgggccacatagcgagaccctgtctctaattccattgagctggaatctaggtggctgcagcctttaggaaagggatctggccagctctgctagagacactgtgcaactttagtcaggtcagtctgggccttgggatcttcatctagacaatgagagctctgttgcccaaggtcactttcagttctaatgttctttgaactttccagcatcaagtcctgactctaccatcttatgatttgtctaagagcaggagtagtgatctcagcactgacatttctggacccaagaagtttttatttttttttttcaagacggagtctcgctgtgtcacccaggctggagtgcagtggcgtgatctcggcttactgcaagctccgcctcctgggttcacaccgttctcctgtctcagcctcccgagtagctgggattacaggtgcccaccaccacacctagctaattttttgtatttttagtagagacggggtttcaccatgttagccaggatggtctcgatctcctgacctcgtgatctgcccacctcggcctcccagagtgctgggattacaggtgtgagccactgcgcccggcagccaagaagtttttaatagcatgaatacctctgtgtctacagaaatggccgtgagatgggactttagtgggttttaattactctttttcttgagtagattgtttttgtttgagtcaaggtctcactctgttgctcaggctggagtgcagtggcaccatcatagctcattgccacctcaacctctggggatcaagcgatcctcccccctcagcctcctgagtagctgggactacaagcgtatgccaccatgcctggctaatttttatattttttgtagagacagggtcttactatgttgccgaggctggtcttgaactccttggttcaagcaatcctcccaccttggcctctcaaagtgtttggattataggcatgggccactgtgcctgacctcttgagtgttttttgtttttttttttttatagtcaaacaatccggcttttatattattgcctctgctcagtagaagtcatctaggggctggggcatttttgttttgtttgtctgctttttaacatgtaacctgttcaaagaaaatgtcatggagaaaagcgccagtgcaaagcagctaaaagcagagttgctattgttgaaatcagagaaagaggcatagggcactgtccctggatgttcctgtccctgagagggcctcattaggacagtttacacatcctggaggtagcccaaactgcttttatatcgatggagaaactgagtccagagctgggaagtgacttatctaagagttagggtcaaagttaaaccagaatttttctttactaaattctggtccagtgctgagttgactattctttgctcagttatataacttaaaatcttccttaactctttgatccaatgtttttaatatttacaatgcaaaacaaaggaaaaaagtcccatttttttttcttttggcatgttaagagaaaaaaatagggggaggtctcccatctccaaacaaccttttcttcctttcagactttcttgccttttctgttcctcttccttggaggtccttaaggtctctgtcagtctatgttgtttttaaagatggtgatgtcggctgggcgcagtgactcatgcctgtaatcccagcactttgggaggccaaggcggttggatcacctgaggtcaggagttcaagaccagcctggccaatgtggcgaaaccttgtctttactaaaaataacaaaaattagccgggtgtcgtggtgggtgcctgtaatcccagctacttgggaggctgaggcaggagaatggcttgaacccgggaggcattggttgtagtgagccgagatcacaccttctgcactccagcctgggtgaaagagcgaaactctgtctctaaataaataaataaataaagatggtgatgtcatagtggttgctccagaattttttcctttttttgagaatctacgacagtcactgaaagatgtcctaatgtgtgttgtaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgaggtgagtcctctgctgctctgtcatttgtcactttagcagaccaagggtcagcaggcagcctggtgacttccggcttagggccacctccagcccttgctcatcctttctgttcccagctactggagaggctagcaggcgccaaagcccagtgagaatctgtgggaaggatgccattgttttaaaaacacattgtctctggccgggcttgatggctcacacctgtaatcccggcactttgggagactgagggggatggatcacctgaggtcaggagttcgagaccagcctggccaacatggtgaaaccccatctctactaaaaatacaaaaattagctgggcatggtggtgcgtgcctgtaatcccagttacttgggaggctgaggcaggagaatcacttgaacctgggaggtggaggttgcagtgagccgagatcacaccactgtgctccagcctgggcaacagaacaagagtccatctcaaattaaaaaaaaaaaaaaaaaaggccaggcgcggtgtctcacacctgtaatcccagcactttgggaggctgagacaggcaggtcacgaggtcaagagatcaagatcatcctggccaacatggtgaaaccctgtctctactaaaatacaaaaaattagctgggcgtggtggcatgcgtctgtagtcccagctacttgggaggctgaggcaggagaatcgcttgaacctgggaggtggaggttgcagtaagccgagatcgcgccactgcactccagcctggtgatagagcaagattccgtctcaaaaaaaaaaaaaattaataataataataatagtaataacaataacaagttgtctctggaagtaggggtcagccacactggaatcccagagtccctccaagctgtagggacaccccagctgggccaggtttctcccagtagaaaatggtctgggaaccagggcctgggtgtggtggctcacacctgtaatcccagagctttgggaggctgagctggaaggactgcttgaggccaggagctcaagaccagtgtgggcaacacagggagaccctatctctacaaaaaacacaaaaattagccaggcgtggtggcgtactcctgtagtctgggaggctgaggattgcttgatcccatgtatttgagactgcagttagccatgactggaccacagcactccagcctgggtgatagagcaagaccctgtctcttaataaaaaaaaaaaaaaatagagcaaggaaaccacagttctggagtccgctccttgctgactagccttgactgacttgagtggggggacactggcactgtccagaagggaatggctcacaggatggtcaccggtggtttttggcttggccatgctacatcctggaagagtacagctcgtgccaggtctcaggtcccatctgctctgtgacctgcctccttaaaattccttcatgtgttcttttgaatgtaaaaaaaattttacttgtaaaaataacattacagaaagtttagaaaatgagaaaagggaaaaaactgacccataatccctctatagcagttctttttatatatttcctcctgaagtctttttatattcttgttttattgcctgctggtactatttagtgaacatcgagttctgtgcctgcttgttttagttaacattatagcacaaacttttaccccaccttatgcttaaagattttaatagcaacgtaatatttcttttggtgcatgtactatactgtacctaaccattcctctacttttggatacggaagttatttcagttttttttttttttttttttgagacagagtctcaaaaaaactgggggaagagtatataggatttctctgtgttctttcttacagctgcatgtgaatctaccattatctcaaaattcaaagtttaaaattaaaaaaagtttcttcaattttattttattttatttattttatttttttgagatggagtctcactctgtcacccaggctggagtacagtggcgtgatctcggctcgctgcaacccccgcctcccaggttgaagcgattctcctgtctcagtctcccaagtatgcatgcaccaccaggcctggctgattttttttgtatttttagtggagacagggtttcaccatgttagccaggctgatctcaaactcctgacctcagcccatccgcccgccccagcctcccaaaggtctggggattacgggtgtgagccaccatgcccagcccagttttattttttgttgttgtttgcttgttttgagacagagtctcactgtctcccaggctggagtggagtggtgtgatctcagctcactgcaacctctgcctcccaggttcaagttattctcatggctcagcctcctgagtagctgggattacaggcacctgccaccaggcccagctaaattttgtatttttagtagagatggggtttcaccatgttggccaggctggtctcgaacttttgacctcaggttatccatctgcctcagcctcccaaagtgctgggattacaggtgtgagccactgtgcctggcctagttttttttgttttttgagatgggatcttgttttgtcacccatgctggagtgcaacgatgcaatcatagcttactgcagtctcaaactcctggcctcaagtgatcctcctgtctcagcctgctgagtagctgggactacaggcatgtgccaacacgcttggctaattaaaaaaaaaatttatagagacagggtctcactgtgttgcccagattgatcttgaactcctggcctcaagtgatcctcccatctaggcctcccaaagtgctgggattacaggtttaagccactgcacccagcctgtttttttgtgctaataagtagtgctgagatagacatcttttctctgtttggggttgtttccttaagatggcttcttagaaatagatttttaggtaaaaccttagaacatttttatgggtcttgaaacactttttcttttggtcaaccaggttatttgaagcagacttctgactctgtgccacttttccagttctaaaacatgtgtgtcgactgagttgaaagaagcacacatgcagctcaggccagaggtaatgggtggtttaaaaaaggaggaaggtggagaacctaggcctctagagaacttggcagtttcaggctacacttctgtagaccaaattcattccttaattcacagcattcgtacgcatgacattcttcaaatgcagttgtgtacttaacaatcctaattccctattttttttttttaaagacggagtcttggtctgttgctcaagctggagtgcaatggcacgatcttggctcactgcaacctccacctcccgggttcaagttattctcgtgcctcagcctcctgagtagctgggattacaggcgcctgccaccacacacggctagtttttgtatatttttagtagagatggggtttcaccatgttgaccaggctggtcttgaactcctgaccttcagtgatccgcctgcctcggcctcccaaagttctgggattacaggtgtaagccaccgcacccgccctaattccctacttttgaagtacacattattgtttatgaagcatcttcacatacagtaatatattttatccctacagtgccccattttacagatgaagaaatggaggaccagaggggccagaagtttgttcagtatcacacagttaggaaatgggtcttaaaggtagcagatctgatgcctagagcagtatgctttccacagtccctcagctgctgctgcctggctggcagcccaggcttcccagagcgtagactcccactgtgaatgcctgaaagctcaggagagtctccgcatgcaccacgctcggtaccagttcaagactgaagttggctggagagtctctgggcccaagagctgccttgggagtggggacagattttttttttaaacctacgtaaaaaggttagttagatatattgctgatcttcagttaattactgccctgcaacctggggcaggggcctcactctgcatccagtttcaaatctgagacctgggtttgctcaaattcagttcaaactggtgacatagcagcctgcattcagaaaggaataggtcttgtaagtatcaacaacagaaccaaagggacattattgtgttaatccttctgggcgtactcacagcccaggagagtttctgagattgtatgtggtgtcctctaaataaataggattgtttttcaacagagaattacaatgtttagcttctggtgaaataatattattcttttaaagtgttagtcactcctggtgctttttttttttttttttttttgaaacagagtttcgttattgttgcccaggctggagtgcaatcaatggtgcaatctcggctcactgcgacttccgcctcctgggttcaagcaattctcctgcctcagcctcccaagtagatgggattacaggcgtccaccaccatgcccagctaatttttttttttttttttttttttttttgtatttttagtagagacggggtttcaccatgttggccaggctggtctcgaactcctgacctcaggtgatccacccttcttggcctcccaaagtgttaggattacaggcgtaagcctctgcatccagctgcttttttttttttccccctggagacagaatgataacggtttggctgtgtctccaccgaaatctcaacttgaattttatctcccagaattcccacgtgttgtgggagggacccaaagggaggtagttgaatcatgggggctggtctttcccgtgctattctcatgatagtgaatgagtctcatgagatctgatgggtttatcaggggtttctgcttttgcttcttcctcattttctcttgctgctgccatgtaagaagtgccttttgccccccaccatgattctgagacctgcccagccatgtgaaactgtaagtccaattacagcttacagccttccccagagtaatcactttgagaagcactttcatttggaggactaagtcctaacctggttgttaaaaataattaggctcagtagttttgtcatccctcctcctccatagttgcttccccaggacacagtttttctaaaacttgaccatacctagtgttgaatccatagtaaggagaaatgttatgtgtgcatttcattgcagtgacaattaaaaacaataataaccaatcagagtaatgagaagtatatgaaggcggtttccaaagtgtggttcaggaacccctgggggattcatgagccctttcaggaggtccacaaaggcaaagctatttccataatgatactcaaatgttatttgtcctttccatcatcattctcacaagtatatagtggagttttccagaggctaggtgatgtgtgatgacatcattcctctggcagcggctcacctaatggaaggtgtgttgtgtgtctttttaaagaacagttttattgacacaccatccaattcacccaatcgagggtacaattcagtggtgtttagtaatatttacagagttgtgcaaccattaatacaattaccgttagaacattttttatcacccccaaaggaaaaactacctattagcagcactcctcaattgccccaattctcccaggcctaggcaaccacttaccgatttttttttttttttgagacagagtctcgctctattgcccaggctggagtgcagtggtaggatcttggctcactgcaacctccacctctcaggttcaagcaattctcctgcctcagcctcccgagtagctgggattgcagtcatgcaccaccctgcccagctaatttttgtatttttagtggagacagggtttcaccatgttgaccaggctgatcttgaacttctaacctcaggtgatccacttgccttggcctcccaaagtgctgggattgtaggtgtgagccactgcgtccagcctcaaatttctgtctctataaatttgcctattctggatattgcatataaatagaatcatacaatatgtggtccttcgagcctgacttctttcatataacattgtgttttcatttatgttgtagcatatatcagtacttcatttctttttttgactaactcataattcaattttatggctatactacattttatttacccatttgtcagctggtggacatttgggttgtttctactctttggctgttatgaataatgctgctgtgagcttttatgtacaggttttatatggacatgtgttcatttctcttcggtattacatatatgagtggaattgctgggtcacctggtaactctatgtttaacttttttgaggaactgccagactgcttgccaaaatggctgcaccattcccgccagcagggtttgatggtgccagttgcttcacatcctcatcatttgtgattacctcctgattctagccatcctagtggatgtgacatggtgtctcattgtggttgtgatttgcatttctctgatgcatcttttcatgtgtctgttggtcatctgcatatcttctttggaagaatgtctattcagatcctttgtcagttttaagaattggattatttttctttatatattcttttgaaatttaattattttttcatgtatagccttccaatgaattgtctttatatattttaagtacaagtcctttagtagataaatgattgtaaaaaactttcctagtctttgggttgtctttttcactttcttttttttttgtgagatacggtcttgctctgtcgcccaggctggagtgcagagtggtgcaatatcggctcactgcaaccctggcctcctgagctcaagcaatcctcccacctcagcctcctaagtagctaggactataggcatgcgccatcagactcagctaatttttgtattttttgtagagacaagatctcactatgtagcccaggctggtctcaaactcctgagctcaagcgaacagccaaccttggcctcccaaagtgctgggattacaggcatgagccaccatgcctcgccctttttcacttacttgatagtgtcctctgaattacaaacatctttaattttgatgatgtccaaattatctttttttcttcttgtgtttatctatttatatgtttaaaaatttctcatttatttttatttttgagatagggttacactctgtcacccagactggagtgcagtggtataatctcagctcactacaacctccaactcccgggttcaagcgattctcatgcctcagcctcccaggtagctgggattacaggcgcacaccaccatgcccagctaatttttttttgtatctcttggtagagatggagtttcaccttgttggtcaggctggtctcgaactcctgatctcaagtgatctgccttcctcggcctcccaaatgctaggattacaggtgtcagccacctcaccagccatttttagcttttttttttcctttatttctcagttttaaaccacaatgtgatatcactgcacagctgtcagtatcgttaaagtaaaaagtggttggctggatgcagtggctcactcctgaaatcccagtactttgggaagctgaggtaggagggtcgcttgaggccaggagttcaagaccagcctgggcaacaatagcaagaccccatctattaaaaaaaaaaaaaaaagccaggcattgtggtgtgtgcctgtagcctcagctgcttgggaggctgaggcaggaaggcgggaggcttccttgaacccaggagcttgaggctgtggtaagccatgattgcaccagtgaactccagactccagccttggcaaaagagtgagatcctgtctctaaaaaaaaaaaaaaaattgataacaccacatggtgtcaaggatacaaagaaaatagatcattcatatattgctggtgggaatgtagaatgatccaatcactctagaaaacagtatggcagtttcattccttcttttttaaacagctttattgggacataattcatatactgtataattcaaccacttaacatagactgggagtttcttataaagctagataatgtgtttatcatatgacccaccagttgtcatttggtaatttatccccaaagaaatgaaaacttaacattcatacaaaaacctgtatgtgagtgtcattacaacttttattcttagtagctcaaaactagaacaagcaaaatgttctttagtgggtgaatggtgaaacaaactgtagtacatgcataccgtagagtactactcagcaatcaaaaggaatgaactatttttctttttttttttgaaacggagtctcactctattgcccaggctggagtgcagtggtgtgatctcggctcactgcaacctccgctgcccgggttcaagtgattctccttcctcagcctcctgagtagcagggattacaggcacatgccatggtgcccggctaatttttgtattttttgcagagatggggtttcaccatcttggccaggctagtctcaaactcctgaccttgtgatccacccacatcggcctcccaaagcgctgggattacaggcgtgagccaccgcgcccagccaggaatgaactattgatgcgtgcagcagcctggatgcatctcaaggaaatgatgctgagtgagaaagcagcatatgcagaagggaacatactgtacgattctgcttccatgacattctggaaataacagaattatgacagtggagaacagatgagtagttgccaaaggttagtaaggggaaggggatgtggttataaaggggtgacatgaaagatccttgtagcagtggcatcatggtaccttctgtatggtgaccgtggcagtgctcacatgagtctgtgcatggggtaaaattgcatataattaaatataggcacacagaaatgaatacttgtagaaatggtgaaatctgaataagattggttgactttgtcaatgtcattcacccagttgtggtattgtactatagttttacaagacattaccattgggggaaactgggggaagagtatatagtatctctctgtgttctttcttacagttgcacctgaatctaccattatctcaaaattcaaagtttaaaattaagaaaagattcctctattttattttatattttattttttgagacagagtcttgctgtcacgcaggctggagtgcagtggcacgattgtggctcactgtaaccttcgcctcccaggttcaagcagttctcctgcttcagcctcccaagtagctgggactacaggtgtatgccaccatgcccagctaatttttgtatttttagtagagacggggtttcaccatgttgaccaggctggtcttgaactcctgacctcaggtgatctgcctgcctcagcctcccaaagtgctgggattgcaggtgtgagccaccgtgcccagctttcattttaaatttttattttatttatttatttcactctgttggccaggccggagtgcaatggcgtgatcttggctcactgcaacttctgcctcctgggttcaagagattcttgtgcctcagcctcctgagtagctaggattataggtacccgccaccacacccgactaatttttgtatttttagtagagatgaggttttaccatttggccaggctggtctcaaactcccgacctcaggtgatccgcccaccttgtcctcccaaagtgctgggattacaggcatgagccatcgcgcctggtcacaattttaatttttaattcagcaaatacgaataaataaaaccacatcaaaaaataaaaataaaaaagatctgcagactctttagtaatttttttttttttttgagacagggtctcactctgttgcccaggctggagagtagcagcacaatcatagctcatagctcaccgcagccttgacggcccaggctcaagcgatcctcccacctcagccttcttagtagctgggactacaggtccatgccaccacaaccagctaatttctaaatttttttgtagagatggggtctccctatgttgcccaggctggtcttaaactctgggcctcaaacagtctcccacctcggcctcccaaagtgctaggattacaggtgtgagccactgcacttggcctccttagtaatttttaagaatttgaagatgaaaacatttgggactccatgctgaatgctgtatacacataccccagctgtgtggtgtgtacctggctatatgatggcacgactgtatggtacacacctcagctgtatggtacatacccccgactgtatgatgcacaccccagctctgtggtacacaccctgctgtgtggcccatacccgggctatatggcccagtggccaagtgaatggactctagggtcagattttaagtttgaatatggctctgcctgttatttttggtatatccatgtggaggttatttaacctttttgtgcctgttttcttcagttgtaaagtgggcttcctagcagaacccatctgggagggaaagtgaagattaaatgtgatcgttaatataaagcatagtacacaatcagtattcagtgaatatcagttacaattaaggaaagcaacctgggctaagggctaggacatctgggtacttgcaggctgggacatctgggtacttgtcctggctttgtccttaactctcagtgtgaccttggtgagccccttccctgcctgggccaccatttcattttccgtgtgtgaccaagctaccatccagtggttctctctattctgatgtcctgagtcagcgcagaaccagggaagatgtcatcaaggtgacttgcacctggattggggacttttctgcttccgtccacgtttcctggaaatgcaagctccctgagctcctggatctgacctaggagaaaggtgcctccttgcccgtgaggctgccaaggcggagtcacttctttaggccgtgccctgcaggtggcatcggttgagaacccggagcagttgggtgatagggaggagtctggtgtttgcagcggggcttcctccttggttttccttccctctgctccccaggcagcccatttgcttggtgtctgtgatgggtgttttagagtcaggctctctgagctcagctcctggtgctcacactctgtgtggcttgggctcctcatgtaaccttggagccgcagtggcccccgtctgtaaaaacaggattgttaagatgctcctggggctatctggaggattcagggagctaaacccgtggggtgccagcacagggccaggtctacactcacccagcgatggctgttctgtgactcagaaccctttggagtttttctgcctcagcctatttgggcaggtaggttcctctggatgaggaatgccttttgtccccagctagtcccctgcctgacctagggcacaggcagtgagggaaagtgcattttttttttttttttgagacggagtctcgctgtgtcgcccaagctggagtgcagttgcgcaatctctgctcactgcaacctccacctcacgggttcaagcagttctctgcctcagcctcccgagtagctgggactacaggtgcccgctaccatgcccagctaatttttgtatttttagtagagacagagtttcaccatgttggccagggtggtcttgaactcctgacctcatgatccacccacctcggcctcccaaagtgctgggattataggcgggagccaccgtgcccggcaggaaagtgcattctttaagagcctttacgagagttaatttaccttgccctctgtcaaactgttggaggtagattggttccttgttctgtatttacctagcaagtggctcccagtgtttacctaccctaacttccttatagaaacaggcatttattgaatgcatattttctccacactgtatgctgttctagggcgttctctgtgtgctgaggaaaggttaaggtgtggcagaattttattaaggccaagaaaaccgtcagggcttctggttgaaagttgcaccaaggctgtggaactcaggtgaaacagcagaatgtctttagtctaaaaggaaagttctattgagaaggcaaatggaagccatgaccaaaaaggtgactcctgagggacatgctctcctcacacacagtggccatcccagcaaagccgcccttccctccagcacctgcctctgtcctaggcacggtgccctctgacaggctgctgccctgaggctggcccagcctatttgtggctacacccttcccctgactccctgttctccccagctcatcaccatgggctttttttttttttttttttttttttttttttgagacggagtcttgctctgtcacccaggctggagtgcaatggcatgctcttggctcactgcaacctccacctcccaggttcaagtaattgtcctgccttagcctcccgagtagctgggattacagacacacaccaacacgccgggctaatttttgtatttttagtagaggcggggtttcaccatgttggccaggctggtgtcaaactcctgacctcgtgatctgcccgccacggcctcccaaagtgctgggattacaggcgtgagccaccgcgcctggcctgggcttctttttttttttttccaatcctgaaggatccaaaacctgaggggagaggaagggactttagaaaaatctcagctccactcctctctttccttacccctgactcagatcagcagttcccagagtgtcccacaggacacagtacagaaatggggttctgtgggcacgtgttgtccaccctcattcattaattgatttagaatcaataaagggttttttggtttattttttgttttgtcacccaggctggagtgcagtgacacgacctcagctcagtgcagcctcaacctcctgggttcaagcaatcctcccacttcagcctcctgagtagctgggactgcaggcacacaccacacacccggctaatttttatatgttttgtagaaacgggatttcgccatgttgcctaggctggtgtcaaactcctgggctaaaatgatcctcctgccttggcctcccaaagtgctgggattacaggcatgggctaccatgcctggccagaattaataaagttctgagtcgaataagtttgggaaacactgggtttggaactcagctaagttgatttactgggaccctctaagaaggcattaaggcagggtagtgtttctcccaaacgaggctatccatgggacccatttctgcatgttgaactcagctgggagcccgaggagagttgtacatgcctgagctcccttcagactcccacagactttgtgctatggggcaggagggagagaggagtgctgaggctgccgggctgcatggaaccccagatagagggaacccgatagcacggtcggcaggctaggggaagtcaaggagtccctgaagagaaaggggtcaccagttgctgacccagcctgtagtagcccctaggcacagcgatactgtcttagggctgaaagttaggatcttccagattactcagattccctttgcccgatggctctgagtggcagttttctaaatgtccactgggtggcgctggctccccaggaggcggcaaaatgaggcgccccttccctttccagcaggaattggcctttttctttacttgaaaattacagaattccatgcagattttacagcctctgtaggtaagctttcacaaggtgtttttctgcacttgtcccccctccttgccccgatcgctctgcccctctcttgggggggtttctgcttctgtttatgccctggtgggccacaccacactcccacaagatgaacattatacaaaagaaaactcagtggaaggttccttctttaaacagaaagcactctcttcatctgccaaatgaagtgagaagggtaggaaaattagattttattgaaaaaatatatttaaaactgatgttttttcagttctgtcttagggctagttagcagtgttatgagacacaaacaggaaggagtgaggtggaaaggtatggaaggtactgggcatggcagctgaagcttgcaaccccagcactgtgggaggccagggtgggacaactgcttgaggtcaggagtttgagaacagcccgggcaacatagcaagaccccatctccacagcaaattaaaaaaaaaaaaaaattagccacatgtggtggcacgtgcttgtggtcccagctacttgggagactgaggcaggaggattgcttgaccccaggagtttgagaccagtctgggcaacatagcaagaccccgtctctaccacaaaagaaaagaaaaagatggaaggggaaaagagaagagttaaaaataaagcagaggaagagcagtgagaaaggtgaaggaagggaggaaaggaaggaaacggtgggagggagggaggaaggaaagggagagagggagggaaggaaagggaggaaggaaagggaggaaagggagggagggaggaaggaagggagggagggaaggagacaggaagggaggtaggttggttggtccgtcggtccgtcggtcctagaccaatcagagtttgcatttcatttcagcaacttccctgggagagggaaagatttgtgcccatgtgatcaagtgtgagcaactcactaagccctaacttatttctgagtcaccattcagagacattgattttttcgacttttgatttccaacttcaaaacaaaacaaagggactcaagaaaacttttgaaggtgatgtgtatgtttattactcttgtgctgatggtagcagtagtgtatacttaagtcccaactcaccaaattacattatgtgcagtttttagtatatcaattacaccttactgaagctggaaagaaatgataataaaaagtttttgagttcttataatttgacagcaaactgagattttactcttataacttgtgatccactgattccttcagcaagcatttgctgacatttaccaatttcctgagtcttgttgatgaatactagagaaggatgttgaagagcactaaataggtaacctcaagcagtgacgttatatctgaaaaaagtgactgaggttcacttttaagtaggcagcgtgctttgaggcctgaaagggctcgggttgaatgggccctgccagccatggatccttatgtagaggctgggcaaaaaaatgctccattttccccctttcgccaagaattgaaatagccccttttcctgctcgtttggccgagtagaagggaaagcctttgaggctattcatgttttcactgcctggttttctgggtcaggattaggtcatgaccgtttcatgtttgttcatttggccttgggcccctggggcaggtagggtctggccaggggaaaggttcttttccagattcttttttttttttgagatggagtctcgctctgtggcccaggctggagtgcagtggcatgatctcagctcactgcaacctccgcctcccaggttcaagtgattctcctgcctcagccttctgagtagctgggatcacaggtgcccgccaccacacccggctaatttttatatttttagtagagacggggtttcaccatgttggtcaggctagtctcaaactcctgacctcaggtgatctgcccgcctcggcctcccaaagtgcaggcatgagccaccacgcccagcccttttccagattcctgtagccagcaaagaccagcaccaaacgtttgttgggctaatggatgggtggatgcaaatgaatgtttgcatttgaatgaaatgactgagaacaaatctttgcctgctttcaagttgctgagcgtccctctactgcctaagatgaggggtttttctacttgtatgttattccttgcctgtcataacaacagtgtttttggacaatggtgaaaaggagctccctctttgatttttgtagatggcagttgaattcctgcatgaactgaatgttccatttttcaaagttggatctggagacactaataattttccttatctggaaaagacagccaaaaaaggtaagtgtctaatttttgacttaaaatcgaagggagtccaaaccttcatatttttactcccctcatggtggcccactttcagcagatttcatgaagacaaattttagcctcttttcatttttttaaatagagatagggtctcgctgtgttggccaggttggtcttgaactcctggcctaaagcaatcctcccatctcgacctcccaaagtgctaggattacaggcatgagccactgtgccctgccagaaacctcttttcaatcagcctgtacttccattttttgtaagctaatttgaaagaaaatgaattaagaatatgacagtttttataagacatttagaaattctttttaagaatttttttttttttttaatagagacaaggtctgtctatgttgcccaggttggtcttgaactcctggattcaagtgatcctcctacttcagcctcccaaagtgttgggattacaggtgtgagccactgcacctgtcctagaaaattttttaactaaaatttataagaaattaaggatatgacagtatatataaaacctagctgggtatggtggtgcattactgtggccccagctactcgggaggctgaggtaggaggattgcttgagtttgagaccgcagtgggacatgatcgtgtaaagtggttttacaacatgaacaatttcatttgatcctcataacactcctaggactgaaacaggtcatgattatgatgcttgatacttatttcacaggggaggcctctgagactcagagacggacagtactctgcccaggcacagctagaagtggcagctccacacctcacattcattcacactcttgaatcagcactcattctactgtactgccatggtatacaacctattaatcagataagatactcattttcctcttggcagtgtgaaattcctctgcctctttaattcagttccttttgctcaagaacactgtcggggggcagaggggagcccacctttcctgtggccgagggcaggaacccaacaagctcctctctgttcccccacaggggctggcacagtgttttaagagatgtctgtggagttcagttgaatgatgagaccagcagttgggatgtgttggggagagtcagaacctctaaagagaaagtgctgatggtgttggtgctggattactcaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggtgagcaggagggagggggttcccttcttgggccatttactatggggaaggcgtagtcttttttataaccaaaattctaacaaacatggcatactttataatttgaacatcctttgacagtcttgctgttaccaaatcaaattcgagctaagcagttgaggaagcacatacattctaaagagggtgactgtaaatgaaattttcttggccaggcgcggtgggtcatgcctgtaatcccagcactttgggaggtcgaggtgggcagatcacctgaggtcaggagttcgagactagcctggccaacatggtgaaaccccttcttattaaaaatataaaaattagtcaggcatggtgatgcgtgcctgtggtcccagctactcaggaggctgaggcaggagaatcgcttgaattcaggaggcagaggttgcagtgagccgagattgcaccactgcactcaagcctgggtgacagagtgagactctcagggggaaaaaaaaaaaaaaaaaagtctgtctgtcaacagacatttgggatgattttaccttttggctattgtgaatgatgctgctatgaacactagcgtacagataaatattcatcttttttcatactgagttataggaggccttcttgaaacttcctggctttttctgctttatttgctgactctcttattttctaatgctgagcatccctgaggctcatactagttatagtgacagccttgatggaaattactctctcccacgattttgcctactcagtcatttcacagatggtgaaatccagtcccaagtcgggaagcctgagatcccacagcagcttggtggcaaagctggaactagaacctgggcatgtccccctaggcctttgtctcttactgtctcacgccatctctctcagttcttcctgtagcactggaaatttaactttattcgaaaatatgtatgtaattatcattaaaactattatagtaacattaatggaattctatctatctatccacacatactagaatcctgatattgcagttgttttccttttatattttcctttcagtatagtatttgacattgttttccccataatataagctttcttacatgttgttatacagccattaacttaaaaagttagcctttttgaaaactgacattactctctttttacctaaactttctgtccctcccaatcctgtttttgcttcacttacagcttatctaaatcacgttatttttaaaatttaaaaatgatttctgtgaaatatgtaatgtcgaaagtaaacatcccctgcactcccatcccacagagattccgataattaacagtttagtagacgtgaccccagctattttccttttcagtgtatctccgtccccactcaaggtgctgtcatgtcctctctcttgacactacacattgcaggagttattctgccagcctatcccatcttgggcctgcacatagtacagtggtttgaattttcaaacttgtagcaacccgcactccatcacacacccttaagcctggttttcaaggcctttgccacctaaccctcctaatcttttgttaaatcccacctgaggccagacaccgtggctcatgccagtagtcccagcactttgggaggctgaggcaggtggaccgcttgaggccaggagcttgagaccagcctggccaatgtggcgaaaccctgtctctactaaaaatacaaaaattagctgggcgtggtggcgggcacccatagtcccagctgctcaggaggctgaggcaggagaatcgcttgaacccaggaggcagaggttgcagtgagctgagatcacgccattgcactccagccttggtgacagagcaagactctgtttcaaaaagaaataataaataacaataaaataataatacacgctacctgagtctttctactgtactcagctttctggtcaccctcaccaacaagactcacccatcttagagtgtcttttgttgcattcagtgaattatagataacggattaattatttatcattttcaccaaaggattgttttgagattgggctgtgtatattattgatgatatttgtgcatatagcacacttgctttcagcagctcaggctaattaaatgtgacagatggtttttgaatgaggttagacattcatttatagttctgttgttactcttggtgtattgtgcaatgtgaaacattcttaaaatgcattctttagaataacagtaaccatttttagagcatttacaatgtgctgagtgcttctcatgcatttacagcaacactcagcaggtattattatcatccctaggaaagagaggctcagagagcctcagtatcttgcccctggctgcacagctagtgagtggctaaaccggggctcaaccagatacgcttcacctggagaatatgcataaagcagcatgatatttaatgttatttttctttttccattttaaaggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaaggtgtgtcctgccggactctactcggttctgctgccgtgtgtggaaaaaggataggctggcctgagagggatggtcaggaccagccctccctgagccaggctgatgaaatgatcagtgaatgtgctcccacccgtgtcagcttcttcaggcttctcttcagtaatgcatgtcactctggcctgtagcagcagcaggagacacatgttatctaactttagcagtttctctggccacctagggtcacattagagtcttccactaattctctgaagcccatggccccagtactcctagactccagaatatgtaacaggagtgaggccctggaataagtcaagtctgggctcccttggagcaggtaagccctgagaaacatttaggcacggtgttccctgaggtaccagaagagcctgtggcatttcctaagccagggtggcactggtgggaagggcagtgagtcgttgcagaggtgggtgggtgatgatgcagctattccttgtgcaacagtgaccttcagacagaggaactggtgggcctagaagcactgcctggcatgctgactatcagggcttcctggaagccgtggcctggaccttcttgccttctgagtcatagagccaggcaggcatcctggggctgccaggcacacacacacctaacctgtaggctgtcggggtcaaggcaaagaccaaacaccaggcatgcctgggactgttgtcaccttttattctagtggggcctacctgcttccccaaatcaaagatgcatctataccaggaaattaaaataaagtaaaaagaaatagtttctttatagaggaaacaggagagaattagaccagaaaccagagtaagatttataacagctgagcacttaatttggctctctgagcagacagtaaaacataacaggatgcatgattatcacttgacattttttcctggcaccacattccaagcagaattgattccttgtactcttacgtggaggatatagagtaataaaacacgtaatttatttgaaagcatttatagagaagacaaacactggtcatgagcttcaggtacccttcattccctcatctgcctgtattatctgccccttcctcgggggctccttttcttgccatctgcataacagccacattcaccatcttatgagtccttcatatttctattttaccaaacaaagtggcggtaaggtgtgtgccctggagaacggtgtgtcaggagttaagaatctcatccctatgttatgtttcatcttggctgtctgcaaccctggccaagtcacccaccctgtatgggcctcagtttccccatgtttacaatgagatactgagctgaatggtaaccaaaagaatcagagtttgcatgtattgagagcattctatgttccacgtacattctgtaatatcaccaatccttacagtcatctgacaggataagtttccatttgacagagaaactaaaacgtggcctataccccacagactgggatttgaacctggctccgcctacatagcctcagccctttcctttgcactttgttgtaaaggctcctcctctgagtctctgaattcaatctatactggttgaattcctgccatgtatgagatattctgagcagtgtagggggcaacagagtgcctgctcccaaggtactgcctggggaagactgatcagggaccttgagtgtaaagtaaagtagtgtgcactagttacttctgtgaagctggcactgaatgttcattttgtccacagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctctgaattctcagttcccttgctgatgctgtcaggtgtgtttgagtgaggcgagggcaggaatggcggtctccagggacctggctgtcatccacctccacctgctccttagacagcagatgtttctgggctaggccctgtgtcagcccactggagacagaaaaagatccagtgatgcaatctctccttcaagttggccagcttagtgcactggccaacagtgcattataaacagagcaccagaagaaggggtggttccaaacaaagtccatatcctccagttgctgggtggctgcagagaggggtgagagctggctgcacatgtcctttcctttaagccttcattctcacttccttacagccctttacttctccattgtctttatccctttcctgcccttggcctctgtgtttagttggcattgtatagcagtcactccacatcagagaaaggactggtcaaaggatcttgtaggcagaaaatgctgaaagcactcctttcagagcaaagagagggaaatggcatgtgttccttctctgaacaaatattgagggccatctttgtgccaggcactgctttaggcacagagtatatggccatgaacaagccccaatcccttcctcagagaacttccattcagatgggggcagatgcataaaaatccatagcatagtgattcagtcacacaatatgttagaaggtggtatgtgagccaggcgtgcttgtgtgagcctgtaatcccaactacttaggaggctgaggtgggaggattgcttgagaccaggagttcaagctataatacgatcttggatgggaacaggtgggagtcagggtttgtttacacgtaagtgagaactttaatgagttatcttcagaagcagtgaatgccccatccctggagatagttaatcagggagcagctgactactaccagaaggctgcgtaaggaataagatatgagtaaaggcccttctgggtctgggtgctagggacttgaagcaacatgaactggagggagctgtgatgtggacacgctgaaatcggtggggaggaagcggaagattcaagggacctcaagagacagaagagtcaggactggatgactcccattcattcacaaatgtttactgtgtgcctactatgtgtcaggttcctgtgctgtacgagggagaaggttcccaggctgcggatgatgtattcaggatgctgagggcttacctgtgggggtatcactgggtgctagggacttgaagcaacatgaactcccagtgaagaccatggttaaaagggacattattcacattttattaaaccaaatattagaaaattgctgtcatttaaaaatatctgcaagcaatttgccatatcaataaagaaatgtctacagattcaagtctgaaagagaagaaggtaagtgatcagtaacccttacagacatggaaaccaaggaagcctcattcctgtgctgagaatattctagtagctcctgctgctgccacatggcagctgggaataccagtagtctcagcactcggtcagtaccgtgcaagctcccttgggaatgctgataaatcctggcatgatacagcagtatatatgttttttttgttttttttgagacaagagtcttgctctgtccccaggctggagtgcagtggtgcaatctcagctcactgcaatctccgcctcctgggttcaagcaactctcttgcctcagcctccctagtagctgggattacaggcatgcaccaccacgcccagctaatttttgtataggactatagttttaaggcaagtttataacctttggctcatttgagcctcacagcacttggtaggtagtgctattatccccattttatagatggcactgagaagtaaaaagtgactagccctggtcacacaattgatatggactgaaactgccgctttctggctatcacgggccttgacacagctagtttgtgacctttacagtctagct

SEQ ID NO: 15621 - DNA, 24280 bp, Human
atttaatagagacagggtttcaccatgttggccaggctgatcttgaactcgcgacctcaggtgatgcctctgcctcggcctccctaaagtgttgggattacaggcgtgagccaccgcgcctggtgacccctaggttttatttatttatttattgagacggagtctcgctctgtcacccagggtggagtgcagtggcgcgatctcagctcactgcaacctctgcctcccgggttcaagtgattcttctgcctcagcctcctgagtagctgagacaacaggcatgtgccaccacacccggctaattttttgtatttttagtaaagatggggtttcacagtgttagccaggatggtctcgatttcttgacctcgtgatctgcctgccttggcctcccaaagtgctgggattacaggcatgagccaccgcacctggccggttttatttatttattcatttattttttttgaggtggagactctatttgccacgcaggagtgcagtggcgcaatctcagctcactgcaacctctgcctcccggtttcacgctgttctgcctcagcctccctagtagctgggatgacaggtgcacgccaccacatctgtctaatttttgtatttttaggagagatgtggtttctccatgttagcccagctagtctctaactcctgacctcaagtgatccacccaccttggcctcccaaagtgctgggattacaggcgtgagccacctcgctcaagcacccttaggttttaaagtttaaccttggggtgtttaaattttgcagttagatttgctaggtagtcctgggtattttgggaagttcttgttttggcagcatgtcagactttatccttgatgcttgggcctttcaggtttgagcctgctctgctggctcggaactagtttagtcggaaggggctggcagttgcctgtagggggtagattcatctggtgtgtattatgctgatggggttttttggttgtttactcatttggaagatttcagtatggaccagactgtttgtgtagagtgggaattgagtaggttggagtcggcatgattctgagaccgaaatagtaattatggcttcgtttgtcctgaaggattctgtcgtgcacttcagttgtctcagcctcttcagagttgaacgtgatgtggttgtcatcgtccacctgatatttcaaatgttcacttttcgggaggttctttctttttcattttacagaagccttttgggaccctttgtcatatgtctttcttccttccacctcttcattaccatcagaggtcagagctccttccctctcttttccttccccaagcaccaagattttgatgtgaacatctttttttttttgttttttttttttgagatgaagtcttgctctgtcacccatgctggagtgcagtggtgtgatctctgctcactgcagcctccgcctcctgggctcaagcgatacttgtgcctcagcctcccgagtagccgggactacaggtgcccaccacgcccggctaatttttgtatttttagtagagatggggttttacagcgttggccaggctggtcttgaactcctgacctcaagtgatccacccatctcagcctcccgaagtggcaggattacaggcgtgagccactgtgcctagcatgatgtgaacatttctacctgtagtgttttttggagagctgttaatattttcatacttgtaaaaatgggcatatttatgtaaaggaagataaaagaagtaaaataccatctgagtggcttgtgggcctgaagtcagttctggcttctagaaaccatctgttttcatttttagggtgttacgtagttaatgccttggcttagcagtggttacttggaaataaagatgtgtcctgctgtgttgacaggcccttcatgaggcagcacacatgtcattcttgctactgtgtacctagctgctgaaatgaatcctataaattatatgaaactaaaaagattttctgatcttatagagttgaagtattgataacaccaaggaactctatcacaatttgaaaagataagcaaaagtttgatttccagacactacagaagaagtaaaaatggtaagtttgtttttgatcacagatactgtttcttcactcatgtacagagatgtttgtagccttttccaaagcatttgcttccattaccatttttattagcccttttggattataaagcaatattatctattctgtattccattctgatagtgtaggaacgaagtcagtgccccattactcccactgcccagagacaacagcttttcagtttgcttgtccctccttggttcttcagttgtgctcctgcaggctttgcttttacacacgagcgatatagcatcattctgaattgtgcagcttaaaagatgaacgttgggctgcttgctctctttacatcatttttaacttaattctcacatccctagcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctgggtaagtgaggttttccgttgtccttttcttttttgtagggtagccagggtagaggttggcacctgttttctaagaaactccagcctctctggggacctctgggttgtggtcagactgaattcctcactgagctgggtgttggtctgtccctcagggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgtaagtgtggccaccactgccgggtaggtgggtgggggggtggtaggcatgctgattgaggatgtggggcccaggaagaagtgtcctgctaggctgtgctccaagaagcacatgccacacttgccctggcacttgctgtgcgtgtgccttctcagtaggtgacaaccaggacaccaccaagccacagagattctgtggaacctgactgcaggggtcataaggaccccgtgcctattgtgtgccaggctgcaccagcccgaggtcattgggcataaacttcacgtctaggctccattggatggatggctagatagatagcagagttgttatctcttccattggatccaaagctgaatgtaaagaattttttttttcttttgggacggagtctcgctctgttgcccaggcctagagtgcagtggctcgatctcagctcactgcaacctctgcctctgaggtagacaattttcctacctcagactcccaagtagctaggattacaggcatgcaccactacacccagctaatttttatatttttagtatagacagggtttcactatgttggtcaggctgtcctcttaactcctgacctcaggtgattcatccacctcagcctcccaaagtgctgggatcacaggcatgagccacctcgcccagctgaaaatcttttctatatgtttattttttattttataaatagagatgggttcttgctatattgccctggctggattcaaactcttgccctcaagcagtcctcctgtccccagcctcccacagtgctgggattagaagtgtgagccaccacaaacaattttttttttttttttttttttttttttgagatggagtcttactctgttgcccaggctggagtgcagtggtgcagtctcggctcactgcaacctctgcctcctgagttcaagcgattctcctgccttagcctcccgagtagctggtattacaggcacatgccactacgtccagctaatttttgtatttttagtagagatggggtttcgccacgttggccagagtggtcttgaactcatgacctcaaatgacccgcccacctcggcctcccaaagtgctgggattacaagcatgagccaccacgcctggccgtttttatttttttaagatgaggaaggtttcgctctgtagcccaggctggagtgtggttgcgcaattatggttcactgcaacctccacttccagggctcaggtgatcctcccattgcagccccctgagtagctaggactacagtcatgtactaccaccccgagctaaaagatcttttaaaaaaaaaaaaaacatttatttgtttcattgtgaaagtattgcgtaaataatggcttctgtttattgagtgtttgctaaagtcaggccctcagccagatgtgctcttcatgtgtgttatttcatcctcctctaagtgggacagatgatgtgacagagctgcagggcagctgaggagtggatcccaagacccacggctgggctgtttggaggcatcagaacctctgccagctgttgcctcctcaggacacagtccccctgaatttatttataggataagcaaaaaagaagtgtacaatcatctataaatctttgacagagtcttgctctgtcatccaggctggagtgcagtggcctgatctggggtcactgcaacctctgcctccctggctcaagtgtttctcccacctcagcttcccaagtagctgggactacaggtgtgtgctaccacacccagctattttttgtattgtctgtgtgtatgtgtgtgtgtagatacgaggttttcccatgttgcctaggcagttcttgaactcttgatgacaggcctgagccaccacagcctttgaatctttgaatcttattccttggaaagaaaaacctgatttactttcacaatgcagatttgtgttctttcacatgggactgacgattttgggttcaggacaaagatcaggattaaaatacggagctaatgtaaatgcattagatacttctgcggagctattgtagatgaagctgtgaaatttttctagtgacaattttctttttttttctcctgaaggtacatcagcatagaggtaattccttttcttttttgaaacagtcttgctctgtcacccaggctggagtgctgtggtgcgatgttggcttactgcagcctccgcctcctgggttcaagtgaatctcctgcttcagcctcctgagtagctgggattatgggtgcccgctgccatgtccagctaatttttgcatttttagtagagaccatgttggccaggctggtctcgaactcctgacctcaggtattatgcccgtctctgcctcccaatagttctgggattacaggcgtgagccactgtgtccggcccatagtggtaattttttggcagaggggggtgtgggggcgggacagagtttcgctgttgttgcccaggctggagtgcagtggggcgatctcagctcactgcaacccccgcctcccgggttcaagcgattctcctgcctcagcctcctgagtagctgggattggaggcatgccccaccacgcccagctactttcatgtttttagtagagatgggttttctccatgttggtcaggctggtctcgaactcccgacctcaggtgatctgcccgtcttggcctcccaaagtgctgggattacaggcgtgaaccactgcgcccgtccatagtagtaattcttaaattaactttattcttgtctctatctagcaaggatattaagtgaagtaaattgtcataaatgtttctacagtaaaaacatttgtgagaaaccattcctttttttttttttttttttttttggaggtggagtctcgctgtgtcgcccaggctggagtgcagtggcgccatcttggttcactgcaagctccgcctcctgggttcacaccattctcctgcctcagcctcccgagtagctgggactacaggcacctgccaccacgcccagctaattttttgtatttttcgtagcatctctggtctttaccaggtgaagtttcatctgtgttagccaagatggtctcgatctcctgaccttttttttttttttttttttttttaagggaggcaaggtctcttgctctgttgcccaggcttgggtacagtggtgcaatcacagctcactgcagcctcaagcaatcctcccacctcagcctcctgagtatctgggaccgcaagcatgtgccaccatgtctggctaatttttaaaattttttgtacatacgaggtttcattatgttgtcctggctggttttgagctcctggccttaagctatttgcttgcctcagcctcccaaagtgctgggattacaggcatgtgccattgagcctggccaataattattccttaaagatgaaaataataggtatttttaaaatcattttcagtggttccttaagaggggtgaatcactctcctcccctgataacatttggtagtgtctgttgacaatgcggtgttggggtgctgtggtgctgtcagcacctgataggtgaagaccagagatgaacaccctatcatgtgcagagtagtccccccaaccaagaattatccagcccagaaggtcagttgtactgaggttgagaaatcctgtttcagatttttcaatgtatttattctcctcccaacatatttacttaacttccttcagcttgaattttcttctttctttgttttgttttttttttttttttttttttgagactgtgtcttgctctgtcccccaggctggagtgcagtggcacagtctcagctcactgtagcctccgcctccccgcctcagcctcccaagtagctgggattacagggcctgccaccgtgccgggctattttttatatttttagtaaagacaggatttcacaatattggtcaggctggtctcgaactcctgacctcaagtgacccacccacctcggcctctcaaagtgctgggattacaggtgcgagccactaccctcagccaaaagcttgaattttctttgtcaagtcataagaaggtggtatcaagaatgaaaatagtcgtgagtgtccttgtagatgtgcatttgcagcaagtacatacgtttagatgcaccataggatactgcacactgactgtttcactgcacacagggtttattctacactggctgctcatcccagcatggaagtagcagtggctggatgcccactctgcagtgtccaccgctttccccgcagcgtctgtttgaggcttccagcagccttgtggtgtagttcgtgtcattaagtccattatacagattagagtctgtatgagagtgatttatccaaagttgatcaactactaaagggcaaaaggggggtctcctcctcctggctcctggatccgaaactctttgccattggttttttttttggagactgagtctcactcttgtcacccaggctggaatgtagtggcgcgatctcagctcactgcagcatctgcctccctggtttaagcgagtctcctccttcagtcttctgagtatctgggactacacgcttccactgcacccagctaatttttgtatttttagtagggatggggtttcaccatgttggccaggttgatcttgaactcctgacctgacctcagctgatctgcccactcagcctcccaaagtgctgggattacaggcgtgagccacctcacctggcctaacattgcttttttgtttgtttgtttttttttttttttttttttttttttggtttttttttttttgagacagagtctcgctctgttgcccaggctggagtgcagtggcatgatcttgcctcactgcaagctctgccttccgggttcacgccattctcctgcctcagcctcctgagtagctgggactacaggcacccgccaccacgcccagctagtttttttgtatttttagtagagatgggatttcaccctgttagccaggatggtctcgatctcctgaccttgtgatccgcccacctcagcctcctaaagtgctgggattacaggcgtgagccactgcacctggcctaacattgcttttttgtttgtttgttgttttgtttttgtttttgtttttgagatagagtctcgctctgtcgcccaggctggagtgcagtggtgtgatctcagctcactgcaagctccgcctcccgtgttcacgccattctcctgcctcagcctcccgagtagctgggactacaggtgcctgctaccacgcccggctagttttttgtatttttagtagagatggtgtttcaccgggttatccaggatggtctcgatctcctgacctcgtgatccacccacctcggactcccaaagtgctgggattgcaggcatgagccacggctcccagccctaccattgcatttttaagcaccgtttggaaatcgcttctttcactagttatccctctttcaagtacccaaaacgtggccaaagacctggccaattagagagaccctgacatcccaggtgaaatcacttccgggtcatcatactcaagaggttggcctttctgttgcaggaataggtggagccagataaaattgttgattgctttgaggagaaagtgttttgaaagttgcattttattttttaggctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggaggtagggaggccgagacacgccggcaggactttgaaaatgtggtgttccctcactattcaaatgtgctattcagttttagactgctttggtatacggtgtagattgaccacctttactctgagatcacatctcccgttggctttgagtacttgggagtttgacaaaacagtcgcactaaaagtgagtagcacttttcataggggactgcaccattttcctttatcttcatccttgaacgttctcaaacatgaatgtggaagttgcttttctatggagccattctctggctgtggagaagtgtccctggtgattccatggttttaaagatgagacaaccagatggtttctgcatgagcaccacgttggagtttaccaacagcctgtgctgcagctgagctgagggcctcttcgtttgtcctctgtcatggctcttttatcatttaaagtgacagaagcacaaagagctgatacagagttttggataaagttttaaactgttgtccaatttttcaaaccacatcattggacctcacgctaataatgtgctcgcagtccatggcccgccgctcgcatgcctgtcttcaggccttatccaaacccctggtgtgcagatggcagagaagataaacgctctgcttggccgcagcataggctggcatagcgcccttgttgctgtttacctttggttctcatagctgattccgactaccaaagcccttctagttgatcaacgtagggacgctggacctttgaccaacaggactctctctgtcaagggctggggctagggcagtcccgcctggtgggcggagttggtcccctttgctgcagatgccttgggatggctgttgtgtgatgcagagagggagttcatttcctctccctcggcctttttaaattttttcctattgaacattttagcatagctaatttattgggagaacatggggaggaggcaagggaagaggattagaagataggctccacctatctctcccctccctcatgagattattccttttagaataactccccacttttgtttttatgtttgttttattttttctttttctttcttttttctttttctttttatttttggagggggcctccaatttttacaatttcctcacagggcagagttgaatgtgctctagtttctccttccctggtccagggtggagatgaattcagcttctgggaaactcagctgccctttagaaagctgccacatcccctttccacctgacagaaaccccttggtcaaactgtgccttgtcttcttattccatccatgaatagaaacgctatcagtcaacgaccccccggacgttctggacaggcagaaatgccttgctgccttggcgtccctccgacacgccaagtggttccaggtttgcattttgttcttctatttgtcttttggtagagaattcctaagttttaacttggctaactgtcaccataaagattccttaacattgacgatagccgtgccgagcttagcacctgcagctgcgcaggtcctaaaggagtgcacctcaacaaattcgaccccaaaagaggctgagactgagttggtgggctgctgctgctgctgctgctttgtgttaagagtaacactctcttgtacacgtagtgacattgcggctggccacagccttggtggtcgccagtgttgactgtttacccttggcaaagcagcaacctgacacttgtgtcgttcatgttgacttgtgccctgggcggtgcctcagactgaagagcctgtgttttgttcccctaggccagagccaacgggctgaagtcttgtgtcattgtgatccgggtcttgagggacctgtgcactcgcgtgcccacctggggtcccctccgaggctgggtaaggcatgttgctgtggctactgggggtggtgtgtgcagagtcttttggatatcccaggaacacttgatggtcacggggcaggagtggcctcttgacgcgtggctggtgtgtactctccagagctgcctgtggagctgctcctgcttgccacacctggggttggggttggggcagtgtgggtcggggccctctgcagggtcgcacagctcaatcccaggagtgggggctgaccaggaggtgggaatgatccctctgggaaggtttgtagatactctcacgcaggaccagttcttggcagttgcacccttttttttttcagcttgcagttgaggtggtttttatatttgtaaataaatggttagattttaagtaagaagtactacatcataaccttagcttggtctctgagctcacacagcctgctaggatgtcatgtctggtccttgaaggcccctgtcctagatgccctggctcaggcttagccctgaggctttgactttacccgactggttggctatgagtcccacgtgtgccccgacccactcatgcagtgacagctccccagtggcggccggccccatcctgtaggctcttggctcactgtccctcttccctttcagcctctcgagctcctgtgtgagaaatccattggcacggccaacagaccgatgggtgctggcgaggccctgcggagagtgctggagtgcctggcgtcgggcatcgtgatgccaggttggggccttgtgctttgcaggttgcagggaaaggacagggttccaggccgcctcctggcgggtacactgactgggttaggacagcagcagccccgtgtccaccccctagagctgaagcatgtgactaccctctggcaccatcatatccagccctgaccgggtccgcagccgtcattcagagggcggatccggggcagtggtgacccactcccacgtgactttcttgctctgagacacttgtgaattatttctgtcaagggctggacgccgagtgggtcaccgagctaggcatgttttccagagctgggtgtggatggggcgcggggggtaacacacctagttccctcagccagcacacctcttcagagatgctaaaagataatcctctgcatatcttccttgtttcctgccttcagatggttctggcatttatgacccttgtgaaaaagaagccactgatgctattgggcatctagacagacagcaacgggaagatatcacacagagtgcgcaggtatagtcatcgccattgccaacgtgcgccctgacccagtctgtaatcactggcttccagttccattactgggtattcccagggtagcccctggactcgtaggctcaggtcggggactgaaggcaaaaggattgtgtctgatacagggcgccccaatctgggctgcttctttcccctggtgccatgcgtggttttcatctgccccctcccttggcttgctcgagtgccgttttcagacactgtgagtggtgctgggagatgtgtttgctgtgcggactgctccggggggaccttcccctgcaggcccccacatggctccgtgtggcaaccagtccccaggttggggtctcctgtattcctttggaaggggggtggtcacaggctggccttcccccacagcaaggctgggcttgagcagtcaggctctcccctggctggtgggggaccccttgctgtcgtaagggagaccattagcagcccttcagctctgcccctcctcagaaggcagtagtgagcacacactccatggccgggagcacagggcagctgagtcagagcctcttccccttctccagcacgcactgcggctcgctgccttcggccagctccataaagtcctaggcatggaccctctgccttccaagatgcccaagaaaccaaagaatgaaaacccagtggactacaccggtaagcctgcggcggttgcctgatggctggggctccaggaagagtcaccatctgcatctcccagccatgccctggtctctccttgcagttcagatcccaccaagcaccacctatgccattacgcccatgaaacgcccaatggaggaggacggggaggagaagtcgcccagcaaaaagaagaagaagattcagaagaaaggtacaggccgggcgcggtggctcacgcctgtaatcccagcactttgggaggccgaggcgggagaatcgcttgagctcaggagttttgagaccatcagcctgggcaacatggcgaaaccccgtctctacaaaaaatacaaaaattagctgggtgtggtggcgcacctgtagtgccagctacttgggaggctgagatgggaggatggcttgagcctgggaggcggaggttgcagtgagcaactgtactccagcctgggcaacagagcgagaccttgcttaaaatcagtgttgaaaaattttagaagctaaataggtaaaaaagcaggaaggtgcagacctccactagtgctgctgctttatccatctggtcctgtgaaggctcaccctgaagctatgggatggctgcttttgtttcatttttctcacttgtgatttctgagtccttttaacaatgatgaggcatgattggggatgtggaagatgagtaggatggtggtgctacagctggaggccacaggagaggtgcaagctgggctcagtttgtgtggctgccccacccactgtgttacgccacagaggcagccctgggggttaggattggcagagctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgagtgtggccagcatcactgtcttctaatagcagaaccatggtctttgttttgggccccttctgagccattgtctctcagggagggcatgtagattctaaaaatacacatggttagatggcgagtatttgccaagtcacgtggcaagaacgccttcccactgtggctggcaggcagaggggtccccaaacatgattggggcattagggcctcctgggagcaggagctgaaaggaaacagccctcctccagatggcttcccgggtgggtgcctgtaggccatgaggaggccctgcatgcagccctgcttcactgggaccttgggggtcttgccacctctgcaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgaggtgagcacatggtgggcgctgggagtgactgcctggacagagcaggcagccatgtgtcctgtcagtgaggtggttactggtccttgttaatttgccccaaaaagtggacctttcaggccagaagtccgcacaggaagctgggtgctgccctccgagccgtgtcggggagggccttgtggatgttgtcccagcatcctataggctacactggggtggccttgggttgataacgtgctgttcagaggggaggcacaggaagggggcacattgctggaaggccctcactagagtcagtggagactctggcaagggctggcagtgtatgaagagcagaggccctgcctcagtcctgccactcctcccatgtggctggaatgcccatagctgagtttgtcggtcttcttttctgttttccctgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtgcgcagcctgaagctgcctgctggggcagtcccatggggaggcctggggtccccctgcccctggagggaggcactgagtcatctccatctgcactttccaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaaggtgagcagtggcccttgaacctccttgcccaggcatgggttcttctgcaatgtgagcacgaagggaatgtcacttccctgtgttctcttctagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtaagggccctcatactgcactgtccccgccttccccacgtgcatgctctgggaacaaatgtgtggggctcctggggtgggccggagacactgctggaccccggtaaccctgtctttccctttccaggtgctgggtatggaagctatgggtacggaggcaactcggcgacagcaggctacagtaagtgtgcgtttctgtctgtctgacctgggaagcagctgcagtgtagcgtctgggcctgagttagcaaagggtggccagagcagcctcgaggaggctgtagaaggggcacacacctttttgcggtgattaggtcagacggcccttgacccccaccccttcccggccccacagtgggattgattgtgttaatacacgaactcgtgtaactgcaaagttccttaaaagttagaattttaaatttctctgctttaagccatgcgaagcaccaatcttgtgaatacgcttttccggccagtgcacagctcttgtcttgagaaggagccttcattggggggttacaggagcagagaaatctaaaacatgaatttcaaatgtggcgctctgtgccctttttcaaaagaattctaatttcttctctctgctctgtctcccccttttgtaggtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagccctcggcccttgcgtcttcattcattcccggcttcaggcggggcgaggtggtgtgctcagtgcaggacactggggaagctggggctgtggggctgtggggtgtgggtcctggtgggggggttctgaagatcccatcctcccagtctcctcgctgagctgccgcatgttcgctttctggcattgtgggacacatcctcccccttggtgtcttggctttgtgatggcgggcgagggaggaggcctgcctgaagaacacaaactgaaggttgcagatagttctgtccacgttgtcatgcaggcagcccaccacaccagcgtggggtacacatctccagtgggtggaggcacgtgaggactcccagttaccctacccaggaggcggtgggcccttagtgtcctcaatctgggaaggaaggacaggcagcgtgggagcctccccttccctcccacccaccctgggcctggaggtctgggcagcctgactgggcaaaggtggctgcattcacaagccgacccgctctgagagcccaggaactcagctgcgcctggtgagcgcttgggcgttggccagcttggctggagagccaccaccatgacccagcctcccacctcacccaccctctgagccttcccacacccactgtggaggctccctgtgtggggctcccttgcaaggcttggggtgcagcattccctcagccagtgccgtcccctttgttccactcgagcctctggcggggccgtgtattgacaaacctagtgaccagaagtggggtctcactgctacattttcagcttgcggctgagaatgtagtggctgcactgcacactttcagccctgctgctcagccccacctgcacccagcagctgtgctggggacaaggaaggggcctcgggagtcattagggctgtaggtctaggcctcacccggctttcctgccccagccgtggccactgccctctgccagccaggctggggcttggtcacatcctgagtcacatgcttgcatgagtatcgcaagggaggtgcctgcatcattgactgagtctcgatttgtcttccaagaaccaaaccagctcagaccagttggtcttctcaggatgatgacggtccggggcctctttaaatagcatcttttaggggcctccaggcctgtgcctgtggagcctgttcccagcacagcagggaggaggggggtggctgctgcttctctggggctttgcttttcctgtcaccattggggatctctgggtagccgtcagctagctgtgaatgtcgtcccgcgctcggagtccatctcattgtaatgttgacatccgctgcaaaagctgctggcgcgtgctgcttggcaaagccccattgttgtcatcagctgctgggtgagtggagctgaaggctgggccagcccaaacggctgtgctaaggaccggagccactgctcctctccctccttgtcctactgcctctgacccgggcttgtgggtcagccttcaggacccatggctgccgcctgcccttccctcccttccccctgccctttcccgtcctccgcctgacccactgcctccctgtttaggtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcagtgagttggcttccagagcccctcggccgggccagggtccaggccccagcagtgcagcccacggagtggcagaagctcggcactgcccagacctctggctgagggccttaggaggaggacaagtggtgctggctgcgggcgggtgctaggaagatggggcgtgggacctcatggtgccgtctccgccactctctctggtgtgttctccgaaggcagggtagctgaggcctctgtcccgaggccctggctgtgggtgaggctgcaaggtgacttcctgggacttgctctagagagttttgcatccagcccctgcaagagcctgacctctccgccaccgcctttccgcttcctcatgcgcagacccagcaggcccgggctgcaccagtgacccagtggggctgagtaggtgtgtccttgggacccagcagctgtcagcagcaggccagggacttgacagaggctgtgctggtgggtcagaagggggtgctgtgtgtctggtgctgctggctgaggagaggcagctgctggggtctcaagcacttcctcagctgctgctgggaagtttgggctgcaggaacagatgggaaggcaccccagagcagggctttggagcttggtgaccagcccagcccagggccaggtgaccctgcagggctccagctggcccctggtacttacctgatgggctgatgtgcgacattgaagcaggcagggagaagagttagaggcccagggtctgggccaggggccggccgcgtctgaggcgcaccacaaggcccccgggccgcccaaggtgtgtctttcctggggccccttaaccatcctgtcttctctcccccagactacagtggtagtggaggccgaagcggcgggaacagctacggctcaggcggggcatcctacaacccagggtcacacgggggctacggcggaggttctgggggcggctcctcataccaaggcaaacaaggtgggcctggagcccctggtggcacagcatggggggcctggcagctgctgtgaagcgggatatggacctggtgggagcagacagcagcgtgggcagggctgcagtggcaggtgggccctgtgagaacacgcactcggatgcactggcagctgctaaggctttcgggagcagccggagagccagcagtgtccccacgcttaacccctggtacctgtgtgaaatgtgggtgacaccaaggccaaacagctgttcccccggttctggccagtagctcagccttgggctcaggtagcttctcccagaaacgagggtcacagtggtcccacctctcagagtcttggtgccagcctgatccagtgatgtgtggtaggcaggcagagccgcacaggagcccacaagtcttgcccacctgcatcctggccgaggcttgggtgtgggctgcctaacctgagccccgctggctgggcccctcggctctaatccaccactctctctcctaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtagacaaataaagaaaaacaaaactgcgcccgtcttaggcctgggtgtctgacccaccagcagtgcaatgggcaggtttccccactctattcctgctcttgggaaagcagcgtgggccatcaggatggtccctggtccttagagagggtccagttcaggcttctagacattttactcatgctcagcgaaggctggttcctggtcccctgggctgtgtagacccggtgtcccaccaggctccaggctcccaccatctacagaggggcttacagcgcccattctggtcttggggaacccatcacaaaataggctttttctgctccccgattctggtgtagttctaagtacacagtgatgtcctctgtaggggcgtgcctgtggtggaacataacgcagttacaaaagaaagggcaggtgaggcctgggtaaccccagccatggaccgtcagtggctggagggagcttcgtgtctgtgctggagctgcagcctgctcgccatctggaggctcagtggagtggggagttggggttctcataccagcagatttccctagagcgtgattctcccatctgaggcaatcttgcctcccaggggaaattttgcaatgtttggaggatgttgtcacagctagtagcgggtgctctgggatctggtggatagatgccaaggatgctgtcaagcatactgtactgcccagaacagtggcccatagcagggacctgccctatcaaaatatcaggtgtatggaggtggagtcccaacgctagagcagcccttctcagctccaccctgcccggggagggaggaggagctctggtttcagagcagtgccgggattgcctttccccaggatctgtgtcggccatccaggaagaactgtactggccaagcctgggaccacacgtctgcagagatcctgctctgctggcctgagccccaggccttggcctcctgtgcttgggtaaccatggccactgggaaaagcaaggaccgtgtttgactttcttggagaggtgaaagaggtgaaagaacaagttgtgtgctagaaaacttttgaggaattcttatttgtgttagagcagaggaggtcccagataccaagtggcgcctcccaggaaaggctgggagaagaggtggcctggagtaccccgagatcccagcagcgcacacagtggagggatgaggatggatgggtcctaacccctgattttgatgggatgtgttcatgtcctatctcctctcctggacacattaaggggttgggacaagaagagactcctgtgagatcagcagacctcgtgtttaaggagagaatgcctgcctgcaacactcatggagagggacacttcctggccccacctgctaaatacctccaaactctgggcaggcgcctgcattctcaacacaggacttcccttaacagtttccggatcagtgaccaccaccacgttcaggtttctgaatgcagacccaccacgagggatggattccacccgcccgccctgctgcagatacatgcggcacagcaggcacgtgcctggagagaacagctcctgagcacagcacccttggagccctcaccccgctcacgatcctcaccagtgctgatgatgccgtcatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttgggtggacggtctcctacatgttcagtggaggccaccaggagcatccatgagcggggaaggggtccacacccttacatggcaagttgatacgatggggtgcttggtggatgggccatggaggtccgtgagctggaactgggcacacgccatcccagagggctcaggatgccccaggaaggaaagaagggcaacagactacacgattggacgtgtgtggttgactgggatgaagttggagggaggggcagggccttgcaggggattggtactgatcccagggaggaagtgttggggcttcatgaactaggatgaaaggaggcccctgagccatgacaaggggcacatccaggatttccgccaccctgaatttagtagagctagtaggccctggtcgtcactctgggcagggatgccgtcagccttgagggtcgccacccacctgtgtgttgccctctgtcctggcggggaaacatacaccccttgtctcaccaccaaccttgcttgtgtagtcagcagggctggccctgccccaaggactcactgcatgtacccggacccctaggcctggcctttgcagcatagttgggagcttctggattccatctgcacctgtgagccccatgctggctgtgcactgcgcgggcctgagactgctggatacaatgttgggcaacaactcagccagcctgatggcagcctcagaggcttactctaacccatcccagaataaatggagacttcatgtgttcattgtttcattcactcaacatgcgttcgttcattttttaagagagacaggatattgctctgtcatccaagctgaagtgcagtggtatcatcgtagctcactgcagtcttgaacccgagagctcaagcgatcctcccgtcacagcctctggagtagctgggaccacagggctgtgcctccatgactgactaattttcttgtagaggtgggtcgccaagcctagtcttgaactcctggccttaagcaactcagcttccctatagtagctgggatgacaggcagcgccactgtgccctgctgtcgtgtttattattgcacagtgattacatgtcaagtctggtgctggttgctgggaacgaaatggtgaacctgctcccaacccacatgta

SEQ ID NO: 15622 - DNA, 24280 bp, Human; identical to SEQ ID NO: 15621

SEQ ID NO: 15623 - DNA, 81927 bp, Human
atcacctgaaggtcagacgttcgagaccagcctggccaatgtggtgaaaccccgtctctactaaaaataaaaaaattggcctggcgtggtggttcacacctgtaatcccagcactttgggaggtcgaggcggttgggatcacgaggtcaggagttcaagaccagcctgaataacatggtgaaagcctgtctctattaaaaatacaaaaattagctgggcatggtggtgtgtgcttgtaatcccaactactcaggaggctgaggcaggagaattgcttgaacctgggaggcggaggttgccgtaagccaagatcacgccattgcactccagcctgggcaacaagagtgaaacttcgtctcaaaaacataaataaaacaaaaatagaactttttttttttttttgagacggagtcttgctctgtcgcccaggctggagtgcggtggcacgatctcggctcactgcaagcgccgcctcctgggttcacaccattctcctggctcagcctccccagtagctgggactacaggtgcctgccaccatgcccggctaagctttttttttgtatttttagtagagacagggtttcaccatgttacccaggatggtctcgatctcctgacctcgtgatctgcccgccttggcctcccaaagtgctgggattacaggcgtgagccaccgcgcctggccaaaaaatggaactttttaaatcaagagaattaaaaatgtttctacacttcttacagaatttatccttagaaccagaaatatgccggagagttcaggggcaaagagattcattccaaaaggcagcagaaacaagacagatttgcgacatgcttaaccagagaggggctatcaaaaaacccagggtgtcagagccaggaaatgcagtgtagcttttagaatttgtgttttaaagactattaaatgataagaattgccatgggtaagattatatgaaagcctagaatgtattgagaaatttcactgagtgtgggtgcgtcttcagccagcgagggccttcagccagcgaggcggagaagcctctttacagacacaagtatctttcctttcccatttgtctctgggtggttggaggacatccccttatgcatattagcatctaaaggaaaaggtgacgtttccaagtgtcagggaccaaaaagtgccattatttgtgtaatactttatcctttttaaacttaagttcatttattttaagggaaacttggtcttactactttcaatggaaaaccagcagtatttgccataaatatctgttttggctgaattgatggaatttcggttagaggcttgtttttttttttttttttctgagacagagtgtcgctctattgcccaggcaggagtgcagtggtgcgatccgggctcaccgcgatctccgtctcccaagttcaagcgattctcctgcctcagcctccggagtagctgggaccacaggcgtgtgccaccatgtccagctgattttcgtatttttagtagagatggggttcgccttgttggccagactggtctcgaactcctgacctcaaatgatctgcccgcattggcctcccaaagttctgggattacaggtgtgagccactgcacccggccagtcagaggctatttgagctatagtcctgttctttctgttaggaagataagcaagtggagagcagtgtgaagggtagaccagcaccccctgagacaccctctgccgtgatcaggaatatggcaggagcccctgaaggcccctgtggggcagtgcttgtctgtgagcgtggcccaccccttcctgggtagactgactgatcttgtgtgcctgagatgtaggacttcctctgagagtgatcatggagaaacggtttgggtggctggtggggaaggtactggcttcctgtgggatgtagattctgatgtgaccgtatgattgtcccttgctatccctgtcctgcctcgcccttggtcatgaaccccagactgaccaggactgtcttccagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaaggtagggatccctgtgcccgcctcgcacctgcggcctctgcccactagggctgcaggcagcctctggaccgagggccttacttggaggatggggggaagccttcttgttggaggtgtcctgccttggctcagccccctaccccagggcccacggccatgaacagaaggttcagctcgtcagaccccagcctgtgctggcgcatgatctgggccccgcgggcacctgccccaccgtttcccgctcccttgctttctgcatgtgaaatttgggaatatcactacaaagttttcttttggtaatgaagaaaaacatccaaattcctaaaaaggcttttagccacgtggtttcccccgttctggctgtcaggctcacctgtgcagctcgcagagccgagcagcgggttccctttcctccaaggcgtgcccctcagccactgtctttacctcacctgcgctgagcagggccttcagtcagcaaggtggagaaggctctttatggtcacaagtctcttttgcatgtccctggatgtggttagaggacatattcccttatacatacagcatctgaaaggaaaggtcatattagcatccatgagaaaaggtgacatttctaagtgtcacgggccacaggaggtcccgggtggtagaagatgaggattgcttgaccacagtctcccatatgctcgtgctccactgggcgacatttattttgtgtacctgtctcgaggcctaagtaggtgtcagaaccttgccttggagtcatgctggggactggggagatgcgcgtcatcttcgggtggctgttctcggtgccctcgagcttctctcgggcagcgcatagctgcgctgccacctcacgttccacatgctgaccctgccttgccatggtccctctcgcagcccatggagtccatgcatgagaagggcatgtcggacgacccgcgctacaaccagatgaaaggaatggggatgcggtcagggggccatgctgggatggggcccccgcccagccccatggaccagcactcccaaggtacagaactgcgttccttcctgccttgtgtttgtcatactccagagtcctcagatcattttcctcccctgggttcccacaggatggattcagggagtacctaggatgatgtagccgggtgggtggcccgccacagagagctgtctggcatggcgtggctggtgctctgttctggccacctcgtctcggagcagccctggaaggggaaatgctggttggggggcagaccatgttcagcatgggtgatagaggagggctgtgcagggcagcagccccgtgccacccaggaacttactggaaatacagattcctggggcctgggactctgctttaatgagcccagcaggtgccttttctgtacgaggacaattgagaagtgatatggtgggtgactttccaaggccttgctgtcatcaggggtgggaagctcaggggctgcactgggaatggaagtgttgggggtgggcctggcgagcccgaggatgtggaccccgcctgtggacaggcaggcggaagccgggagagagccgtgatttcatgcacaggttctcagcattaaccagaagcaccttactgagacgtgggccaaaccaaatccaccaggtcggctgctgggctgaggtgccttcagcatgtgccctccaggtgcccctggttgactcaagagaaggatgccatttggctgtgccctgtctcagagtaggagctggtgtagggggaagaggctgtaaaaatcacagacatatgctgccgagtgaccagtgggctgacctttctctgcaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtaagactggctgccctggccctcaggtgtctcagagcgaatggctggggcgtgggtggcggggtggacagaccgtgctctgttgccgactgggttccccggtttgggattgcacgggcccatactgcacttctgggtgctcgggtggtgggggcagctaaatgctgcttccccagctccccgcttcccctggggccgctggttaataggtgtatctgctgtgtcccctggagccagggctgcccacggggctgggcgcaggcataaacctgggacgcactgttttctcttttgtttctccctacatgtaggtatgggagggcccaacatgcctcccccaggaccctcgggcgtgccccccgggatgccaggccagcctcctggagggcctcccaagccctggcctgaaggtgagctccctcttctatggtggtgcacccgtgcccttactccccatctcaagcttgggtccttgagatgagctttgtcagggagaaagggccgagggtggtcaggctgaactgcagcctgtacttttcttgtggtggtccccgggtctcccctgtagccagtcagttcccaaaggctgtcgttcatccctcctctgacagcttgtggccttcacccagtccctgagccctgtatatgtaattgctcagtaagtgctgcaggctcccatctgttgggctcaaagaggcagtgggactcattacccatcctcttggagcctgaggtttagcgatgggcattgaggggcaaattgcttccactggatttagttggcactaggaggagatgacaggaaatgctgccatagagccacagacagaacaaaaaggccttgggagcctggggctggccccagtggagggtgtgaaggacgagggtgaggctgagatctggaggaggttggagcccaaggcaggtgtgaaggacacccctgggtgaaaggtgggagatgggcggggtctgcctgtccccagtgcctcaagcagctcagcagctttccatttccagcccgggatgggccccagagctcaacatgacgccctggccccttgccttctcccaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggtgagggcggggcccagttgccaaggtcactgccctgtgtcccccatgtccccctggggaagccactcaactttctcccccactctagcaaacagtgccctgtgcccaccactgccacttggcctacacctccttcctcacctccctgctcccaccctggctgcggtctgtttcccacacagcagtttgagttctctctctttttttttttttgagacggagtttcactcttgttgcccacgctggagtgcaatggcacaatctcggttcactgcaacctgcatctcctggcttcaagcgattcttctgcctcagcctcctgagtagctgggattataggcatgcgccaccacacctggctaattttgtatttattttagtagaggcagggtttctccatgttggtcaggctggtctcgagctcctgacctcagatgctcccaaagtgctgggattacaggcatgagccaccgcacctggcatgaattctctttttatgattgatatcagatctactccgtggattaaaacctgcctgtagcttcaattatctgcccaataagctttgccttatgtccactcctgcccagcatccttcctcacccatcccagtctctctgttcctcttttcatttatttaacaagttagacttgttcctgccccaggacctttgcacaggctgtgcatggctccttctactcattcaggcctgattgctggggttccctcctcatggaggcccttcctgtcacttccagccactctctggaattgcagtggatattttattttttttaaatctcctttatggcctgtgttttctaatgagactgagagttccttgctttgttgttcttgtttagtgctaaggccctgcacttaaaatggtccctggcatacagttggtgctcaatgagtatgtgcagaaagactgattaagagaattagcccacataaccttcgcatgtaaccttcgtaaccttcagaccaagcctctagggtcactccgaggggttgcctcagttttgaggtgagaatgctgaggtgtgcagttgaaatagattcccaccgccctgcgcctcatccatgccagagctgcatgaaaaccttggcccgcctgacgccagaacctggctcacaccactgaaaaggcatgacctgggcgcgtctatcaggaatcttgtttgctgtcccctgaggcccggtcctgaggagtgccccgggctatctccctctctgctgtgccctgcggccagcatcctcttctgaggcatctcttgcctcatgactagtgcctgcctctctcgagggatgggtcccctgcagctccagctgtaactgggtgccctggcaaccctctcaccgcctttgctccttgtctctgctcccaggctgcaggctcgcatcgcacaccgaattcaggaacttgaaaaccttcccgggtccctggccggggatttgcgaaccaaagcgaccattgagctcaaggccctcaggctgctgaacttccagaggcaggtgggtgctggcatggccgcagctttccgaaaagggcctttgtcaccaacactgctgctaaggctccaaatacggcttgcctggctagtattacacctgcctgggctgtgaaaagcagccgtggccatccatgggcactcaatcactgcagagccttcctcttacggcctgcgcagtgctggggacgtggacctcactaccctaaagcacttgccgcctcaaagcagacttgtatgggcttctttcttcctttccctttccctttttttttttttttggaaacagtcttgctctatcacctaggctggagtgcagtggcataaactctgctcactgcaaccaacgcctcctgggatcaagcaattcttctgcttcagcctcccaagtagctgggattacaagcgtgtgccaccatgcctaatttttatatttttagtagagacagggtttcaccatattggccaggctggtctcaaactcttgacctcaaatgatcggcctgccttggcctcccaaagtgctgggattacaggcatgagccaccacgtgctgtcctgcatgggtctatttctgagggtactgtgcttagaccctggagtgcagtggagagatcacagctcactgcaaacttgacctcccaggctcatgtcctcctcccgcttcagcctcctgagtagctgggactataggcgtgcaccattacacctggctatatttttcttttttttgaaacagagtctcactctgtcacccaggctggagtgcagtggtgccatctcaccccactgtggcctctgcctctgtggttcaagtgattttcctgtctcagccactgagtagctgggattacaggtgtgcaccaccatgccgggctgatttttttgaagtgcagtggcacaatcttggctcactgcaacctctgccttccaggttcaagtgattctcccacctcagcctcctgagtagctgggattacaggcatgtgccccacgcctggctaatttttgtatttttagtagagacagtgtttcaccatgttggccaggctggtcttaaactcctgacctcaggtgatcctcctgcctcagcctcccaaagtgctgggattacaggcatgagccaccacgcaggcctggtttttgtatttttaatagacacagggtttcgccatgtcgcccaggctagtctcgaactcctgagctcaagccatccacctgtctcagcctcccaaagtgctgggattacaggcatgagccactgctcctggccgcctagttaatttttcttctagtttttgtagaagtgaggtctctccatgttgcccaggttggtctcaaactcctgggcttgagcaatcctcccaccttggcctcccaaagtgttgggattactggcgttaagccaccacacccagccaagagtgttatacttctgaatgactcctaagacgtgtgtgtggtagaggggaggcaagctggaggtccgagaggaccccctggatagatgtccagaagtgatcaccttctgtcctgtgctcgccctgcccgggggcacctgctagacgtcccctgcacacacggactgggtgtgtaaggcacttacaatgctcctttagcggtgaagcatgtgacatcaccatacgtgtttgtcattgtggatgccacagagctgtgcagtgcgcgggcttgtcctcttccctcctacagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggtacgctccggtggccccaaggccctgcagcccgcccacctggctgcctggcttgtccagcggttgccacggggctgtgtttgctttgttcctaaacatgctgcttgtctctctcttttgctcattgtaacagtattctaggtactgagagtgtattggtgtaaaaacccaatggtagggagaagatagtgatgaaatccacgcgtagcacgtctggaaggtgatagggcacaaagaaaaatcaagccaggatagagaggaaggaacgggctgttgtagaactgatgttgggggagttctttcttttggaggtgacatctgggcagacccccaaggaagggaggcacacagatctgtgggaaagagctttctgggaaaaggagaaggtgcaagggccctggggctggaatgtgcctgtgttttctctggaaagcaaggacctgcatgagccagagtagagtgagtggcggggagagctggaggaagggagcgcagggaggtgacgagcaggtgatgcagggccttgcgagctgcatggaggatttgggcttttgctctgagtaaagtgggagccatagagggttctgggcagtgcagggactgatctgactcagggtttcccaagatgaatcagtaagacggaaatcttcaaatctaaaatcaagtaaggatttggggatgattgtgctgatttggtcatttatagattttctagagattttctataattaatatcttattggtgtagtgtaaaataatctagacagtcaacacagcaatctctgttaacttttttttttttttttgagatggagtctcgctgtgtcactgaggctggagtgcagtggtgcaatctcggctcactgcaacctccatctcctgggttcaagcagttttcctgcctcagcctacctagtagctgggattacaggcacctgccaccatgcctggctaactttttttttgtatttttagtagagatggggtttcaccatgttggtcaggctggtttcaaattcctgacctcaagtgatctgtccgtcttggcctctcaaagtgctaagatggcaggcgtaatcccccgtgcctggccaacatttttttttttttttttttttgagatggagtttcactcttgtcacccggactggagtgcaatggcacgatcttggctcactgcaacctctgcctcctgggttcaagggattctcctgcctcagcctcccaagtagttgggattacagatgtgcgccgccacacctgtttgtttttttctttttttgagacagagtttcactcttgttgcccaggccggagtgcagtggtgcgatcttggttcgacacaacctctgcctcctgggttcaagcgattttcctgcctcagcctcccaagtagctgggactacaggcacctgccaccatgcctggctaattttttatatttttagtagagatgaggtttcactatgttggccaggctgctggtctcagactgttgacctcgtgatccgcctgcctcggcttcccaaagtgctgggattacagacgtgagccactgctcctgaccaccaacatttttttatatatattatttcagccttttttcttgtatattaatacaaggttaaatagccctttttaaattttttctaaaactttgctttttttttttttttttttgagtcagaatctcactctgttgcccaggctggagtgcagtggcacgatctccactcactgcagcctctgtcttctgggttcaagcgattctcctgccttagccacctgagcagctggaattacaggtgtgcaccaccacacctggctactttttgtacttttagtagagatggggattcaccctgttggccaggctggtcttgaactcctgacctcaagtgatccgcctgccttggccttccaaagtgctggaattacaggcgtgagccgctgctcctggccacatcgctttgtttttaagtatcatggaaacatgacttttgatgtctacactgtattccatttctatgtgtccaggatctaatcatttatgtcacctttttcctgtttgaggacatgcagcatgtttcagcttttgaaaattaaaaattatgctaggaccggaattcttggcttgaacattttggagctggtctctgatatttccttaaaataaatttgtagtaatggaataagttgggtgaagggttggaagcatttttgagacatttcacatccgtgccatgctgccctgccagtcgactgcactgtgtgcctacctgctgtgtttgagggcctttcccacccacagttgccggtgcttagtttgtttttttttttgagacggagtctcgctctgtcgcccacgctggagtgcagtggcgcgatctcggctcactgcaagctctgcctgctgggttcatgccattcttctgcctcggcctcctgagtagctgggactacaggtgccagccaccacgcccggctaattttttgtatttttagtagagacggggtttcaccatgttagccaggatggtatcgatctgaccttgtgatctgcccacttcggcctcccaaagtgctgggattacaggcgtgagccaccgcgccctgccgccagtgctgagttttatcatcagagagagaaacccaaccgcggcaggcaaagggtgtccctttattgttttcataatagtctcgtttttattttatgtattatatttatttttttgagatggagtctcactctgtcacccaggctggagtacagtggtgcgatctcagctcactgcaacctctgtctcctggattcaagcgattcccctgctttggcctcctgagtagctgggattacaggcatgtgccaccacacctggctaatattttttgtatttgtagtagagatggggtttcactatgttggctgggctggtctcgaactcctgacctcaggcattttgtcctcctcagcctcccaaagcgatattctaggtttttttttttttttttttttttgagacagcgtctcactctgttgcccaggctggagcacagtggcacgatctcggctcactgcaagctccgcctcccgggttcacgccattctcctgcctcagcctcccgagtagctgggactacaggcggcccctcaccacgcccggctgattttttgaattttttttgttagtagagatggggttttaccatggtctcgatctcctgacctcatgatccgcccgcctcagcctcccaaagtgctgggattacaggcatgagccactgtgcccagccctaatttttttatttttatttttagtagagacggggtttcaccgtgttagccaggatgatctcgatctcctgacctcgtgatctgccctcctctgcctcccaaagcgctgggattacaggccaatattctaggttttaaacaagccttgcggggagatgtgtccaccatgctgctgaagggtcagccttctcttttgtgctttcctgcaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggtatggtcctgccttcttgacgtgcgctcttctacatgtgtagctggtactgcgggctccaggggtcactccccagggttacgccaaggcatttcacagctcggagttagaggtgggacagagggaaaagagcaggcgcgggcttgggagtcagtcctgggctcggatatttgctgatctctctgatcatcagaatgactgtgtgacctcaggccacttagccggctcctctgccttctctggaaaatggaggtggtgcccccttccctcgttctgtgagagccaggtggtgtgatccagacccccgacccctagcataaacatctctgaccatttatttgtgactgagtcgctggttgggcagatattggcagcgtgttctgggccaggtgctgctctgtgtacggggacatggcccctgcctttgtgggggctcctggttgtgcttgaggggcagatacgcgaatgaagcaaacagagtagtggatggtgaccgctacagtgaggagggggaagtggagtggaaggggagggacagggtagtaagtaaaagccttgaaacagaggcccaaagggtggccctgatgcacaaacgcagagacccagggaaggagccccaggcagtgcggacaaaggttgaggtggcaggcagccatgtgccagggcagccggtagccctgggctcccagaacagcgttgtgtggggcaggaggtgaggtcagagcttacaggggcaggtgggaggtgggacctttcagaccattgggaggactctgggttgagttctgatcatgaaggggagcctcacccgggagggttttggctgtggggtgatgtgatctgatgtattcttagaaaggtggggggctgctgtaggaggtggtgggagggatgcaccttggacttggtggagagaaggcttcgggtttggggtgtatttcgtggacagagtgggtaggactggctcatggcctctgtaaatggctgctggcgggactgtctgcctagcgggtgcccttggaacctagcccttggtgggttttgaggaaatgattcctgaatgaggagtcgattgccgtgtgaagggctggtggcacggcacccgcgtgagctacgcgtgccctcagtgcgcttctggattgactggccatgggtgctcacagacatgcacattgtgccaccacattgcagtaacccccatgcttttgtaggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaaggtgtgctgggcctggcatggtgcccgccgcgggtgggatgggagcagccgtcttcacgtgtgtggcctcagccttgtgggtcagggcctgaccgtgtctctctctatttccagaaggcagaaaatgcagaaggacagacgcctgccattgggccggatggcgaggtgaggaagcagggtttcttgtggaagtatcaagctagccctaaggcgttggtctgtttcagactttaaaacctgtgttcttttaaaattacgaacaatgatatgtgatgatggtgagaatcccagggtgtcctctgacgcccatcccacccgaccccacatcccacatgttgtgttttcttccagacctttttctatgcatgtgccacaggattcatctttcaggttttactttgttgtaacgtccgacttacaggagaggtgcaagaaccgtccagagatgtcctgtgtgttcttcacccagagtctccattttcacgttttgtgttttgttttgtttctttgagacagggtctctctgtcacccaggctggattgcagtggcggatggctcactgcagccttgacctcctgggctcaagtgatcctacccttcgagtagctgggattacggttatgccccaccacacccagctaagttgtttttttttttgagatggagttttgctcttttgcccaggctagagtaaagtggtgcaatcttggctcattgcagcctccgccccgcgagttcaatcaattgtcctgcctcagcctcctgagtagctgggattataggcatccaccaccacgcccatttaattttatttttatttatttatttatttattttagacggagtctcgttctgtcacacaggctggagtgcaatggcacaatctctgctcactgcaagctccgcctcctgggttcacgccattctcctgcctcagcctcccgagtagctgggactacaggcacctgctaccacgcccggctaattttttgtgtttttagtagagatgggatttcaccgtgttagccaggatggtttcaatctcctgacctcgtgaacatcggcctcccaaaatgctgggattacaggcttgatccaccatggccagccagtttttgtatttttagtagagacggggtttcaccatgttggccaggctggtcttgaactcctgatctcaagtgatccacccgccttggcctcccaaagtgccaggattacaggcataagccaccacgcctggcctaattttttaaaatttattttctatagagacgggggttccatatgtttttcaggctagtctccaattcctgggctcaggcatcctcctgcctcagcctcccaaagtgttaggattataggcatgagcccccgcacctggccttcacctgtgttttttcctaaactctttgagagtcaaatgcagacgtgacagcgccttacctccatgtaattcattatctacttcataaagacaaggttgtttctgcacactgtaccgaggtgacggacacaggaggtgaacattggtacagcactgttatccaatctataggccttcgtatgaggtttggccagtttttccagttatcttcacagcagcagagaatcctgggtcacatttagtggaggtccctttagtcagctttagtcttaaagagctccttgtgtgtgtgtttgtttttttgcagagatggggtctcatgttgcccaggctggtcttgaactcctgggctcaagtgatcctcccacctcggccttccaaaggctgtgattataggcgtgagccaccacgcttggcttcaggccagctatgtcatccagtggccccggactttggtttgtctgatgttccttgtggttggagttgggttatgtgtctctggcaggcagacccaacatggccctgagtccctctcagggtgtcatatcgagagtgcatggcggaggttagcaaataaggtcactggtgatgctgactttgaacccctgccaagggatctccactgtccagttactgtttttttcttttgtaatcagtaagtaccctgtagggagatacttgagactctgtaactatgttgtaactcctcagaattccagctactccttttagtatctttttttttttttttgcctgtatcagtttttgctctgatggctacaggatggtgacttttatttccatcgttctttctgcattgatttgtttgtttttctatagtaggaaaagctttctctttggtcctgttagtcctgtggccatggtctgccaacccctggtgtagacttacggattcttgtttagttgaatgaatggattccgatcctttaaaatgatttcttttggtcatttagctttagccagcaggagccccttgccattggctcctgtttgcttttggtacatgcccaccattcctggagcacttccttcctcatcagacttttcttctgctttccctgcctgagctctctggagccaactctttctccagggagtcctggttccttttttttttttttttgtctgtcaagacggggtctccctgtgtcacccaggccggagtgtgtggtggtgcaatcatggctccctgtagtctcaacctcctggactgaagcgatcctcccacctcagcctcctgagtacctggggctacaggcgcacgccaccatgcttggttaagtgttctgtatttttttgtagagacagggtttcaccatgttgcccaggctggtctcgaactcctgagctcaagcaatctacctgccttggcctcccaaagtgctaggattacagacatgagccactatgcctggctatatttcgtattattacagaagaatatttacatgccaagatctgactttgggggtgcttcctgctagtgggccatcactgcttctaggccctctgagcagccggatctgggaaatagatgtatgtacacatactcatctgcattgctgtttgtatatattaaaacttgtggctgggcatggtggctcatgcctgtattcccagtactttgggaggccaatatgggaggactacttgagcccaggagttcgagaccagtgtgggcaatatggcaaaaccttgtctttataaaaaattttaaaaattagttgggtgtagtggcatgcacctgtggtcccagctacttgagaggctgaggtgggaggatcacttgagtccaagagtttgaggctatagtgagctgtaatctcaccattgcactccagcctggtcaagacagtgagaccctatctcacacgcaaaaagaatcttgaggttatactgacacctccaattctaatccaacagcacagggttaatttttatcctttccgcctttccataattctaaaatcagcaacctgatttcccttagcaataataggcttacttacctgctccattttagaatacacagaaagtacgttccaaagtgctaatggacacctctatgcagaagtctcctagttagagttcagtatttatagagttcctctacctcaggatatgtgttccaaatactgtgtccagaagttactggggccgggtgcggtggctcatgcctgtaatcccagcactttgggaggccaaggtgggcggatcacctaaggtcaagagttcaagaccagcctgaccaacatagtgaaacctcgtctctgctaaaaatacaaaaaattagccaggtgtgggggcacacgcctgtggtcccagctacttgggaggctgaggcaggagaattggttgaacctgagaggtggaggttgcagtgagccaggttcatggccattgcactccagcctgggtgacagagtgagattctgtctcaaaaaaaaaaaaaaagaagttactttggaccaggtgtggtggctcatgcctataaccccagcagtttgggttgctaaggtgggtggatcgcttgagcccaggagttcgaaaccagcctgagcaacatggtgaaacctcatctctacaaaaaattaaccaggcttggtgcgcacgcctgtagtcccacctactcgagaggctgaggtagggggataacttagcccaggaggtccaggctgcagtgcactgtgtttgtaccactgcattccagcctggggagctttttattacttgagacagggtctctctctgtcagccagttctgtctcacagttctgaagccatctggaggactcaagaaaaaagtaatgggccaggtgcggtggctcacatctgtaatcccagcactttgggaggccgaggcaggcagatcatgaggtcaggagttcgagaccagtctggccagtatggtgaaacccagtctctactaaaaatacaaacattagccaggcgtggtggcaggcttctgtagtcccagctactgggaggctgaggcaggagaatcacttaaacccgggaggcggatcacaccactgcactccagcctgggcgacagagtgagactctgtctcaaaaaaaaaaaaaaaaagtcatgaagtgggaaagtgcatgaagtgggagcttgtgctcagtcctgctgtggctgcctgtcctgtggagtgttgagaacaggcaccggcacttgctgctgcttgtgggttttcttgttctcggacagtggtactcagcctctgttgtgtgttctagtcacctggggagctctctattattattactactattatttgagacagggtctctctgttgtccaggctggagtccagtgatgaggtcatggctcaccgcagccttgacgtcctgggctcaagtgatcctccgaggacctttttctaagtagtagctgagcatgaaggcatgtgcctgttgttgcagctgctcaggaggctgaggtgggaggattgctttagtccaggagttcaagaccaacctgggcaacatagggagactctgtctctccaaaaaataaaataattacctgggcatggtggtgtgcacttgcggtcccagctgattgggagccagaggtaggcggatcacttgagcccagggctttgaggctgtgatcacacctgtgaataaccatggtactgagcccgtctccaaaaaataaaaagtaaattaaaaatcttaaaaagcgaggatgcccaagcctcactccagaggagttcaatcagaattttgggtgtaggggaggcatgcagcaatcggcatctttgactgctcctcccagtgatcccagagaggatgtggagttgaaagtccctgactgaggcagcctgcagagcccattgttggggtaagaggttgctcttatggtggccgctctgtgggtgagcttttagcgcgtagagactgatatccctccgctgtgtggacggtattgacactgtgagcgcagcagttttgcaggtagttataaattcctggaagatgaaaaccaaaatttaaaccaataactttttctccatcctggaagttttttctaggaaatatacaagaattgatgagggagaaaatgtttatccattgaatctcaacaggaggagtttcatatttgttgctaagaggaattatttttgaaatatttcaattagctttttaacaaaaaagaatgaggacccttgatgagatctacaaatagagtataagtgggggaaaaaatcaaggtccaaagaatgtaaattatataaccgttagtgtaaaaaagagggagaaagtggaaacgtctaagtccttgtttcttatccatggaattgatctggaaggatggacaggaaactgataccagtggaaaactgtgaagagaaaaacttaggctggagcacagaagaatggggagagcccacatgatgctcttcagttttcgttaaaaaaataaaaatgggccttgggaggccgaggcgggcagatcacgaggtcaggagatcgagactgtcttggctaacacagtgaaaccccgtctccactaaaaatactaaaaattagctgggcatggtgatgggcacctgtagtcccagctactctggaggctgaggcaggagaatggcatgaacctgggaggtggagcttgcagtgagccgataccgcaccactgcactccagcctgggcaacagagtgagactccatctcaaaaaaataaataaataaaaataaaaaataaaaatgggccgagcatagtggctcacgcctggaatcccagcactttgggaggccaaggcgggtggatcacatgaggccagaagtttgagaccagcccggcctgaattttcagctatgagtgtctggactatttgaaaattacaatgtatatgccagttaccttaaagaaacaggtgttgggagactgaggcagagaattgcttgaacccaggaggcagaggttgtagtgagccgagagccgagatcacgccactgcactctagcctgggtgacagagcgagactccgtctcaaaaaaaaaaaaaaaaaaaaaagaagaaacaagtgtcagccaaggttgatgggttatatatttttactggattactgagtatacagtttacgcattttcccaccactggccatgtttgcctgccattttctgtgcaaacagttgagtgggtgcttcccaccttggcctctgtaagtgtttggtctggaggccctgcaacctcagtgtcacacgaatgactctttttcagcctctggacgagaccagccagatgagcgacctcccggtgaaggtgatccacgtggagagtgggaagatcctcacaggcacagatgcccccaaagccgggcagctggaggcctggctcgagatgaacccggggtgagttgggccttgcattccagatgcagtggggatccaagtcctcggtgggccttgttccagggaggtggcagccaggagcaattttacttctgtttgaattcccggcaggtttggtagggaaagtgaattctgctggctctgagcagatttgtatgaaagcccttacattttttctaggtatgaagtagctccgaggtctgatagtgaagaaagtggctcagaagaagaggaagaggtaagagtgcatttcctggctttcaaggctctcagtgcccactggcagtgacttccaccctgtgtgttgtgaccgtctcctgccctggctgggcatcttgtggggcagggaacagcagggcccaggcctgcccgaagtcggtgctttagagctgtcctatccaatagggcagcttctggcgacatgtgaccatttccattttaaattaaatcagtcacattacataaaatttaagactcattttctctttcacactggctgcatttcaggtgcttggcatcccttatctgggaatggtctgcctcatttgcccattttttttttttttttttgaaacggagtctcactctgtcacccaggctggagtgcactggtgcaatctcagctcattgcaacctccacctcccgggttcaagcaattctcctgcctcagcctcccaagtagctgggactacaggcgcctgccaccacgtccagctagtttttttatgtttagtagagatggagtttcatcatattggccaggctggtctcaaactcccgacctgaagtgatccacctgcctcagcctcccaaagtgctgggattacagacatgaacctccacgtccgacttatgatttttttgttgttgttttgaaatggagacttgctgtgttgcccaggctggagtgcagtggcgcgatgttggctcactgcagcctccacctcccgtgttcaagcgattctcctgcctcagcctccctagtagctgggacttcaggcacctgccaccatgcctggctaatttttgtatttttagtagagacagggttacaccatgttggccagtctggtcttgaactcttgactggtgattttttttttttttgagacagagtctcactctatagcccaggatggagtgcagtggcgcgatctcgctcactgcaacctccgcctcccgggttcaagtgattctcctgcctcagtctcctgagtagctgggattacaggcgcccgccaccatgccagctaatttttaaaatatttttagtagagatggggttccaccatgttggccaggctggtctcgaactgctgaccttaagcgatccacccacctgggcctcccaaagtattgggattacaggcacgaaccagtgcgtcaaagtctgttctgtgttagtcactctaaccctcttatgattattgttcacatggtacatctttttcccttcttttactttcaacctgaatctacaacagcatatgggttttgcattttcagctagtatgacagtgactgctttttgactgagtttttaagaccatttatatttactgtaatttctgatatgattgggcttacatttgctatttcttttctatgcctcctgtttttgttcctcctttactgccttttgtgttcaatgttttttttccctagatttttatttttatagtgccttttttttttttgagacggagtctcgctctgtcacccaggctggagtgcagtggagcaatctcggctcactgcaatctctgcctcccgggttcaagtgattctcctgcctcagcctcccgggactacaggtgcatgccaccaaacccggctaatttttttttgtatttttagtagagacagggtttcaccatgttggtcaggctggtctcgaactcctgacctcaggtgatctgcctgccttggcctcccaaagtgttgggattacaggcgtgagccaccacgcctggcctctcctatttttttgcttacctcttcatgtttagttgaagcgtactttagctaccctggagtctgacttttaaaactctgggaggttgtggtggcgtctagtctgtttagtaatttcctggggctcagtctgtgaaatctggttcctgcatagtgtgtatagcctctgctgtatttcctcaattcttttaaacattttttggttttatcttattcgtgatttttttcctggttcattaggggcaggcagtgtttctttgtcacttagtggtcatccaaagattggccacagtttgtgctcagacacgcgccttctttctcctgctgatggttcagttgtatgaggaggtgcattccacatttgggccattgtcgggttctccctggcacttatgctttgctgagtcctttggcgtctctttgcatatgcacagactcagcctcagccagtgatacgcttttccctaccgtggctgatctcacctccattagcagtgccactggctgtgggcattgcttccttctacaagtgactgagccccttccacctccctgccaagcctcatggcctgcagctctccagctgtaagaggttcatgtgtccagagctgaggcagaagaagtgaaagtggcccacagtaaaagtgctacaaactcccactcttcccacctgaagttcagttttttaaggttcaatgattctagtagacctttggtcaactcgctgagctctgaaatgctcactctgtcaatttgtccggctttatagttgcttttggggaggaaatttgcccacctcctcatttgggtttagccagaagtctcactcctattttaattccagcatgtctgtaccagctctgattttcttgcctaaaatgtcggtgttattaccacctgtttattccaagtgatctgtaaaatcattttttgtgacctaagggaaatcctactggcttttcactggaattatttaacagattaattgcagatcatatttttaaagctttgtagcagttccattatagatgagggaacaatcaactgtgttgtatttgtaggatttaaatggcaatacaagaatagtttaagataaggaaatgcattcttgtctatgttatcaatatgtgttatgcaaaatcgcagtaaaggctggaaagccattaaatgatgcaacatgaatgattaaacaagttcgtagataacttgcagtaaactgagatgcctcttgtcgccagtgttatcagacatattgtagatggttgagacttgtcagtaaagctggaagtaaattacaagcaataaatattgaaagttggttctaagatatttaaagccaggcgcggtgtctcacgcctgtaatcccagcattttgggagggcaagttgggtggatgatccaaggtcaggagttcgagaccagcctggccaacatgatgaaaccccgtctctactaaaaaatacaaaaattagccggggtgatggtgggctctaagatatttaatacctaggaaatccaagagaatcaactgataaactgctttagtaggtcagcagagaatagacgtgtaatgttcattgtataacaggggtaggagagatatggagtctacttctaattagtaatgaaagtccacaataccctgagatagccttaaaagaagcgtcggggccgggtgcagtggctcatacctgtaatcccagcactttgggaggctgaggcaggcagattcttgagctcaggagtttgagaccagcctgggcaacatagtgagtccctgtctctaccaaaaatgcaaaacaattagccaagtgtcatagtgcacgcctgtggtcccagctactcgagaggctgaggtgggaggatcgcttaagtccagtgggtggaggtagcagcgagctgagatagcaccactgccctccagccagagtgacagagcaagaccccatctcaacaataacaaaaaaaaggaagtgtcaggaatctgtggtggggaaaccaaaaacggtttactgggctgggtgcggtggctcacgcctgtaatcccagcactttgggaagccaaggcaggcggatcacgaggtcaggagttcaagaccagcctggccaacatagtgaaaccccgtctctactaaaaatacaaaaattagccaggcatggtggcgcatgcctgtaatcccagctacttgggaggttgaggcaggagaatcgcttgaacctgggagctggaggttgcactgcgccgagatcacgccactgcactccagcttgggcaacagagtgacacttcgtctcaaaaaaaaaaaaaaaaaaaaaaagatgtagccagtgtggtggcatttgcctgtagtcccagctacttgagaggctgaggcgagaggattgcttgagcccaggagtttgagaccagcccggggaatgtcacgagactacatatctacaaaaattcaaaacatttgagctgggtgtggtggtgcatagctgtagttctagctgctggggaggctgaggcaggatgattgcttgagctgaggagttcaaagccatctgggcaacatcctgagactcccatatattaaaaaaaataataataaatacataattttaaaacaaagatgtaaataataaacagcacacattccaggataggtagagggggtgagggctgtaagaagatcacttgcttctgagactgttctccccatgggagtcccgtcccccctctctgggggatgaactgaggtgacatgggcttgtctcttggtaggaggaggaggaagagcagccgcaggcagcacagcctcccaccctgcccgtggaggagaagaagaagattccagatccagacagcgatgacgtctctgaggtggacgcgcggcacatcattgagtaaggggtcccgacacaggttgttctgtgccagcttcctgtgaggtggcgctggtgggagtggctagaatcccagccatccctagctgacattcagcactgtccagccagctgctactgtggaactacagagaccaaatttatttacttcacatttcatgtattttatagggatttaatagagcaattgcattcgcatggttcaccatatgcttacgaggtacagtcaggtgtgcgggagaagccctcctcaccccgttctctgctccccggctccctccctttccactaccctccctggggaaactttccagccttgtgtgtcatcttccagagatgctgtctgcattagcaagcaaaatgtgcatatttttgtcttcatttgcatacatatctccagtgtacattggtgtgcaccttgttattttcactgaaccttccctcttggaggtcatcctgtgtccgtgcagagtgcttccagtctggtcctcagcgtgcagtgtcatactgcgtcacgttatattctcattttcgtagcctgtcctttggtgacaagcgtttaggttatatttgtcatcttttgctcctgtaacacatcacagttaacacagtaatctcttcattgcttatggtaaggaattaatagatcctgttaaaaagcaagtgagggctgggcgtggtggctcaggcctgtaatcccagcactttgggaggccaaggcaggtggatcacttgaggtcaggagttcaagaccagcctggccaacttggtgaaaccgcatctctactaaaaatacaaaaattagctgggcgtggtggcgtgcacctggagtcccagctacttgggaggctgagacaggagaatcgcttgaaatggggaggaggaggctgcagtgagctgagatagcgccactgcactctagcctgggcaacagagggagactccatctcaaaaaaaaaaaaaatgtaggtggataaaagtcacttttttttttttttttttttttttttttttttttgagatagagtcttgctcttcaccaggctggagtacagtggtgcgatcttggctcactgcaacctccacctcctgggttcgagtgattctcttgcctcggcctcctgagtagctggcacaacaggcgcgggccaccacgtccagctaatttttgtgtttttagtagagatggggtttcaccatgttggccaggatggtcttgatctcttgacctcatgatctacccactttgagctcccaaagtgctgggattacaggcgtgagccaccgcacctggccagagttactttttaaaagaaaaacattcagattagattacaaattgcctaagttttaacagctctggttttgtatgaacctgttcagtctgtgtttcttttcacctttaggctcatgaattgttcttagaaagggtgggttctatgatgatcagcatctggctaggtgcagagtgtctttctgtgctgtggcaagtgacagcattctatttgttgttttgagacagtcttgctcagtcgcccaggctggagtgcagtggctcgatctcttgactcactgcagcctctgcctccgggcttaagtgtttcttttacctcagcctcctgagtagctggggttacaggcatgcaccaccacgcccggctaactttttttttttttttttttgagacagagtcttgctctgtcgcccaggctagagtgcagtggcacgatctcggctctctgcaagctccgcctcccaggttcatgccattctcctgcctcagcctcccaagtagctgggactacaggcgcctgccaccacgcccggctaatttttgtatttttagtagagacggggtttcaccatgttggccaggctggtctagaattcctgacctcaggtgatccacatgccttggcctcccaaagtgctgggattacaggtgtaagccactgtgcccagcctaatttttgttttttgtagtagagatggggtttcaccatgttggccaggctggtcttgatctcctggcctcaagtgatccacctgcttcagcctcccaaagtgttgaaattacaggcgtgagccaccacgcccatcagagtgacagaattcttgtactgtggtggtgcaatcaggacccagagctcccaggagtccagtctggacccctcaggcttagtgcgggctgccctgcctggcctcacactgtccggctgcacctctatgtgtcttacagtgctggccacaggtcattcagcagaaagggccactccgcagagcttgtgtcaggagccagcacattgtcacagataggaatgtgtgtccttacccggcacctccatctcactcccaggaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccaggtgaggtagggggtggggaggccaccgccacgtagctgcctcggtgcaggtgttcccaggtggtgcgggcttcagacctcaggcagacctgagttcaccttttgctctttgtgggcaatgcactcttcccctctgagcctcggtttccccatgtgtaaagcagagatgtggtctggtaggttagctgccaggaggacgtgcaacagcagaaagtcagtgtctactgggtgcccgatgtgccaggcagagtgggagcgatttgcactccagtggcctcacagaggagacggggccacctgaggagcagagaggtgcagcacctcctcagcatcgcaccgtgtgtaggactgaaccagggccggagctcagatctgggcatctgcatgctcaggacaggttacctgagctctgtgtggtgtgaaacggcgagcgtcaggagcttagatctaggagccggcagccctggactccgctctttcttctggggatgaggtagcaggtcctgtgtgagggtgaaaagttggtggctctgaagctcttcacctgggcctgacttgggacagtcacgaaacagagctgctcatgctcttaatgcggcctgccatccagagctcattacaaggccccacaagacaaccagtacaactccaaccaaagaacagctctctctggttttcaatttggttgtttcttttcttttcttttttttttttgaaacggagcctctctgttgcccaggctggagtgcaatggcgcgatctcagctcactgcaacctctgcctcccgggttcaagtgattctcctgcctcagactcctgagtagctgggactacaagtgcgtgccatcacgcccggctagtttttgtatttttagtagagacagagtttcaccatgtcggccaagctggtctcaaactcctgacctcaggtgatccgcccaccttggcctcccaaagtgctgggattacagatgtaagccagtgcacccagccccaactttctttaagacaactcttaaaccttttgtgctagtatcaacattcaaagctgcacatgcacctatagtcccagctacttaagaggctgagatgggaggatcgcatgagcccaggagttgaaagtgggcctgggcaacatagtgagacactgcctctacaaaaatattttaaaaattagctgggggtggtagcacacatctgtagtcccagatagttgggcggcttaggtgggaggagagcccgagcccaggacttctgagctgtagcgccctatgtcgatcaggtgtctgtactaagttcagcatgaatatgatgaccttccaggagtggggcaccaccaggtggcctaaggaggagcgaatctgcccaggtcagaaatggagcaggtcaaaactgatgtgctgatccgtagtgagatagtccctgtgaagagccactgcactccagcctgggtggcatagcgagaccccatctctataaaacaataatgaaacaaaggcaaagctcatggttagtggaattttccaagagtcccatgcaattaaaataattagaacttggctaggcgcagtggctcatggctgtgatgccagcactttgggagaccaaggcgggtggatcacctgaggtcaggagtttgagaccaggctggccaacatgatgagaccctgtctctaccgaaaatacaaaaaattagctgggcatggtggtgcatgcctgtaatcccagctacttgggaggctgaggcagaattgcttgaacctgggaggcagaggttgcagtgagccaagatcgggccactgcactccagcttgggtgagagtgagactcggtctcaaaaaaaaaaaaatgaattagaacttggccagaacttacttcctcaatccattacgaacatttccaaattttccttcataacgttatcttcagtttgcaaatagtcttctgtttaaggcctgtatttcagaaagctcccaggctttggaaatccctctcttaatcttgaaatgatgttcaggcagtgaattcctcacgaagtcgccctgaagccctcttggtttcctgagtgcaagtgtcccgtggtgtgggcaggtttttcctgtgtgctgtgtggggcatggacaggcagacaatgtaacaggtgggagtgagctgttgagatgtgtattagaaatgtcacacgtgtccatcgttcgcacagtcatcctgcagcttcacagacgttattgctaaggatgaggctaagcgataaagaatcagtttggttcagaggaaaaatccgtggtaaaggcagtagagggtgggatgtggcttaggcagaactcgtggctggcggtgtcttgactctctgaagtgggaggaccctctggtgtccgacccggccttcagtcctggcgtggccgcatctgtccttgcagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcgtgagtacccgctgccagcaacatcccacacgccgctcacacgctcctgtgtttgtttcctaagtttgccgcagtagaataccacaaacgaggtggcttaattacagaaatttgttttcctggaggccagaagtccagggtcaaggtgtagcaggttgcttcctcctgaggcctctcttcctgcttgcagggatacgtgcttacatgtatctcactgtgtcttcacatggtccttcctctgtgcgtgtctgtgtcctcatctcttcttcttagaaggacatgggtcaggttggatgagggtgcatcctaatggcctgctttaacttcattgcctctgtattggccctgtctccaggtacagtcgcatcctgagctgctgggggtcaggactgctccaccagcctcggggctgtgcacagctccacccgtcacagcctctgcctctgggtcccggatcaagtgggggcatgactgtgcatcccctccacccctggggaggcctggggtccctctcccgggatgtccttggtgtccttttcaagtcccacaaccagcaaagtccatgcaggggagtcgcaggagacaagaacctcccactagaaaagtagggtgaggccattgaggctccattgaacagtctctacttcctcactgtgcagtgccctgcaagggccaccagagccctcgggcacatcccagcatggcccaggtccttgggcatggtgggatccggacaccctgagaggctctcacttgccactgcctggctccaccggcctttttctccctgcaaacagagtccgcccccctgcccacctctctcgacatctctctacccagctcagcccctgcactaaagggggacctgcctagggttttcccagaaagccccagggccggctcttactggtccagttcaagtcacatgtccagcaagcagacagtcaccggcctgggggttagtctggtctgattgggcaaacttcagcatagcatttggtctggccctagagcacagcccctaactccaaccaggcactcattgggaccactacagccacgagtcagcagcggacccccaactcctggcaggctggggagcggcatgcccatgctccaaccccatgggaaaatgcccttctgcctataagacagccaggccccatgggtcacacacccatagggtaggcctgacgtcctgactgttgcagggaggactggaggaaaggtgaggaccccagaaccctcccaggtttactgtggaactgtttctttcttctatctccctgcttcctacgtggcgggtagaacagactgctctgaaggagcagggcgtccttgtgcacagcgctgcaggtagctgcacctcccctcgtggtcagacccagattgctacagcgttcctgctgcacctgcctgagctctgtcccctgtctgtgtctggaggctgttccttccggctctgcccacctcctggctcccctctgcccttcttcccctggaggctgatgggtgcagtggcagtcgccctctgcagttcccgattttccctcctttcacttacagacttctcagatcaccatctctgctggaacgccgctctccagggtgctgttgttttgcagccttggttcttagttgttaattttttgctttaaaaaatttttttaaacttttcattttgaaatgatctcatttatttttatttttttttattttttgaggagtctcgcactgttgaccagcctggagtgcagtggtgccatcttggttcactgcaacctctgcctcctgggttcaagcgattctcctgcctcagcctcccgagtagctgggattagaggcacgcgccaccatgtccggctaacttttttgcatttttagtagagacagggtttctccatgttggctaggctggtcttgaactcctgaccccatgatctgcccgccttggcctcccaaagtgctgggattacaggagtgagccactgtgcctggcgacctcattcttagaaaacattgtagagttagtgtaaagaattgctatgcacccttcacccatcttccccattctttcataaccccaagacaattatgaaaaccaggaagataacatggacgtaggactaatagcaaaccagaggccttatttaccaatcttgtcagttttctcacaagtggccttgctctggtccaggatcccacactgtcacgtctgtgtggcatgcctgtggcagttcctcatttcgtctttgtcctggtcgagcttgacgctgttgaatcctgatcggacctttggtagactctccttcaatttgggtttgtccgatgtgatcgcgtggagcaacaccacgccctgcttgatgtgccttagcggggaaggcatgagatgttgaggccttggtgtctcgggcaaggtgcctgctgggtttcccactgtaaacctaggagttacactttccgttaataactgtctcgtgggaacgtacttcgacacttgtgaatatctcatttctcttcctactttcctcaataatttcagcatctcttctactccatttcatgttgccataaaggaatacctgagactaggtgataaagaaaagaggtttagctgggcgcggtggctcactcctgtaatcccagcactttgggaggccgaggcaggcggatcacctgaggtcaggagtttgagaccagcctgaccaacatggtgaaaccctgtccctaccaaaaatacaaaaaaaaattagccaggcatggtggcgcatgcctgtaatcccagccactcaggaggctgagacaggagaatcacttgaacctgggagacgggggttgcagtgagccaatatcgtgccattgcattccagcctgggcaacaagaatgaaacgccttctcaaaaaaaaaaagaggtttatttggctcatgattctgctggctggaagactgggcacctggtgagggcttcaggcggattccactcctggtggaaggcaaaggggagccagtgtgtagagatcccatggggagggaggaggcgagggaggcgggggtgccgggctccttttaaccatagctcccacgagagttcagagagcaggaactcattcatcccccatccccagtacagtacaggccgttcacgagggttcacgaggccgttcacgagggaggcccccatgacacagatgcctcccaccaggccccacctccaacattggaaatcagacttcagcatgaggtttggaggtgccagatacccaaactatagcagcaaacgtcagataagtcttgcctgaaaaaataattacatgagagttgccaaatacatggttacctgtttctgtccgctcttctctacaaattaattggaattccaccgttaggaagagctttcccgtctcccccatgtgcttgtttgggtaattattatatcagtgtgggcgtgaacaaatattatttattttgttgcttcagtttttttcagatttggcctgggagaattctccctggaagaattgtgtcttctctatgtattcagtcatttgttaatatgagtatggacccacggatatttatttagtactccaggctacgcaccagtggctgggttttttttgttttgtggctcaaatccatccagctttggccactgggagtgctttcagttggctcttctgtcctttgacacgcccccagcatcgggtgaattttgaggactttcttgctttttggcaccaagagatgctgcaggctcatgtagtctatttcccgcccactccctcaaatcagccatttctccaaggagccctggtttcccttcttacagaatggttttgggaaccaagacctgggtcctggatgggcctgttgcttctggggtgtcattgctcctggggccctctcagtggtcagtgctaggagattcatgtgcgcgtgctgatgctttgtgcacgtatcgtctaaaaggccttctctgcctcggcatctgtttctgtgttaagctgaacgtgagttcataccactgtctgcggctctgagtgaggaccacaggttccttctcacacttccaccctgtgtgtgcgcccattctcagcttccgtggacaacagtttcagagtagtgagccggtacctccgggaagcatcttgagccactagagcgcaggccttggggccagttccttgtgtgttcagacctccagattgcagtcagattccatttccagggtgatagaggtcaccttcttcccctacttcagtgaggttgtgaggtgggtgctcctgcagtctttcccactgcgccccacctgggcaagcgtccatgctgtggaacgccagctcctgcaggccagaagagggcccgcgcgctaggaaatgtttacggcgtatgggcatccggctgtgccggccctctcactgggaattgctgcctcctgccatgagctgcttgtcctgcctccgtttggacctctgtctctgggacctgtcccctcagtcccctcctgacccttgctcctggctcttctccctcccagtgcagatgctccgcacacctccggcttctcccttggtgcgctgactgtccccatcactccagggaggtttcactgttcctgagtcagcggaagcacagggtcaggccctacgggccaggtccggtggctccaagatgccatcagggacccagcctcccccaggtttctgcccagtcattcttgggtgactccaaccctcaggctccttacctcatggttgcaggacggctgcactgcctccctcgcctcatgcaggagagtgggcaggaaagagttctaggagagtgggcagggcaaaaggcagcagaagcgcaaggctgctgagcctctgctccccacgcttcttcaggaactctccccagccttcaccacagccatgcgtccttctgtctattggctgtgccgcctggttggctgtggcttccagcggggctggagatgggttcatggtggacacagcacctccctcgtggagctgcttgggggcaaaccacgagtagtccctgggactccagcttcgagccctgtctttacggaccaccccgtctagactttctgagtggcttccctcccccactgaaaactccctgccccagagttcctcccagagcccgtcccctttgggactcagctttattaccgcctccaccctctcctcagtctctaggctgtcggtctcaggtgactcacccctccccactgcattctgcctgcccccatgtcctccctcattccagccctggtcatcccacaggggaacagccacgagttgccgctccctcccatccctgtcctcccgcctgccacctgagccaggccccgcctcgcccctcactgtcctcgttctctctcacagtcaggaaccttccgtggctggagggtggcagaaagactgtttggtgtctcctatatcctcaggtctccacagcactgttgctagcctggctctgggcgtgaagcctgtgctctgaagctgcattttcccggcagcaggtccaggcttccccagccctggcagcattgtttctgtcccccatcacatctctgtgtccctacttctcactctaaagggccttgccctcttttcccagtggcctcccttctgtcctctgaggcagagcccttcacgtcctcgccagtctctcttcctccctccctccctcagctgccctaaacacagtttctctgcccactcggagggctgtggccatgttggcctcgcccctgacagccagtggctatgggtttgcacagtgagccattgatgagagaccggcacttgactctcatttccttgttccatcagaacgctgtccaactgggcgtacgagtttgacaagtgggccccctccgtggtgaaggtgtcttacaaggtaggtcacagccactgaggtttcctctcttgctacggaggtgcaggcggtggtgggcaggacgtccacacatacctctggacagtgaacctgagaatgctgggtctccagtcgcatggagtctccaggacagcctggaactccagtcacatggatccgggagtttggactgggcagggacagggcagattagctcactggggaggagacaggagtgagcatggtggccagcactcagaggccagctcaggcgcctgagatggggacccaggaagaggggagcctgtcagccaccaggaatgtgcagatggcggtgcaggctgcgtggttccctcaggccccggccgccgctggcctgcactgcttcctcttccccctgcagcgcgtgttctgcgtggtgaggtctggggacgcgccagcggccctgccagcccctttccccactacccctgtgaggacgagccctcccgccgtgtcactgggcagttgcagggggtgcctgtgcccctcttgccacctggccacccggctccaaaagccgagctgtgcatcctgcttcccttgcagggatccccagcagcaagacgggcctttgtcccccagctccggagtgggaagttcaacgtcttgctgacgacgtacgagtacatcatcaaagacaagcacatcctcgccaaggtaacgtgtccctgtgggaaatgccaggccatgggccgagtgctcacacgtgggtcacgctgcccgtctcctccaaagcccctacaagtttcttcccggagtcccacctgcatgtgcgtgaagacagctgccctgtgtaggggaaaggcctaggtgggggcgacctcaggtttacctccctaactgtctccaggcaggccctgagtcaggcccagaagctggggccatctacacagcatgcgctctgcctcctctcgggccttctgcccagagagcctcagcaccaaggcgtctcctgacccgcctacagagtccccatggggccttggccagaccagtcttgtcctcctgtctcattgccttggccgtccctccctggggccctggcttctcaccacaggccatgggctgagattcagcatgtgggggagagctcgagggccaaataccatgactgcctgctggccttgggcagctggttcgggctgttctgtgagggtcctactgtcctggaagcctcttctgggacgaaactgtgaagggagtcccagcgtggccatgactgagaatacggcccagatagaaaacagacatagccctctgcctccaaaaactcatgttcctcatttgaggaggggtaaagatgtacctggtctcacccctaaacatccagctgagtgagtgttgaacagtagagagttttttgcgttttggtttttttttttttgagaccgagtctcgctctgttgcccatgctggagtgcagtgatgtgatcacagctcactgcaggcctgacctcctggcctcaagcgatcctcccacctcaccctcctgagtagctgggactacaggtgtgcgccaccactcccagctaacttttttaaatttattttttatggagatggggtcttgctgtactgcccaggctggtctcaaactcctggcctcaaggaatcctctcgccttggcctcacaaagcactgggcaactgtgtctggcctaacagtagagttcttgacccaggtatggggggatggaggagctgtttatgggtggctccgcctctcagtgcatggctggagtgacagtactggaatactggggctgtgaactgggtgttttcttttctttttctcttcttttttttttttattgagacagagtctcacagctgtcacccaggctggagtgcagtggagcgatctcagctcactgcaacaacctctgcctcctgggttcaagtgattctcctgcctcagccttccgaggactgggtgctttatcccggagccaacaagggaggaaactgaggcccagggagctgggtatcccacgtgcaggctcttacctcaggtccatgcttcaggtgcctcctttgtggctcacccctgctgactccttacaaagccaggccgttggcaggcacaggaaccaggctctgaaaccccgtgctcccctgccagtggctcagttgatgtaatcaccctgcagtgggagtgctctttgagtgcggccactgcgccccctcccgacccgcatggccctgtatgtagtggcgctggcccctaccccatggggcccacattctgaaccacaggctgctcattagaaatgtaccgtcaccaacccagttcccctgagaccctccacaccagcaggacaagtcccccagtcagcaagatgtgtcttctgccagaacgtgctcggcatttttctgtgctgtagattcatatgtgtgattttgcagggaagccagattgcttttttgcaatttgcattgttcacctgccaatagtcatggggtcacgggcctgtctctgcccaaggcttgcaagaggctacgttgtgtggctccaactcggtgagtcagccccggggcaggacgtcaggcctgtgctctccacccagctgcgctcttccacctggagccttcctggctgctgggcgcagagtgggagattctccccatgtgccgggccacctgctgccccctgccctgattgcccactctggggcccgcagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtgggtttgcccagctgtgcccatgctgacggttccaggtgcggctggctttgctggttggaacgtgttgagcaccagctacagctggctgggcctgtgctgggtgcctggtgagagtctgcatctgcatggagcaggggagccctggaacccaaggctggggcagccacaagggccccaggggagcagggcagaggtcatggtggtgaatctcggaatgctcggggcgtctctgaccctatgctccaggtgcagagtggatggtgaggaagatggccctgaggcagctgtgggaccgcaagcgtgtggagagcacagctagaggctgtagcgtgctgtaggcccctttaggtgccctcagaactcaccctcagggcagtgggaaggaaacttggaagattccagttagcggggccacatggtcaggttctgtcttacgttgttttcaaaaagctcagtggccagtgtgtctcaatgtctgggtggcaccatcagccagactgtggcatggcagcatcatcattgatgagtggtcccacaccagcactgatccctgagcctagagctccttgctgttggaggttgaaactgtgggacagactgtgtttcctgctgaggggtttaagtaaccagatgctgaagtgtgggcagaactacagaggttacctcgaagtgccctgcccagcacggctgggcccacccccttcttcccaccttagacaggtccagggcagctggggccttcctggcctcatgcgtgagttccctgccctctcggctgctggtcaaggcagagactcttctgatggcgaaaccgaggcattccccaaagcctcgtgataaaggagtccccaatttttagactcccgggacccccacactaagggccaggatctgatgctatagttttgtcactttctgagccgagcaaaagctctgccaaaggattgccagggaagcaatagaagaaaagttttggcgtcgtctcattttcctttaacttttttaattaaaacattttaaaagttaattattagtagaggagtaggcgccgtgggaggtcagggtttctttcacctggttccacccaggctgaatgagagtcccttggggctcccggtggcagagccctccctgagaatcacccgctataagccccatgtggtcagcctggcccctgcagcgctcctggcatgagcttggcgtggggtgggtctgtggacactccagtttgtgttactcgtggagaagcagcatgcccgctgccgggggtctttctggtgaggcacagggagcagagtgctctgggtactgcggttccatgtcccaggaattacatggagggaaccagatcctcacagtttcctaaggaagagggtgccctgcctggctcccagaaagcataaagcaggctgaaaagccacgtgccaagggcaagatcaccccaggggaccccgtccaccctgtccccacatccgcaccttctagtgagacctctgtcgccctcctttggaggtaacgcttgcttctcctgtcttgggggcttccaggtggacctgaatgaggaggaaaccattctcatcatccggcgtctccacaaagtgctgcggcccttcttgctccgacgactcaagaaggaagtcgaggcccagttgcccgaaaaggtgatggagttttgaggggagccaccagtgaagcagcctcacgtgggggctttctccagggctgggcgtgctcagggcctctccccacagtcccaggcctgccctggtcaatccagcttgggggtggcgatgacgccactgggtctgtaaagccctgtgctgctgttgtagggattgaaaagcactcataggctcacatagctcacaataggttagagcacaaaatcccacttcctgtcagggggccaggtgcctgtgcgggctctcctggccacatcaggaggggccgtgggcttggggttgccccccggccccccatcatggctctgggttttcaaggcctgctgcagccacacccctgggcccagttcccacagcaagacccatggactcggggtccccggctgcagttgtccctcttggctctttgtttcctggctggctgtagagaggcccccagaagatggctggggggccctttctggcccagtaaccctctggtatctctgcctggtgcttcctctcattgcccaggtctcccctcttctccccagctgtgagggtctcctcacccacaccccagtgtgctctggtcagagctcatatgacagggccgagggggtcagagctgggttcggatggggggagtcaggcctcaagccaccttgggccctcgtgagcattatgtgtcccctgcaggtggagtacgtcatcaagtgcgacatgtctgcgctgcagcgagtgctctaccgccacatgcaggccaagggcgtgctgctgactgatggctccgagaaggacaagaaggtgggccccagagtcccccaactgcattccccactgggtgtccaaggccggcagcgtggcaggcagagcagagcgtgctctgaccatcgggtcatgatctggtcatgatccccagggcatctggccagccctggttatgatggctggtggcttgtgtcaggacacactgactcagctgccagtggcttctcctttgcctatgaaacactggctccttctgcaattggcagcctgggcccagcactaaccccagcagggttagagtgttctagaatgccccccttctctgttattaagtgaaaggaagggagcgggctgtctcctgcaggggctgctctgagaatcccaggccccaggccccacctgcctggctctcctcaccagcagtgaaattatcctcccaggaaatgcaccagaccccttgattctgcccccaaggccttgacctcggcctggcttccccgagacgttgtgtctgtgccccttctcccctgagctgagcagcagtgtgttccctagtccattcccagcccagagcatgcaccccccgccccgcccccacctccttcctcatcctggagcccagggagccctgagtcatggctcacccggctgaggccctcttgcccagctgagaccctctagggacccccacagtaacagtgcccagaacaaagctggcatcacaaagcatcggggactctgcctcagccctttgccagtcttgtttccgtcccgtcctgctggccctgtccctgccatctgccctctgctgtgccaggcagtcatttgtttcccagggcttgttgggggcctccgggcctccagcctgccatctcctcactcccaattgctgtgccaaaagccactcttccccactagagcgtccccatggcccttctcccaacacccacccatccaccaagcccaccccaccccaggagggcaagaccccatttgggtccctctcatctgccttccagggcaaaggcggcaccaagaccctgatgaacaccatcatgcagctgcggaagatctgcaaccacccctacatgttccagcacatcgaggtgagcccgccgcggctgggacggctcaggccctgctgtctgctgagctcctaggcagagctggcttctcctcgacagctctttaaaaacagactcgaatattttcattaggtaatgcctgtacatctgtctctcatttggtcttcgcttcaccagtgcttacgggaagaatcccagcagttagggcgcaacgtgcgataggaatatagggccctgaaagcttgccctcagagagcaggagcgtttggagacttctctggggatgtgtccccccacagtggggtcctgctgcgtctctttggctcactggcttttctcacgttgcggggcgtcaagagtcaccaccgtcttcagtgaagtgtgggggagtcagaaccctttttggtcatggtggctttgagaatctgggttcttagaagcatgcatatgttcgtgtttcttggtgtaaagtgtcagggtcgttggagaccgcctgctgccccgagagcccctggggctgtctcagcaccctgagcgtggctgtggccccatgacgtcctcgtgcattcagggtgtgaagagtgctgtatgggatgtcctttccttcgttggaggagtgtgagggaaaggatgtcagtggactaagaaagatggttttggcatctgtgtctggtctcagagccgccgtgggcccgtgccgagcacacagtgtgggggctttgtcctctgagcacgagcggtgtgtgcggaccgcagcggggcccggtggcctgctcctgcctgtcactgacccctctctccttgccttgcaggagtccttttccgagcacttggggttcactggcggcattgtccaagggtgagaagcttcccaactggatggggtgggcaggtggtccacccagaggttttctgtcgttttgttggctttattgctgctgttatgttgtccaatttcaaaggcagaaaattagaaaatacagaagaatccaaagcaaataatacaaatctttttttttttttttttttgaggtggagttttgctcttgttgcccaggctggagtgcagtgacacaatctcggctcactgcaacctctgcctcctgggttcaaatgattctcctgcctcagcctcccgagtagctgggattaccggcacctgccaccacccagctaattttttgtatttttagtagagatggggtttcaccatgttgaccaggctgatcttgaactcctgacctcaagtgatccacccgccttggcctcccaaagtgctggaattacaggtgtgagccaccgcgcccggccccattatacaaatctttagtgcttggagagctgaccactattaaccccaagagacaggattcctgaggcagacctggcttacagatcccactctgccgcctccaagctctgtgactctagacagctttcttaacctctctgagcctaaactctgctcactagtacagaggcactctttacatcatgtgggtgttttctatagcaccctttgtaaggggcagcccagactcctttaagcccctaatggatgtggatgctgtgtctagattttcaccattgcaaagaaccttgctaaaagcattcttccagctaaagcctccattcaattcccctggggtagtaagccatttgcaagaagagaggcgcctaatgaaaacatcacaaattctttttgatgtgtttttttatactgagttgtggaacagggtcctgtacacctggcttcaaggctgggaggcctggcttggacatgtggtcagccatatcacgtcgtccccctgccagcctcagtgtccacatctacaacacttggggtttggctggagagaacatgagaagccgaggtggcccttccttctgggtctagcagagcatgggtgtctccagtgtggcatttgctcctggggcttctttatcgggcaaggggacaaggtctggcttcccggagcatccctgttccagccccgtgttgtgccggccatgtgactcacagctcctctcattttcatgagtgtctgggtttgacgagaaatacatgtgccaccctggtgatacgcctccccagcgagggtggccgggcttatttcagttgggggaaatggctttgctgaagctttgggtgggtgacgtctgcttaggatgcatgtctgtgcccttgaacccggcgcctggcctggaggcgggcgatgcacctcctgccttacctgcctgcagggttccaggtttaacatcctgcgccttctctcctgcctcctccacactccaggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggtgagtatgagccagtgaggcgtttcttacagggttttgttgttgtggctgccacagaagctcctcactggcattccctcctgtgaggcagggtgaggcccaggcgctctgggtccagtggccagagtgggcctagccacaggctgagcatcttgggcactcggcactgggacaggccgtggattggacgccgggtgtcctgactcctaggctgacagtctttccacgacaatgctgggcgcactggggaaggggtgccctgtgcacttttagctggaagtgacagaattccataccatgtggacacaggaaagaaagcaccaataggcttacatagctctaaccccaggaggttaaacatccttcaggcacagctggatccaggcatgcaggtgatattggagagacttttctccagctctttgctctgccttcttccatcttggcttcctttccacctgctcagtgtccccaacaaaggcaggtcccaggctggctctcatttagctgctgtgagccgcatgcccatccctgggccattcgtagcagcccagtgactgccaccttgccacaggtcaggcctggacctggaatcagactctgtggtgagcacggagggagggaagcaagcactgccaggcaggagcagcagctgccgtagagaggctctcagcccaaccccctgccctgcggtccctgatgggaaaggtcaccgcctgtgtttctgcgcctgcctgccccagcacacgggagctcagggaggagaggctgtgagatgccgacagggcacgtgagacatgtctgtcagtcccagtgggtcagggagccctggagtgagttcttcgtgggagttactagaactgggcttacgagaaacacgagcatgagctgctgagacagacacggctcagccagtttgttgttccctacacgacctcccagagcctttgttgaagctcctgtgcaaggtctgtctcacagcaggacaccccagacctccataccccttgtcccgttgatcacttggacctgtgtttgctgggccaacctgcccaggtgccacccggagtgtgccctgtgtgtccctccaaactgcaggtcctccccggggttctgtccaggaccactctacagacacgagtctgttgcaggggtctccccggcttgccttcttccttgggggcttcccactttcagctttgaggctgaaaaccaaaatccttcagggtcctcatggccgggccaccccccaccctttcctctcctacggtctctccagcggcttctcccgtcctcgagagggccaaggcttcctgagggccatcccgtctgtgtcgtgtccctgactcccccaggagagagcctggttcccacccatcccagtgcccttctgcctactccataaggacaaggactttggtcagttgaactacagatgtgtcctctgcatgtgatgtggtcatggccacagggccagagaatccattgcgagtagaggaagggtaggagctcagtgaagtctcctgagactgcatctcccatgggtgggctggcatctgggagccgggtggcccctcacctcagcccctcctccgagctggagtagcaggggcacatctggtgcctgagagagggtgggacggcaggtggatggccaggctactgtgggcttctgcaccgtgcctgggcatgtgtaggctggtggcaggaaatggccagtttttatttcttcttttttttgagacggagtttcactcttgttgcccaggctggagtgcagtggcatgatctcagctcactgcaacctccgccgcctggattcaagcgattctcctgcctcatcctccctggtatctgggattacaggcgcccgccactacgcccagctaattttcttgtatttttagtagagacggggtttcaccatgttggccaggctggtctcgaactcctgtcctcaggcgatccacccacctcagcctcccaaagtgttgggattacaggcatgagtcaccgcgcccggcctgccagtttttatttcatcaccaaaatgacttcagtgttcaggggcacctctgtccgaactcccagcagcgcagggagtgttgacattgccttaatgcccacaacgctgagggcatcgtgggttgtcacccaggagacctgctctggctccttgacttgggttttctggggcatggggacactgatcctgccagaaaggacacgagccccctttataaggtctccatgcttttaccgtagaagattctctttgtgaaccacaaaactttttgagacagggctgaaggcaggtgcacccacagtcactgtccacccacccccaggtcccttgtgttgcgagcggcggtgttgccggcattggccgctgtgtcttccgctccccatggaatggcacagggtagagtagaggagagaatccagggctgtggtggtggtggctgtgctgacgctggacgctgtggcctagctgtgggctgggtgctggactctgtgctccaggcccacctcctctagttctcccagcggggcctgttttcatttctgggatgtgtggagagacgttttgtggtgaaacactggaaatccagttattcgccagtggcccacaggcccgtgtggagagtgcggagccagggatctggggatgctggcaggtgctgatcctgctcctgctctcagaagcaggtgttccttggtgtccccactctacccctgaggtcaccccgctgaccctgttctcctctgtgcccgtcaggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggtaaaagcgggccgggccccaggtcgaggagaaggaagggggtgcctgcaaaacctcgaggagacggccctggcttgagggtcctccagcctcctccacattgtcttggaccccaggagccgggaggagctgcacccatatctccataggtcatcagggagaaaagaggcggggtcctcctgtttcccaaaatacaaacagcctttccctctgattgggaaagcagtgtataagccatccgtcggtttggtttttcttaaatcttggaatggcacccatgaggaggtggaaagtatcctgatcaatctgcgccgtcactgtggggcggcccctgcagtgtgccctgtgagcacacacactggcgcttgttcagacacaattgggggtaaactccatgccacttcgtttacttcctcctcttgttccataaccatgtacccctcatgggcctcggcatcggtggataccaggtcatgctgttacatagctacaagaatttgaaaatgagttaaacttttctctgtgtttcattataagactgataagttcttattgtttttaacatgtaaacaccagtgacagtcaggagtcccttttcccttcctctccaaccgtgctctcttctgagcctctgccagcccatctgccttcgcacatgtatgtactgagattaacacagatgcggcgtggcctagcatgtgcctcttccaccaagcagtgggtgtcaaccgccgagtgcacatcggaagctacccagccatctaatcggccaccaggcgtcccggcagatggccacccctggacgtctgctctcaaactctggttggcaggcatccgtcttttctgttgatcagcctggtcaccaacccagcagggtccctctttctctcagagtgcttgtgcaaacaccctaggtctgcgcagccctcagacatggggtcgctccaccccagacattgtcctcttcgtgttctggttgctactgccaaagtggtttcactcctacgctggggtgtgaatgtaccctgcccttccctgcagcgtgagggcagcagcgttctcagtgtgtaaattgtcgcttgtctgatgggtgaatgccgtggtggtcactggtggccccttttacgatcaggctggggtgtagcttctgcccagaccctggtgaccagccagtttcttaggaggtggttgagttgtgtgtccccgttggcaggccggcagcaggcggaagctgcacctcagggctgggggcgcgttggggagggctggccctgccaggaagtgtgctgacagggcaggagggctgagcggcagacacaaggcactcctggtccccaccagctgtggcctctgccaccccatgggtgccagtcttaagtttcagagcatcactggtactcaccctggtcctgcagctcctgggcccagagacaggatttcgtgttagcctcctcgtactgtgctggggtgatgataaaactaacaacccaggctggacgcagtggctcacacccgaaatcccaacattttgggaggccgaggtgggtggatcaactgaggtcaggagttcgagaccagcctggccaacatggcgaaaccctgtctctactaaaaatacaaaaattagccaggcatggtggtgcatgcctgtagccccagctactcaggaagctgaggcagaaaaatcgcttgaacttcgggaggcagaggttgcagtgagctgagatcgcaccactgcactccagcctgggcgacagagcgagactttgtctcaaaaaaaaaaaaaaagaaaaaaagcccatccacggcacctgcattgttgggagctaactgcaccagtcactgggccacactcctggtgcttattcactcattcgaggtatgcagtagccacgggttgggccccatgtaggctgagggagttttgaggctcacagaggtgagacctggttccggttctgtgtgcactgtgagagtggcagggcccacagccaaaccaagcactgccacaacacggccgagcttcggccccctgttgtaaatggtgctcgactgtgtaggtccacgctgtggggagctgtgccgctgccacgggagctgcttgagaatataatcccctggggggttggtgctttcttcccgaatatctgtggggtcccaataaggtagaaggtggcacttctggaggaacgtgatgagagtccccttcccccgagggacacatggcggcccaggctccaccagctctgttttcatgcggcggcaggtcaggctgggcagaattgtcaggccgagggtggcacgcacagcacacctctccagctagtgtcagaggccaccttcccttttatgacctcctgggctcctttgggactgactggcacctcttcccccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgaggtgagcccagcaccggccccgacccctccccagcgtgaatggtggacgcgtgagcggctttcatttttgtttttttaccttttttgcactcttattttttttgcatccctttggagtaaagggagtgtgggctgaacggaaagaggatgagtacttgctttttctttgaagtggtttttttttctaaactgctggtgaaagacgccggattgacagccctggagactgaagtcctctatttatccacagagcagacactgcagcacgggcagcggcagtgccagcttcgcccacactgcccctccgccagcgggcgtcaaccccgacttggaggagccacctctaaaggtgagaggggtagttcagtctccatgcccattcaatcctcggcttctcggctgagacggccagcaagggccctggtcccacggagcgtgcgtgtgcgtgtgcgtgtgtgtgcctttcgctgccgtgtgggtccccatccaccgcagccgtgccgggaccaccagctcattcccacggacgccgccgctcgcctctgagctcggccgccgcccaccccggcccctcctcagcggcactgacagtttgcaatcttataggaggaagacgaggtgcccgacgacgagaccgtcaaccagatgatcgcccggcacgaggaggagtttgatctgttcatggtaagcgctgcaggctggatggggcagttcaggcatcccactctgctgccaccaggagcaaagcagacgtcctagtgcccatggtggtatccctagcaggtcagggagccagggacagctcacagtgcagcccactcccacctccagactgacccgtcttccacccccagtctcctgaggatggcatcggagggcgagatgcacacccagccttctgcatgtgacccgagacctgccccaccagctctgttttctaacgggctctccagggcttcatgcactccctttcagagggagttcgccctatccaaggccaagggactgaccaggccttcagtcgcagagcccccttgcccctgggtgggaaacaggaaataagccacccaagcaggggccccttggcccgcaggcctcatgcctccaccaacgctgggccacgcagctgctgcccccctgctggggtctgcagccctcttgtgcaaccttccatcttttcgagtttcctctgcctcctgaggcagagcctctagtcagggtctgacggagccaggccaggtcagccactgaaaaatcgagagctactgtttaactctcgcagcagcgtggagccccacgggcagagaaaggcccttctgaactctcggtgttctggctctagcgtgcccctggtgcctgcatgctgatgcctctcccgttgcctccctgcccaccagcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggtacatgctggagaggcccagcagctgccgcaggccagcgccaggcagggctggggagacaaagggcccaccgccaggactcaggcctgggtccaaaatgctttccttgggccactcctggccaggctccgcaggcagccgagagccttccgatgtgggccagggatggtcaggtccttttggctctgccttggaatgcaagaaggacccacggttcctgagcagctcaaaacctgctgctggttatggttggtctttcaagtaaaagggtttacctcttcccgaggttaaaaatcatgttgctgatctcagtggactgctggctttcccagtacctgccaggagggaggcacaagggtgaatcatggactattgaggcgccctgcaaagcgttgcactgctggctgcaggcagcctcactttgggcaagtccccccccatgagctggggagactcagtcatggggagggaggagagggcaagcccccaagggcctctgaacctggcaggtgctgcacggggctggcagttgcttgtggagctgacgtgagggcccgttctcagcagatggcagctggccctgcaacagcagctgcagatgtctttgagtcagtcgtgcggtgctcctggggcttcacccgacccaactttcccagcccaaggcacactgtgacagatgcctggcactgatgtcctcactggggttacggtgacagatcagaccccttcccagctcaggggctctgagttatagagacgatgattcagaatccatccctgaagttgtgtcataaaaatgtcctgaagcaataattccgagaaggcaggtggcagcttttggctatgccatgcaaagtgccacacccaggaaagagccatgtggcctagcccatgtggccaaacagccccggttccctcctgggacctcagcagcccagactcatgagcttgcctgccaagctgtgcaccagagggcgctgttgaaacacaccaggagcccaggtgacagacaggccatcctgttccccagccagcctcccaagcacagcgctccaggacccagaagagaaaccctgaaaagacagtgtgagccctgccacagacctgtgtgacagcagagctgtttggctgctgtatgagtgtcaccggccctgcatttttttcttttttaataaagacaaagtcttgctgtgttacccaggctggcctccagttcctgggggctcaagtgatcctcacacctcagcctcctgagtagttcagactacaggtacacaccaacacgcctggctaattttaaattttttgtaaagtgggggtctcactgtgtcactcaggctggtctcaaactcctgggctcaaacaatccacccgcctcggcctgcagagtagctgggattacgagcatgagccacggtgcccagctcagccctgcatatttgaggcagtgagtaccttttaaatttaagatcagttcatacgtggctgctctatgtacatttttttctaggtgtaatttacataccatacagttcacccttttggggtatatgatacaatcatcttcagtgtatccaagagttgtgcatctctcaccacagtccattttagaacattctcatcgcccccaaaagaagccctgccccgatttgccattcctggtaattcatggattctccccagccccaggcaaccactgatgtactttctgtccatatagttttacctgttctgggcgtttcctgtcagtggagtcctacagcgtgggatgctttggtgtcaggcttttttcacgcaatgtaacatgctgacccatgatgcagcaggtgtgttgcattctttgatggtgaaataatcctgcctcgtacagatttgtcacattcggtttttctgtccattcttgatggacacttgggttgtatccactttcgggctattacaaacaatactaccgtgaacattcacgtacacgtttttgcgtgcacgcgtttctctttaatatgtgatttctctttaatatctgatttctctttaatatgtgcctaggcgtagagttgccggaacaatgttagttctctatttaaccttttgagggaccccagcctggtttccttggtggctacgccagttcacagttccaccagctgtgtatgagaattcctctttctctacatcctcagcaacccttgctgttccctcgcccgctgattctagccatcccagcacgtatgaagtgccatctgagtgtggttggatttgcatttccctgatggctaatggtgtggagtatctgttcatatgcttcttggccctttgtgtatcctctagaaagagatgtctagtcacatcatcctttacccaaatttaaaatatatttatcttaatattgaattgtaagttatttacaagtgccttatcagatatcatttgtaaatattttgttccattctgcacattctcttttcgcttccgtgatatccgttgaagcacagaagtgtttcattgtacttacagtcgatttttctttttcacctgtgccttggtgttgtatctgagaaaccatcgcctatccaaggtcacgaagacttgcccctgtcttttctcctaggagggttataatttgatctcttccatgtagatccatgtaagatccattttgagttaaattttatacatgatgtgaggtaggggtccatcttcatccatccaactggaaatccagttgtcccagcagcatttgttgaagagactattttttcccattgagcccatcttattacacagtatattcaaattcacagttgtgaaaaatattatacaaaacactgtctccccactactgttggctgtggaattggcaccacttttctggcagccatctgttgccaagtgaactcaaagccttcaaaatgctcctatggccgccatcggacatggccatgactgtggcagcctaaagcaacagaactattttctctgcattctgggccagaagtctgaacccacggtgtgggcagggctgtgttcctttcgaggccctaggagaggacccttccttggcttttccagcttctgatggttccagaagcctcctggcttggggcagcgtcaccccatctctgcctctgtcttcatggggacttctcctctgtgtccccttctgtgtcttttaagaacaatttttaaaacttaatcccaaaagtaaagacctcatttgcaaagaaggtcccattccgaggttccaggtagacatgagtctggggggcacccgccgctccgccctgggtctgcagggggccttctcctggtgcctcctgcctgctgtgccctccatgctgcttctttgacccggttgccttccatcctcctgggcccctcaggctctcagcttcccatcttctctaagacatgtctgctccatcattctggtgtctctctcttccctccttcctggcacctgacacgtttgttaccccacttgtggggtgttgctgtctgatcaccatcttccttccaagggtaggggaaagggccctggctggttcaagtcacagctctgtcctcagcgccaggcacagtgcccagctcactggcacagcctcagattccctggacacctggctccccggctgcattttttaccattgggataagttattagtaccattgaaaattaatacctggggattctcttaatattgttcatattcatgttcttctcagcagttttaccatgaggaatctgtcttaaacaatgtcagttgtcaatagcgttatttaaaatagcaacaacaataaaaaaaggtggtcagacctggcagcttgtgcctgtaatcccagcacttggagaagccaaagcggggggatcatttcagctcaggagtttgagaccagtctggccaaaatagcaagacctttgtctctattaaaaaaaaaaatgccaggcacagtgacacatgcctgtaatcccaagcactttgggaggccgaggtgggcagatcacctgaggtcaggagctcaagaccagcctggccaacatggcaaaaacccgtttctactaaaaatacaaaaattagccaggcatggtggtgggcacctgtcatcccagctacttgggaggctgagtcaggagaatcactggaacctaggagttggagtttgtagtgagccaagatcgcaccactgcactccagcctgggcgacagaatgagaccctgtctctgaaaaaaagggaaatgacctaaatgcccaagaacaaggggaggctaaattagggcacgttgtgcactgaaacactaaacagacattaaaaaattttgttgtagaaaattacaggaaaagatatccatgacacagccagcagtgtggcacgtgggctacaattccagcgtggccttcagttctgcacacgtgcgtcaaaggtggggagagttctggtggtgggtggcgctgagggctgcacaacactggggacgtgcctaatgcccctgaactgtgtactaaaacatggctgctttggtaaattttatgttatatatgatttataatatatttttttaaatgcccagctactcaggaggctaagatgggaagatcacttgagcccaggagttaaagtccaaccagggcaatgtagcaagaccacatgtctaagaaaatttaaaaatcggctgggcgcggtggctcacgcctgtaatcccagcactttgagaggccgacatgggtggatcacgaggttaagagattaagaccatcctggccaacatggtaaaaccctgtctctactaaaaataccaaaattagctggacgtggtggtgggcgcctgtagtcccagctactcaggagggtgagggaggagaatcgcttgaaccaggaaggtggaggttgcagtgagctgagattgcaccactgcactccagcctggtgacagagcgagactgcgtctcaacaacaacaaaaaagaaaatttaaaaataatttttcatacaaaaattagccaggtgtggtggcacgtacctgtaatcccaggtacttgggaggctgaagcaggagaattgcttgaacccaggaggcggaggttgcagtgagccgagattgcaccactgcactccaacctcggtgacaagagcgaaactccgtctcaaaaatataaaaataatttttaaaatgtcttaaaaaggccgggtgtggtggctcacacctgtaatcccagcactttgggaggccgaggcgggcagatcacaaggtcaagagtttgagaccatcctgaccaacatggtgaaaccctgtctctactaaaaatacaaaaattagctaggcgtggtggtttgcgcctgtaatcccagctactcaggaggctgaggcaggagagttgcttgaacccaggaggcggaggttgcagtgagccaagatcatgccactgcactccagcctggtgacagagtgagactccgtctccaaaaaaaaaaaaaaaaaaatcttaaaaagaagaaatagatggaggccaggcccagtggcttatatctgtaatcctagcactttgggaggctaagatgggagcactgcttgagaccaggagttcaagaccagcctgggcaatattatgagaccccgtatctacaaaaaatttttttaattagctgagtgtggtgacacgtgcctgtagtcccagctacttaggaggctgaggtgggaggatctcttgagccctgggagttcaagactgcagtgagctatgatggtgccactgcactccagcctgggcaacaggtcgagaccctgtctctaaaaataaataagtaaataaaagaaatagatggggagagtgtggaacagaggtgtcaacatcacctccgggtgaagggatttcaggagcacgttcttttctgtacagagaagatagttctttttttttggtcaagaaattcaaccattagttttttaaagacaagcttgggtggggtgcctgctgggggcagtgctggtctttcactgcagcccaggcaccccttgagagtcccagtgtgtgttatgccccgagccagtcaagctgaagggagagcgggtgcgggggccctcctccgtgtcccagcccggcccctgggattgcgtcgcggcctctgcttgtcgacctgggtgctggctgtcctattttactactattgaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacaggtaagcgaggaggcggggagggcgggggctgtaggggtccccgtgggagcaggcctggcatctgcactctgactctgcacactcaggcttgggccgctcactctttcactcatccacaaacactgactgaatctctgtgtctttgagcctggccctgaggaacatgctttctggaacagggaagcacacatgtatctgcggtgatgagagggaatgtcacatgtggtcgagaggagaggcaggggtgcgggtctcggagaaggggacattgcagcagagccttgagagaggggaggttggggagagtgcaccagcagaggccacagcaggcggagaggctctgccaaagttgtggcctggtggcctcaagggatgaggtgggatgaggggttatatggcagtaatgggtgctgcccgtgtggccaggaggttggggacaagaggctggcatgtctggagcagagaaagtggcagccctctcctgtccttgcaccctcccaggctacctgtgccatctctgtgttggtgagatggtggccacactcctgctctctgccaggccctgctccaagcctggagatcgctgtcctcacagacatgtcctatatacgaggcagcatgcggttccagctgtggccacggcccagcggcggatcataacgtgttggtggatcatgagtgccatttatatgtttttcatttactaatatccttttccgtgagcgactctatatgggtaccatttaaataagaagaaaggaatgttctcagcaactccccagggaggcatgtgcaccttctgccagcccagggcaggtcacagagctgggcaggagccagcaaaggtgtaaggcccatgcctggcccaggactcacccagtcttccactctccaaggtcttatttcacttcctggtacacactggccagtacggctgtccccgtaatgggagggttgtactgtttgattttaaataacagtttgctgttagtcatgaagcagagcgtgggggaattgtatctgttggaggggaaagtgaagggagcccacatgcatggtttggagagaatcttaccaagtgtgaagttttagaggatggtaacaattggagtgcctaaattaatgagtcaaaattaccgcgcaaggccagctgtggtggtccacacctgtcagcccagcactttgagaggctgaggtgggaggatcacttgaggtcaggagtttgagaccagcatggacaacatggtgaaaacccatctttactgaaaataggaaaacaattacctgggcgtggtggcacgctttttgggaggctgagacaggagaatcacttgaacccaggaagtggaggttgctgtggaccaagattgcaccactgcactccagccttgggtgacagagcaagacgcccactccaaaaacaaaatactgcttaaaaaggttcttttagccagatgcggtggctcatgcctgtaatcccagcactttaggaggccaaggcgggcggatcacttgaggtcaggagtttgaaaccagcatggccaatatggcgaaaccccctctctactaaaactacaaaaattcgccgagcgtagtggtgcatgcctgtaatcccagctactcgggaggctgaggtaggagaatcttgaagctgggaggcggaggttgcagtgacccaagatcacatcagtgcactccagcctgggggacagagtgagactccgtctcaaaaagagaaaaaaagaaaggttcttttattattggaagagaaacagatgatgaaggaaaggagacatattcaagttcaatgccagatctgaaaatgtcatgtgttgtcagtattgagaaaaaaatatatagactctaattcacaaacctaactccaaggctaagtcctcaaagaggaaagcaagtggaggacttaagttacttaaagtgcgggatacagctgcgggcagtagcacatgcctggggtccccactacttgggaggctgaggtgggaggatcacttgagcacagcaggtccaggctacagtgagccatgatcacacagctgcactccatcctgggtgatggaatgagaccctgtatcttaaaaaaatgaaataaatacagaatacttatttaaaacatgggccaggtatagtggctcgtgtaatcccagcactttgggaggctgaggtgggcggatcacttgaagttaggagtttgagaccagtctggccaacatggcaaaaccccatctctacaaaaaatacaaaaatagaaattaaactggcatggtgatgcgtgcttgagctcccagctcgggaggctgggcacgagaatcgcttgaacccagaaggcagagggtgcagtgagccaagattgcaccactgcactccagcctgggtgacagagtgagacaatacctgaaaaacaaaaaacaaaaacaaaaaaagggaattcgcagaaatctaatgacaatgacagaccctccccatgttttatttctaatgataatcttgtgagggaaacttaacattaccaacctaaagaagacccttgaagcgcagtggggaaagcacgggtgtctccatcacactggtctcctgggtatccacgtagagaggatgagcctcgaccacccccacacacgcacacaccatgcacttggatccacgtgacatggactgtggatgtaagaacgtgaaaggtaaaacaaaattctagaagaaagcacgggagaaaatcttcatgagtaggcatcgatttcttccacgggagccaaaagccactaatcacaaacaattgagaaattagacctcactgaaattaataacatctgtttattaatggacacgctgatggagacagtgaaaactcctcatagatgaggaaaagacaacacaatttaaagctggacaagagccgggaacagacgcctccttacacaggacatcccaggactaatcaatgtggggaaaggtgctcacgtcattgcattagcatcacaacttcaagaaaatgctcgttaaaaccagagtgacttgcaccagcacccgccccagaacggccgaatgcccatcagtgctggcaagtctgaagcagtctggcctcacaccctgcgtgtaggagtatgcagctctttggcaatctcttctgttttgctttgtttgtttttaaccatcgaactgcagaagataatattttctgaggctcagcctgtacataccctctgacccagcagcctgcagccctcgttctacccaggagagctgagtgcatctgtccacaccgacagacgtgtccatagccactttggtcataatctcccaaaacaagaatcagcccagtgtccatctacaggggcatggatcagtggaggcctaatcgtacagggccccaaacagctgtgaaaacagacatagtactgctacctggaagaagcttacattttgttgagtgaaagaagccagacactaaaaagggcatactggccgggcacggtggctcacgcctgtaatcccagcactttgggaggccgaggcgggcggatcacgaggtcaggagattgagaccatcctggctaacatggtgaaacaccgtctctactaaaaatacaaaaaattagccgggtgtggtggtgggcgcctgtagtcccagctactcgggaggctgaggcgggagaatggcatgaacccaggaggcggagcttgcagtgagccgagaccgcgccacggcactccagcctgggcgacagagcgggactccgtctaaaaaaaaaaagagggcctactgtgtgcctccagttctgtgagggtcagaagctgatccacagtaatggctgccaagcagtgcttaccttgagagagggaatagcaggaaagccacacgacgagccttctaggatactggggatattctctctatagatctggatgtgtatatgatgtgtacattcaccaaggtgtacacatgagatatgtacacttctctgtattccattacaccttggtttttgaaaagacagaaacagcatgctcagcttattaagaacctgaatattttcagacaaaaagtatgtctagtgttagtccacttttttttttttttagttttagactcacagagccctcttagggtcatatttagttgtatatcatctgacaaaagagggaatggctcacccagctgctacagtcagtcttgtagcctttgtaagatttgatgataaatcatacaataaattaaaactttcggctgggcacagtggctcacgcccataatcccagcactttgggaggccgaggcggaggatcacttgagcccaggagttcagatgagcctggccaacatagtgagactctgtctctatttaaaaaaaagaagaaaaaaaaagtctgggtgtggtggctcacgcctgtaatcccagcactttgggaggctgaggcgagcggatcacaaggccaggagatcaagaccatgctggctaacacagtgaaaccccgtctctactaaaaatacaaaaaattagccaggcgtggtggcgggcgcctgtagtcccagatactcgagaggctgaggcaggagaatggcgtgaacccgggaggcagagcttgcagtgagccgagattgtgccactgcactccagcctgggcgacagagcgagactccgtctcaaaaaaaaaaaaaaaaccccaaatcttaactcttactgctaagtgactgctttatcgaaactgttctgtttcgggacatttgattctggtagagattttgagacctgctttgaagaggacaccaacatttcagtcacacagcaatgctcctgtcttacctgggatccatgtgggaggatgcctcagtgggggatttgatctgtgttttcaatttaacctcacatcttactggaatggatggattcacagacctgggggtcgcccattggactgggagtaactacgttggaattacaagtaggacaacaaagatgactattaaagaaagcctcctgagtgctggaagcacagcaggcgtgggtctgtccactcactgtaatgtgatttgcacaggaaaacatcacatagggcacatcaactcaggaaagatagtcgttgaaaagctacctcagctgggcgtagtggtcacgcctgtaatcccagaactttgtaaggctgtgaggcttgtggatcccttgagaccaagagtacgagaccaacctgagcaaaacagggagaccccgcctatgcaaaaaatacaaaaattagccaggcgtggtggtgcactcctgttgactcagctattcaggaagctgaggcagaaggaccacaagaagtcaaggccgcagtggggtataatcacatcactgcactccaccatgggtgacagaggtgagaccctgttgcaaaaaaaaaaaaaaaaaaagcaaaagaaaagctgcctccatttagcaataatttcaaacatgatgtttgggtacaaaattggtgtacttaatggatatttctgatattcttaactaaatttgaagctgtgagggaagacaaactcagggtccacagggtgggaaaagtccacaagatcaccctcaagtgccgtcattctctaggaccccgagagccctagcggttgttacgcttgcagttatgatttattacagtgcaaggctacagattaaaatcaaccaaggcaagagatgtatggggcctcttgggggccaaggtgggcggatcacttgaggtgatctggacggttccagacacagggctttcctttgtctcctccctgtggagttgaagacagcgctgatgttcccggtgacgttgactcagagcattgccaaccagagaagcctccgtgtccagaggtttttttttttttttggagatgcagtctcactctgtcactcaggctggagtgcagtggcactatcttggctcactgtaacctctgcctcctgggttgaagtgattcttctgcctcagcctcctgagcaactgggattacaggctcgcgccaccacgcctggctaatttttgtattttttagtagagatggggtttcaccatgttggccaggctggtctcgaactcccgaccttaagtgatccgcccgcctcagcctcccgaagtgttgggattacaggcatgagccaccgtacccaccctgtgtccagcatttttactgggacttggtcacaaagacacagctggctacccacgtggctgacctccatctccagcccctctgcaggtgagcagaaactacatagcccaaagccccaacctaggactggtcccagaccccacgtaaacaaagacagccattaggtgtgacattctaaggactcagagatcacctcccaggagccccaggcaaaagccagacctcatttggggcgaagttacattcttttttattattattattatttgcccatcattgtctagaagttacattctgtatgacacatctgtcagatccctggaagcttcctcgccaccgactgcatggcaggtggtgctcatgtcactcggcccttccttggccccacacagctgcaccaggctgagaagagcttgaatggaataaagtcagacacagctaacagctcacttttttgtctccaactttgaattgctcctttccaagaaaagaaaaaaaacttctttttgtttaattggatttttttttttatttattttttgaggcagagtctcactctgtcacccaggctggagtgccatggcacaatctcggctccctgcaacctccaccttccaggttgaagtgattctcctgcctcagcctcccaagtagctgggattacaggtgcacaccaccatcatgcctggccggaatttttgttttttagttggctctccagaaccctctaagtagttcagctctgcaattgagttaaatgtgaagcctgaaaagagactggcatctgtgtagacctgagttctaacaattcaaagagtgaacacgggacgttgtcctctggattcggtgtcaggagcctgcctcgccgagctggagagtgtgcccatgactgcaggtgggagccacatggtccgtctaggtggcgacacctgaggacagaagtggtttagctgggcacccgctgctgtgttggggccagacccttttggagaggcagggacgcccttcctgtcaggtggaatcttttcaaatattgcttttgatcgttggagatacttgcagccccctagttcgtgttttattctggcagaattgtgtttgacgtgacctctgtgttgacctcatcatacgtgtacagttgtcttgcctgggaatcttatactctgttcttctgcactcagattcacagccatgaggccgctcctcccaaggccctggagtgtggcactgccagctgtcacagccacggtcctttacattgtatacacagagtgcagtgacatgcccctcctgctcaggggccacagtaggaacaggctggagtgttctgtggtaccatgccggcagtgctggcttctgctgtccaggggcttgtggtggctccagtgggaagggccacgtaagcagaacaggaagtgtgagcagtgtccactgggaggagagggacaagtgtcccaggcagagaggacacagtgcatgcagaggctggagggaggctaggggcttgagtggggctgcgccagcaccaggggcctcacaggggccctgggccacacacctgcccttagccaagggcgtttctccttggtggtttgaaatctcaaaccacattgaggaacctgccagaaatcgaaaccagaattaagaaattaagttacatgtaggagattttactttaaaatcagaacatgcagaaacgttctctgtggcttcgggtcaggttcgggcttgtggggctgtacactgccagttgataccttcttccctgggttctgtgtttttttttttttttttgagacagagtcttgctctgtagcccaggctggagtgcagtggcacagtcttggctcactgcaacctctgcctccctccctgggttctttatagcagtcagcagctggtggctgaggcatttggggcactgtgtccaagtgtcaaggccgcatgtgtgtcagggggcacacccttggtgtgcttggtaagggctcagagaagggcatctgctggtccatgtgggctcagccagcagcctgctaaagaccaccccgccagccaccagcctgcctgcgacagtgatagggcagagatgctgctacaataaagaccatgcgggccaggcgcaggcgctcacatctgtaatcccagcactttgggaggccaagccgggctgatcacttgagctcagaagtttgagaacagcttggccaacgtggcaaaaaccccgtctctattaaaatacaaaaattagccaggcatggtggcactcgcctgtaatcccagctacttgggaggctgaggcaggagaatcgcttgaacccaggaggaggtttcggtgagccaagattgcaccactgcactccagcctgggtgacagtgagactacgtctcaaaaaaaaagactgtgctagacggtggtgttgaacttgaacttgatgcttgtgctgaggtcaggagacacgtgcacagcttcagggctagaggggcacaatggctgcagactatgctcgggcagctcggaaagacggtgacgggtccaggctgccgcagctaagcctcacaagagctctggccccaccaggcgggccctctgggttccattcccactccccactgcctggaggcagcagccctgtggttactgtaggagggacctgaatgcagtgaagatctgcactccacacctgtctctgtgcctcagtctccacgtctgcagcacaggggcctgactgaaataacgtggccaggcacacagcccagacgccagcactgtgtgcactgtgggaggggacgatggtccctagcccagggcctgagctgctgccttgccaattcgtggtgacagctttggcctgggtctggcaggggctggctgctactgctgaaggcctgtctgcactgtttccctgcctttccacaagcactgtccctcctggctcttcagagttgagtggttataccttgtgcaagaaaaacaatgaaacagattgtctgaatgtttcagacctgcctgaaacattctgcaggagaggtcatcccaaggcttgaaagtgtttgtcacactccttcaagcccccagggcagggcccctgagggaagggtgcaggtggagggtgggcaggagtgggagccattccttggggacaggggggctcctcagggctgtctggcccttggcctgtggttccaggtctatggtctgcttggcacatagcctggaccctggtgctgtgcaggcactggctggatgagggcaccgagcagatgagccccaggcatgcccacttatgggcataggctgggtgcagggcactgggtccaacataaccatggcagagggctcagggggcctaaaagtcatggatggagttgcccacgcagcctgcggtcaggttccctgtggagccgtgctggggttctgcgcctgccccaggatttgctggaagaagctccccctcctctgtttgtgagtcgggccctacccccaagtctccccctcagtgatagagacctttacataacacaaataaacaaggcaactggtttagaagaatgagtctgaaaactagaatggcgtgtttaaggaaagcttaggacaggacaattagagacagaggtgcaggtgtgtggagttggcagcaggaggcctgggggagccgctcgtgcctttccctcctgccctggcctcccttggaactcggagcagccccctgccttgaggaggcccttcctttcagtgagcctgtgccgcagtcgtccgagggaacacagtggggacatatttccttttttttttttttttttgagacagagtctcactctgtcgccaggctggagtgcagtagcctgatctcagctcactgcaaattctgcctcctgggttcaagcaattctcctgtttcagcctcccgagtagctgggactacaggcatgcaccaccacgcccagctaatttttgtatttttagtagagatggggtttaaccacgttggctaggatggtctcgatctcttgacctcatgatccgccagcctcggcctcccaaagtgctgggattacaggagtgagccaccatgtccggccggaaatgtttattaaaatagcagatgaggccgggtgctgtgactcaggcctgtaatcccagcactttgggaggctgaggcgggtggatcacgaggtcaggagttcaagaccagcctgaccaagatggtgaaacccatctctactaaaagtacaaaaattagccgagcgtagtgagacttgcctataatcccagttacgagggaggctgaggcaggagaatcgcttgaacccaggaggcagaggttgcagtgagccgagattgtgccactgcactccagcctgggcaacagagcgagactccgtctcaaaaataaataaataaaaatagatgatcatagacaggagggatgaagtagaagattcaaagcagcttaaaaaaaggaagtaaaaaagaaataaggtcaggagacaagattgagtgactgtgaaacatcaacaataggcagatttaaaataaagtcaggaaatagctagatcaaagaatagaaaggtgaaccaggtgtgatatccacctgtagtcccagcttcttgggaggccaacgcgggaaaatcacgtgagcccaggagttggaggcaccgctgcactcaagcctgggtgacacagtgagaccctgtctcaaaaagcagcaggaagagaggctggcatgtggggctccagggggtgtgaaggagggtccacaccctccttcctccacctggccatactgagcagcacattctctgagccaacggcccctacaaacacccaccctttcctcctggtagcccagagggcgcccctgcctgctcacttcccaatgtcgggatcctgtgatttctgcctcttcagaaaggacttgaggcattttctgactcagagccactcaggattccaggacctcctgtggtgacaacagggacaccagtagtgatgaattcagaaaagagcgaacgcccctcaagctgccctcccccagccctgcagacagtggccatgggcctccctgcactcaggaccgactgcacctgcctgcggcgtaggggagctggggctggcctttccttttcatcttcccctggcactgggaaatgctctgggtggtgccatgtataacaccctttgtcacagtgctctcatttcgtcgtgtaaaaggccagtccccgcctcgcagtgttggggcagccagcacaggcacgtgagacaggagccacacctgggttctcatctggcatctgcctcttgccatgctcaggttcttgcctccagatatagggcatcaaactaagtggtttccaaacttgggttcttggtggggagtgagatcagggtttcttaaaaactgcacttggaggctgggcacggtggctcacgcctgtaattccagcactttgggaggccgaggcgggcggatcacctgaggtcaggagttacaaaaaacggaacctaggctcatgcctataatcccagcacttcgggaggccaaggctggcgaatcgctggaatttaagagttccagaccagcctggccaacgtggcaaaaccctgtttctactcaaaatacgtaagttagccgggcatggtggtgggtgcctgtaatcccagctactcgggaggcggaggtttcagtaagccaagattgcaccactgcactccagcctgggtgacagagtgagactccgtctcaaaaaaaaaaaaaaaaaagaaagaaattcaaatctcagtgtcgataaatgaagttttgttggaatgcagccaaagcccaccgatttctgcgttgtctgtggttcccttcatggaacagtggcagaactgagcagttgcaacagaggcaggcccagcaagcctcaaatatttacactgagctgagcgcagtgactcacacctgtaattccagtgctttgggaggctgatgtgggaggatcccttgagcccaggagtttgagaccagcctgggcaacctagtgagaccccatctctacaaaatattttttaaattagccaggtgttgtggcgtgtgcctgtagtcctagctacttgggaggctgaagcagtaggatctcatgagcccaggagttggaggcttcagtgagctaggatggcaccactgcactctagcctgggcaacagaacaagatcgtgtctgtaaaaagagagaaaagaaacagacaattcctagactgcagcaggtgtttgcagtagtgcatccagcaaaggactccccagggaaggaaatgggccaaagatgggaacaagcgctgcttggaagagcctgtgaaacagtgcttggcttctctgcacaacaaggaaacgtgtttagggccacattgtagaatggctacaaggacaagcaccactcacgctggctcagtatctcccaagtagagcatttccccaccctgtgacctagagtatcttctcccagataaattcctaggagaactgcaaactaaacacttgttcctgagtgtccacagacacttgcttcctggtgtccaaccctgagcacagcccagatgcccggcagcgggaactgggcatggctggtgtgtgcccacctcgggacctgctgctgcactcggcaacagggacagcaaggaggcaggaggccaggccaggtttgggggctcccctgtgtgtttctgcatcatcaacttgaagaagcagccaacctcggcccaggatcatccctgggggaaggactgacaggagcgcatctttagcctcatgcttaagatctgtgcattgggccaggtgcggtggctcagcctgtgatcccagcacttttgggaggccaaggtgggtggatcaggaggtcaggagttcgagaccagcctgaccaacatggtgaaacccgtctctactaacaatacaaaaattagctaggtgtggtggtgcacctgtaatgccagctacttggaggctgaggcaggagaatcgcttgaaccctggaggcagaggttgcagtgagccgagatcacgccactgcatgatgtgtgcattggtgttaagtcagctattaagaggtgtgggctgggtgtgtgtgggggtcagaggaggtgatgtttgccctgagatgaggtcagagcccacattcccatgggggtggactcccctttgtaggccttgacacgagcatgggagcggagctaggggcactgacatcaaaggtggtggcgcctatccagaggactccgggtttcattccaagtgcggggaggctgcagcatgtccctctttaatatagaggtgagggaggctctcagcaccctgcctgttgcagggaagcctgaggacaggacctccagggaactctgcaccagagcggaatcctcagaccggcaactgggtggtcttgattcatccagaacgtaattctcctagaggtctgggaaggggtgctcttgtaccttggttttgtgttttgtttttgtttgttttttgagacagagtctcactctgtcgcccaggctagaatgcagtggtgcgatctcggctcactgcaacctctgccacccaggttcaggtgattctcctgcctcagcctcccgagtagctgggattgcaggtgcctgtcaccacgcctggctcatttttgtatttttagtagagacggggtatcactatcttggccaggctggtcttgaactccggacttcgtgatccacccacctcagcctcccaaagttctggggttacaggcgtgagccactgcgcccagccgcaccttgttttttttttgctgcctgtagctgtttctcattagcctgatggaggtggctgttggggtggtggggtgcttattataaagccttctgctgtcacagccctggggtctcacttcctgggctctctgcatagggagccgccctccagggcaagggccacagtgtgcagtaagccccccatggccacagggcagggcgtttcaagccaagagtctgcactgtttgctggccactaagggcattgaatggatcacaaaactggcttttttttcccccagtcaaatagaaatggggttttgccatgttgtccaggctggtctcaaactcctgggctcaagcaatcctcccacgttggcctcccaaagtgctgggattacaggcacgagccaccatatctttaaaaatgtaatagaatggaaaatggcaaagcgcgctgcttttcatagaagagactatcgcattggggttcttctgttgcccctgcctgtgctgcacgtcctgcttcacagtgtaaagcgcaactcttgctgtgccttattgtaacaggtatagggtggatgctgccatcatgaagagagaggagagctctttgcttataaaattccgtagagtggagaacaggatgtgccggcttaggagagggaagaggtacaggcccgctctgcccgagctgcagatgggacacacatttcccgactcagaggggagtcgtgtctttctccagggtcaccgagcagcaagcgcatccactgtgtgttcttattttctgagcctgtggactgggtttaccaacagttgcctgtggcagagccggccaccagcccgctcataggaaaaaggaagcctgtgcctccagggagggcccacgatgggaatgcagtctgagaagggtatgtgctcccatgctggaccggctggtcccacacccaggaccaaaaacacctcctggcaggagatggggagatgtacttcatgaacacacgttggggaaggacactcctggaaggcagaggctcaaggcgggctgtgtccaggccaggagattcactcccacctcaatttcctcctcagcacggctggcctggcactggtgcctgcttcagagtttagtgtgtgtaaagtgtggctggcccagcaagcaggggatgatggcggttgtcaaggccaggggaggtgcagggacaggattctggctcccgtgtgtaacgtctgcatctcaggaggctctcatgttagaagctgggtcaggggcttcgtgatgcacacaaacaccaaacaagcaggaggccttccgggatcctgctcacgagcagcttcctggaggcaagcctggcccgtctgccccttggtgacatcaggaccccagcaacagaaccagggaagccaccatgttgtcgctgccattttccagcgtggtaaacagaagcaagacaaggcgcactcaggacacccaaacagacggcggggccagccagtggcatgggcgggctgccctgccctctggaattttctgggaaagaacataaggaaagaagcggtgctgatgaggcagctggagttatcaggacccaagctcagctcctccttcccatcaggccccgttggccacttttaggcttcgtccgcctggtggctccctgcttggggccgttccctggctaggcccttcctctgggccaaagcagagaggagagcgcgtttgccatgcgttctcattttcccagcctgcgggctgggttctgtcagagcaaggtcagctctcagagcttctgtccccacccaccctgtcctcctgagccaggctcaggtatgggtaagagctgggagcgctgtgcacgaggcctggcagcatctcatcactgccgctgtaccgagtgcacaagggcgcttcctgtggtgttcagggggttagatcagtccccagtgaggacagagcagagatccagatgcatcccaggccggctgcagtggcttctgcctctaatcccagcacttcgggaggccaaggcaggcagatcacgaggtcaagagatcgagaccatcctgaccaacatggtgaaaccctgtctctactaaaaatacaaaaattagccgggtgtggtggctggcatctgtaatcccagctactcgggaggctgaggcaggagaattgcttgagcccaggaggcagaggttgcagtgagccgagatcattccattgcgctccagtctggcgacagaacaagactctgtctcaaaaaaaacaaaaaacaaaaaaatgtatcacaggcctgtttgtgtggttgtctctgggaaatgttccagaagctacaagaaagcacatgtgcaggccaggcatggtggctcacacctgtaatcccagcactttgggatgctgaggcgggctgatcacctgaggtcgggagtttgagaccagtctgaccaacatggagaaaccctgtctctactaaaaatacaaaattagcctggcatggtggtgcacgactgtaaaaaatcccagtgactccaaaggctgaggcaggagaatctcctgaacctgggaggtggaggttgcagtgagccgagatcgcaccattgcactccagcctgggcagcaagagcgaaactccgtctcaaaaaaaaaaaaagcgcatgtgcaagaaatagctcctgagctgagttggaatttctcatccttaaacaatgtgggaacctgctgaggtggggtgggggctcccgggtgggcggactcgggggtgatagccgccggttctgccttgcagcagcagtggacgtcagctcagcgaggtcttcatccagctgccctcgcgaaaggagctgcccgagtactacgagctcatccgcaagcccgtggacttcaagaagataaaggtaaccctgacgttgtacctgcgccccgcatgtgcccggaggggagtctgacccaggggcacccccatctgagagctgtggtgtgtgggcagaatgaccagaaaccacctaggcggtgccttgggctacctggttagggacctggtcgtgggcttttggggttccttgtaagggttgggggtgtcctgagggatgtcagtgggcagtcggtgttgggtgttccttcaaggtcccactcacttagtgctgggcctcagtcatgcagttcccatgcctagtgagccaggttaccgaggctggcgcttcggccacatcctcataggcacgaggaatcctagcccgtggggtctccagcacacagccaggcctgcgggcaggcgaggcggggtcctgaggtaagacctgctcctcccgtccactgcaggagcgcattcgcaaccacaagtaccgcagcctcaacgacctagagaaggacgtcatgctcctgtgccagaacgcacagaccttcaacctggagggctccctggtgagggcaccgctgggggttggggatgggccactcccacagctgggctttgacccaacccgcccctccttcccttctgaattgatgggttaaaaacaagtcccgctagctgtggtggttcgtgcctgtaatcccagcactttgggaggccaaggcgggaggatcacttgagaccaggagttcacgaccagcctgggcaacataacaagaccctgtctttaaaaaaaaaaaagaaaaaattaaaaatttccaacttgggatattttagcaattacaaaagcagtatgtatttaccgaagaaaataaagataggcacaacagaagaaatagactcagagtcctctgtctgttggaattttattttaaattccctggggcacattctcttcaaaggaatcctgtgggtttgttctttcctgtgatagaattgacacatacacagcctcaacttggcaaactttcttaagtgtctttgggattgattcctctcagaaaaaagacttgactttgatgagtttgggaaagatgctggcttcaacaaggggcatgtatttccaatgttattgcagacctcagagattgtgcagaaggagggaggcacctgcagctattcccaaaccagtgtgcctgacctttcaccctggagcatttcagaagtctgatgctcgggcccctatggaggaagattatggagagggccttccaccctgggtgggctgaagccccgacccgctgaggctcgcattggccactgatcagctgtccaggggcaacacagggctggggctggggctggggccagggccgggcaggcagccctccagtcgggcccatccactcaagcccctggtgtctctgcccagatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatgtgagtcccgggggggttcaggacgccggggttcacgctggcccgagagcccccaaggccccagcttttcacagccctcccggctcccagacgccccttgctgtgggggtgctgcattcccagagctcaaggctgtctttccctcccggtcccctccagctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggtgaggccgggcccccgagcaggcagagctggcatgtggcaggaggcatcccggggccctgatgggacagccctgtggggcggtgctcccacgcccccacgctgcaggtgggaaagctgaggcttgacctgccatggctgaccccaggtcacacagccagtatgtggcagggctgccactcaaagccaagcctgtgtgaccccggaaccagctctcagtacccgtgggtgtctggggactgggggacacgtgagtcctcaggacaggcagcaggcggtcccagggcaccagggctcctgggctgaggccgggcaggccagggcttgattagggttgggtaggaggtgctaggattggggacccaccagacagtgccccgtctcctcagtggcatagagaatgggcagaaacgccaagaccacagtggatagtttttggggtgcagtggggagccggagaagatccacttgctggctttaaataatctcacctctgtctctggcccttcctggctgtgggacctggcaggtcactttgcttctcaagcttcagtttcctcttatgcaaagcaaggaggctgcatggattagggggctgcccccaccgaagggcctggctcccgctgaagcccagcgaatgccattttgtcatcacagaagcagcaaatttcagtgcctgggaattagtctgacgaaagacgcacgtgacgtttgaggacattcatgaagtcctcatgtggaggggaggcccctgtgtcaggcaggagggtctgggctgtgatgctgtctctcttgcctaatccagagcagggtgttttatggcccatgccaggctgtttaaaaaggttttatgaggccaggtccagtggctcacacctgtaatcccagcactttgggaaactgaggcaggaggctcacttgagcctgggaggtcgaggctgcagtgagccgtgatagcaccactgcactccagcctgggcaacagagcaagaccctgtctttaaaaaaaaaaaaaaaaatatatatatatatatatatatatatatatatatatatgaaagagcaaagatctttcacagtcaggaagaaccaagatggtttggaagctgtaggtcaggggccaagggccaggcaggtgacatgggacagagcagggaaggcacgtggagcctcgaaggtcccgagagggccgagtgtggtcacagggactcgtcctgtagagaaacatgaagtttgggcatggccatggcgccatctcggctcactgcaagctccaccccccgggatcgcgccattctcctgcctcagcctcccaagtagctgggactacaggcgcccgccaccacgcccggctaattttttgtattttttagtagagacggggtttcaccgtgttagccaggatggtctcgatctcctgacctcgtgatccgcccgccttggccttccaaagtgctgggattacgggcgtgagccaccgtgcccggcccacatcagtgttttcttgagcaagtttatttaaagtttggcaggtccctggcaaggtgccctggcaggggtggccaacgcacactctctcctcctgtcccctctccaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccttgcctgcaggtggacttgtgcctggctcccaccgtttctgccagcaggagtggcgggggccacctcatgtccaggtccctgtccttctcctggcaccagaacccatggggcccgtttcacagaggaggatactgaggccccggcaggggaagaggacttgtctggtcacacgtgtggcctttgccactgcaggtctccagcatttgttcagctgagacctacagtgcagggagcaggcagctccatccgttccctgcccgtggcccagcctgggttggggagaccatcacagaaatgggcagatgccacatagagctctcagggccatgatgcaggaagctcagggcataatgggagcccaggtggtcagtgagggaagggacggagccgcctgctccctttcaaatccagaacataatttgagtttttgtttttttgttttgttttgttttgtttttgagacgaagtctctgtcacccaggctggagtgcagtggcatgatctcggctcaccgcaacctcagcctcctgggttccagtgattctgctgcctcagcctcctgagtagctgggattacaggggtgcgccaccatgcccagctaatttttgtatttttagtagagatgggtttcatcatgttagccaggctggtctcaaactcctgacctcaggtgatccacctgcctcggcctcccaaagtgcaaggattacaggcatgagccactgtgcccagcccctaatttgtgtatttttagtagaggcagggtgtcaccatgttggccaggctggtctcaaacccatgacctcaagtgatccacccaccttggcctcccaaagtgctggtattacaggcatgagccaccgtgctttgagtttttttacagtaagtcttggccggagtgcagtggctcaatcttggctcattgcaacctatgcttcctgggctcaagcaatcctcccacctcagcctcctgagtagctgggattataggtgcacgccaccatgcccaggtaatttttgtttttgtttttgtttttggtggagacagggttttgtaatgttgcccaggctggtgtcaaactcctgggttcaagcagtccacccgcctcagcctttcaaagtgctgagattacagacgtgagccactgtgcctaaccaatttgaattcttatcatttttgtctgttcattaagagccattattagtgggtcactgtcgtcatacttggctttaattcttgagatgtggtttcttctagctctttgaacctttttttttgttttgtttttaattgagacaaggtcttgctgtgtcacccaagctagagtgcagtggtgtcatcacagttcacaacagccttgacctcctgggctcaagtgatcctcctgcctcagccccctgagtagctgggaccacaggtgcacaccagcacacttggctaattattattattattattttttttgtagagataatgtttcgctttgttgcccaggctggtggtctgaactcctgagctcaagtgatcctcctgcctcagccgctctattttttttttttaatcgagacatggtattgctctgttgcccaggctggagtgcagtggtgggatggtagctcaacttccagagctcagatgatcctccctcttcagcctccagtgtatctgggaccacagacatgcaccacccagcccagcttgaacctgtttttagtagctgctttgaagccttttggtccaacatccggatccattc

SEQ ID NO: 15624 - DNA, 10546 bp, Human
tctcgctctgttgcccaggctggagtgcagtggcacaatcttggctcactgcaagctccacccactgggttcacaccattctcctgcctcagcctcccgagtagctgggactacaggcacccgccaccacgcccggctaattttttctatttttagtaaagacagggtttcactgtgttagccaggatggtctcgatctcctgaccttgtgatccacccacctcggcctcccaaagtgctgggattacaggcatgagccactgtgcatggactatttatttatttttttgaaacagagtttcaatcttgttgcacagcctggagtgcaatggtgtgatctcagctcactgcaacctctgccttctggtttcaagcaattctcctgcctcagcctcctgagtagctgggattacaggcacccaccaccacgctcgaatatatatatatattttttgagacggagtcccgctctgtcaccaggctggagtgcagtggcacaatatcggctcactgaaacctccggctcctgggttcaagcgattctcctgcagcctcccaagtagctgggattacaggcatgcagcaccacgcccatctaatttttgtatttttggtagagatggggttttaccatgttggccaggatggtcttgatctcttgacctcgtgatctgcccacctcggcctcccaaagtgctgggattacaggcgtgagccaccgcgcccggcctacgcctggctaatttttgtatttttagtagagacgtggtttcgccatgttgcccaggctggtctcgaactcctgacctcatgatccgcctgtctcggcctcccaaagtgttgggattacaggtatgagccaccgcgcccagccaattattattattttttgagatgcagtctcactctgttgcccaggctggagttgcagtggcatgatcttggctcactgcaatcttcatctcccagactgaagcagttctcatgcctcagcctcctgagtagctgggattacaggcacacgccaccacacctggctaatttttgtatttttagtagagatgggatttcaccatgttggccaggctggtctcaaactcctgacctcaagtgatttgcccacgtcggcctcccaaagtgctgggattataggcgtgagccaccgggcccagcccaagagaataaaaatgtgggtggtaaaaatttttttcccaaaaattcgtaaatgaaaatctcacatattatgcatactgcccaggagcatggcctagcactgtgcaaacactcaactgctggtcgttgcaaggattattattggccggcttcagtggctcgtgctggtattcccagcacattgggagatggaggctggaggattgcttaagtccgggatttcaagaccagcctggacaacatagtgggatcccatctctacaaagaattttaaaaattagccaggtgcagtgggaagattgcttcagtccagaggctgcagtgagctatgattgtgccactgcactccagcctgggtgacagagcaacaccctgagacagagagagagagggggaaggagggaaggagggaaggaaggaaggaaggaaggaaggaaggaaggaaggaaggaaggaaggaaggaaaggagagagagagagagagagagagagagagagagagaaaataatttttatttatttccaggctgggaagagatgctgatttctgcgataaaatcagtaggtacattttttggaatgttcgctatgtgccaggctagattttacagatgagaagtctgaagctcaggtaaggtaagtcacctgtccagggccacaaagaaaaaaaaaacgtgtgtctgaagccagaacgggagctgttgcggcccaactccctcccctgcccccaagcggcctctgggctcgggaagggcccctgcctcctcccgccaggcacttatctctacccaggctgagtgctggccccgccccctcggggatctgccacttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaaggtaaggatgagctgcgtgtggacccctacgctggagcctgcaggaccatgctggggcctgaactcccagcctaggtcctgggggccatgcctgtttctggacttcctgaccgggtcctgggggccaagctggcatctgaacccttagactgggtcctggatgggtggggggcggggtggggtatgttaggatccaagactcctgatcgcgtcccgggcaagagctagagtgggcttaacattcccgttttaccttttcagggagtctgggacatgctaaatcctaagggggctgacttggtgctaaggtccctggggggtggggaccaagccgaccctccctaggggagggagggtaaagcccgggtccgagttagaggggccaagccacaggctactgtaaacacggtttgtgtgagggcgccagatcacttgcccggcccggtggagggagggaggcggggggcacggttggcgctatcggttggcggggagcctgccggggccgatagggggcccgcctctccgcacacacccccagccgcgcgcgtgtcctaggctggggcggggctggcagtcccgagctcgaggtcttgaacgccgcgcccagctcagctggccgctgggtgggcaggtgtgcgccagtggtgacggcgggggacagtaaggcgagaaacttgcccctgggaattaggggggcaccacctctgcggacccctccaagggacccgcttgggaagatggcagggcggggcttttttcttatcgggtccgcccaggctgcgggagggaagaggagggggctgtctcccgaggatagagctcagacccccatgcccttcctttgtcgcccctccccagcggccttgctggcggcccgggggcccgaagagcttctgtgcttcaccgagcggttggaggacttggtgtgtttctgggaggaagcggcgagcgctggggtgggcccgggcaactacagcttctcctaccagctcgagtgagtccgatccggcgggtgcctccaagggcggagggagggggtggggcagagctccctggaggtcgtagcctcgtatgtcccctgctgtttgaggcccgacggcgcctccagtcgtggtcactggagggaaacctgcgggtccagggctggcacgccctctatgggccggggcgcgaacactcccgcgatcaccgctggaacgcgaccccaaacatcaggctgggataacaacgcctccaaatcgagggtaaggcgttactacgtcggggctgggacgccttctcgaggtagtatccaaaaggaggccagcagtggctcatgcctgtaatcccaactctttggaaggtcgaggcggaagaaccgcttgagcccaggagttcaagaccagcctgggcaacacagcgagatccccgtctcttaaaaaaaaattagactgggcgcggtggctcacgcctgtaatcccagcactttgggaggctgaggcgggcggatcacctgaggtcgggagtttgagaccagcctggccaacatggagaaactctatctctactaaaaatacaaaattagccgggcgtggtggcgcatgcctgtgatcccagctactcgggaggctgaggcaggagaatcgcttgaacccgggaggcggaggttgcggtgagccgaggtagcgccattgcactccagcctgggcaacaagagcgaaactccgtctcaaaaaaaaaaaaaaaaaaagccaggcgtggcgcgtgcctgtggtctcaactacttgggaagctgaggtgggaggatcccttaagccccagaatttgaggctgcagtgagccatgatcgcgccactgcactccagcctgggcgacgaaggaacaccttgtcacacacacacacaaggctagaccttgtgtcacacatacacactgccccccacaggccgggcaatgccaactccccggtcccccctcccaacctgctcccttccctgggcgcatagggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtaggtaagtgctctgggaatggaggagtggtcggaggagagggtctcagtcctcgcccacctgaccaacccccatgcctgcagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtgaggccagcccctacggcccagcccccaaagctccactgactacggcccagccacgcctctcgaggtcgcgcccggtgccgctttcagggccggtccgtaacatcccacatcccattaccctggtgctgaagaccgttccacgcccacagacacaccccctttcctaatgtcctcgcaagcctgttgaaccccaacttcttctccctccggcccgtaaccctagacccctttagcgcccgggtccctctacgagtgctagcccagatattaaattgcccgggtcccgccctttcgtaccagagactctctctctgattggccctgagctttcttgggctcctccccctactcttattggtcccattgcaattctagggcaccgttttcctttcccctgattggctcagttccaccagggcccgcccccacgtcatctatttttgtctgctacgcgtccctcgccctgattccgcccccaggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcggtgaggccccaggcgggggtgtaggaggagccagggcgaatcacggggcaagcccaccgccctgacctcctccccgcctcttagacctggaccccctcatcctgacgctctccctcatcctcgtggtcatcctggtgctgctgaccgtgctcgcgctgctctcccaccgccggtgagctccccatttgggcgctgggcccagactcctccccgccaacggtcctctttcactatggaaacctaggctcagagagagacacgcacttgcccaaggtcacgcagtaaggattcacatcagtggcagggctgggatgcatgccagactagacccagactcttcgttaacattttctgctcttggggactttcacctgattttccttctacatcaggggctgccatttcttgggtccctttgttagttcctttccccagtgtcatcacctttgtaaaatcaactagatggatttagtgaaagaatttaagaccctgaatgcctccgcacccctgcggtcaagcttctcagacactatgatcagactagccgttctgaggtatttgtaattccaagcacacactaggtggtttcacacccccaagcttttgcccatgctgttccctctgcctggaatgcccttcctgccttgtctgctaagcaatcttctagtcgtctttcatggccctgttcatttacttggttggaaaatacaaacagagtgccaaacatgtgccaggcactggagagagaatggagaacaagctagaccctgaccacaagtccctgaccttgtggatctcaagtcaacaaacaagggacccaagaaatatttgatgacaaattgtaatgagtgatatcacagaaacaaacagaatgtggtgacatgacaggatggtcagggaaggcctccaggaggaggtgacatcagagtggaaacctgaagattggaaggaagcagccgcttgaaaagtggggagaagaaacagcaagtgcaaaggccctgaggtgggaatgagattggaacgttcagccagcttcaagaattgccacatggcatggcctggcatggtggctcacgcctgtaatcccagcactttgggatgccgaggcaggcagatcacctgaggttgggagttcgcgaccagcctgaccaacatggagaaaccccacctctactaaaaatacaaaactagccaagcgtggtggcacatgcctgtaatccccgctactcgggaggctgaggcaggagaatcacttgaacctgggaggtggaggttgcgggtgagccgagatcgtgccatcgcattccagcctgggcaataagagtgaaactccgtctcaaaaaaaaaaaaaaaattgccacatggctagagtggtatgtaagggggtgtggcagatattgagatgagggaggtgacaggggtcatataacgcagggccttctgcagggtggtggggaggagtttggaattttttttttttttgagacagagtcactcttgtcgcccaagctgtagtgcagtgcagcagtcttggctcactgcaatctctgcctcccaggttcaagtgattctcctgcctcaaccgcctgagtagctgagattacaggcgtgcatgcccggctaattttgtagttttagtagagacggggttccaccatgttggccaggctggtctcaaactcctgacctcaggtgatctgctcacatcagcctctcaaagtgctgggattataggcatgagccaccgtgcctggcttggattttatcctaaatgccttctctcattaccccagaaggtaacataatatttatctatgaagtgacatcatggacctcctggaaaaatctgggccagggttttgggttttttaatttattttattttattttttttagagatgggggtctcactatgtttcctaggctggtcttgaactcctgggttcaaatgatcctcccacctcagcctcccaaagtactgggattatagtgctggtgtaaaccactgcacctggccatggccaggattaaagggagaatgaccaaggtatattgaactcctatgcacccttcaataccctgttccatttacccttttgtagggccttgctgatgcttcagccaaaacccctgtcccctggccctgatgtactcctctgcctccattgtgatcacagggaccaagtgtatctgtgcctctatgactgggagtggagggggaattggtgagtattcaatgagtcatatctatgtaactatttatattggcttcaacagggctctgaagcagaagatctggcctggcatcccgagcccagagagcgagtttgaaggcctcttcaccacccacaagggtaacttccaggtaggtggcctggttgtcccctcagtgcctgggcttccctgcttcttgcagccaaactgcaggcctctctgagcaggttggtgctatttcttcagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcaggccatgttctaagaaagtactctgatgacacttggtgtcaacaagtaactcagtgggagttttgctttaactacttctttttttttctgagacagggtctcacttttgcacaggctggagcccagtagctcaaacatggttcgctgcagcctcgacctcctgggctcaggcgatcctcctgcctcagcttttcgagtagctgggactactggcgtgcaccaccaagcctgactgattttttttttttttttttttgagacagagtctcgtcttcatcacccaggctggagtgcagtggctcgatctcagctcactgcaacctctgcctcccgggttcaagcaattctcctgtctcagcctcccaagtagctgggagtacaagtgcatgccaccatgcctggctaaattttgtatttttagtagagacggggtttcaccatgtaggccgggctgacctcgaactcctgacctcaggtgatccacctgtctcggcccctaaaaacacacacacgtaccagggcatgtgtgcaagaatgttcgcagcagtaaataaggcaatctgatgaagaaatcagggtatagtcacccatggaattatatgcaatatggaaaaaggaatgaactaaaaaaatgtagatgaatcttagtaacaacgttgagtgcaaaaagaaggaagtctcaaacttttttttttttttttttttgagatggagtctcgctttgtcacccaggctggagtgtagtggcacaatctcggctcactgcaacctccgcttcctgggttcaagcaattctcctgcctaagcctcctgagtagctgagactacaggcacctgccaccacacccagctaattttttttgtacttttagttgatacagggtttcatcatgttgggcaggctggtctccaactcctgacctctggtgatctgaccgcctcagcctcccaaagtgctgggattacaggcgtgagccaccacgcctggcctgaagctctttttataaagtttaaagcaatgaaactataaacaacatattgattgggtaaaatatatacaagataatgctatacttttaaaagagaaaaagcactttacattgtttaggtctttggatctgcatatgtccctgaggtaagtattccagccatgggaaactgaagcacagagaggtagtcacccaccaaagctcagggctggcctccagagcttgaacccttgcctgagctggggtcaccagcctgggtgggccacggagcgatcatcatttctccatctgatcggaaagtcacccaccactctgttctggggcccagcccgcctggctccaggcaggctcggaggccgtgctctcctggacctggtgcatctggctgcagccagcactgggcaggaaaataccgctggag

SEQ ID NO: 15625 - DNA, 18326 bp, Human
  misc_feature (1)...(18326): n = A,T,C or G
gccgtgaagtctttgggagtgcttgttactaagcataacccagcccttcctaactaatgcacttcatcctcattcatccacgtggcagctcttgaggcagctacttttgttcccacgaggcagtgggggctcagagaagttcagcaaattgagtaaggtggaattgctgggattccaacaccagcaaaacctgggtatttcacaaagggatccaacccactttaactttctttatttagagataaagtcttgccctgtcacctaggctggagtgcagtggcacagtcataacctactgaagcctctctctctcccaggctcaagcaatccccctgcctcagcctccggagtagctaagactacatgtatgtgcccccatggtcagctaatttttttttcttttttctttttttctttttctttttttttttttttttttttttgtggccagctaattttcaaaaaaattttttgtagagttgggatctctatgttgcctaggctggccttgaactcctgagctcaaggaatcctcctgcctcagcctcccaaagggctgggattacaggcatcagacactgtgcccagcctcatttattttttaattttttttttttttttttttgagacagagtctcactccatcgtctaggctggagtgcagtggcgcgatctcggctcactgcaacctccacctcctgggttcaagcgattctcctgcctcagcctcccaagtagttgggattacaggtgtgcaccaccatgctcggctaatttttgtatatttatttatttatttgagacagagtttcgctctttttgcccaggctggagtgcagtggcgtgatctcggctcactgcaacctccgccttccgggttcaagcaattctcctgcctcagcttccagagtaactgggattacaggcatgcgtcaccacgcctggctaattttgtattttttagtagagacagggtttcttcacgttggccaggctagtctcgaactcccgacctcaggtgatctgcccacctcggcctcccaaagtgctgagattacaggtgtgagccaccgtgcccagcccctaatatttgtatttttttttttttttttttagtagagatgaggtttcaccatgttggccaggctggtcttaaattcctgacctcaagtgatccgcctgccttggcctcccaaagtactgggattacaggcataagccaccgcgcccagctctcgtttatttttatttatttgaaacagggtcttgctctgttgcccaggctggagtgctgtggtgcaatcaaggctcactgcagcctcgatgtctccagcaatcctcctgcctcagcctcccaagtagctggggttacagacgcacgccaccacacctggctaatttttgttatttttagtagagatgaggtctccttacgatgcccaagctggtctcaaactcctggcctcaagtgattctcctgcctcggcctcccaaactgctgtaattacaggccaccgcgcctggcctagcctactttaaggccggcactgcacttgacaaacactaactcagatcagaatcctcccacaactctgtgaggttgggtactctcgctatgagctacttgacggatggggaaactgaggctcaaagaggttaagtaacgcgtccaaagccacaagactagaaagtggtggagctgggactcgaaccaggcccaagactctatgcttttaacagccgtgcgtatagtagaagctctttacaagcagctgggaaaatgagatgttgcttggctaggacgggctctagacgcttggtgcagcttccagcccctcccacccgctctctgaaagccccgcccaagactcggcccctcttcgtcctcccccatcccccgctccgggaacggcccttcctccgccttctgggcggagcccgcgcgggatccgggtggctgcaggctgctggcttctgcggctgcggggtcggggtcgcggccagggccaagccgcagcgagttcacaggcggaacccctgcaggcggcgccccctacgcgaggtcacccctgggaaggagcgcagcccacccggcccctccgcatccgagcaggtctgtggggtacgggggtttgggaggaaggtagggggtctggggaacaaaggcggggctgcggggaacgcctctgccctcgcccccacccagctgggcacttgggaagcgctgatggggcgcgggcggggcagagagcccagctggggacaggcgttgggaccatatggtgatgggggaaactcctgagtccacctgcattggctggggcgccccaaatctagtgaaggggaacagaggcgagccctccggggccaggcttgagggagggtcggcagatggttagaaagaggcgggaccgactgacacaggtgagctaaggctgggggaggtgggggccccagccttgcggccctgccctgcgtggggaaaggtttcctgcctcttctcttcccctccttaaactcgttctcctggaacacggggtggggccggttgggtcctggtttaaaatggaaaaaagccccaaaggcagttgagaaatagctgtgccagggctgtctctgcctctgccccgcctgcatccaggccttctgcagcctctccgtgcggttcccgcagcggccatagacagctggggaaactgaggcctgggagaggttatgagggttgagggagcaccttggactcggatgaagcagcatgttggagtgtgggcagattcaaggagcctagccgtgggacagattgcctggaaagaccaagggtgggcggcagtggtcgtggtggtggggttgtgttaattaagtggctgggatcgtttccttgggtataaggactctcactcctgcctccgtggactggggctggagtgagtcagccttgggcagaaggagacaggcctggcccctttgacaaatagaaaatagcagtacccatttagggggtagaactggactctaaacctgggccctgtacatagaaaaccccttccccttggaactcagagaaggggttgtatttggcatgagttggtgggcggcaggcgccccagtggctgacacctgccaaagtcaacacccaagccttaatcaggggctctatccagcttatccagctggcaggtcctccccccaccccaccccagcttacacctgggccacaccggctgcacacgctggggcgaagtccacacctgtgccttctccagaatctagttctgcaggggccagagccccttaccctcggccttgcacttgaaccctttgctaggcctctgggtttccagataggaaaggtctccccaccctccaccccaatacagactcagttacgccacagggtgtgaagattaaacagcagtcacattttttgtgccccagctctataccaggcactgtctaatgaccgttacgtgtgttaataccttcccactggaaggaacgtgaccacccgaggatggactttttcttgtcctattcacagctgcatttccacagagaacagggcccggcagagagtaagcatttgttgaatgaataaagaaacacattttaggtcgggcgtggtggctcatgcctgtaatcctagcacattggaaggctgaggcaggaggattgcttgagcagaggagtttgaaaccagcatgggcaacataatgagaccccatctctacaaaaaaattttttttaaattagcctgatgtggtggcatgtctgtagtcccagctacttgggaggctgaggcaggaggatcactcgagcccaggaggtcaagactgcagtgagctatgatcacgccactgcgctccagcctcaggcaacagagcgagatcttgtctctaaaaaaaaaaaaaaagaaagaaagaaactcattttaggctcacaaccaactactctttcaggaagggactgtgacaaacatcccattttttagaagaggacactgaggtctagagggggcaagcgatgcatccagcatcacttggtctccgagtgaccgagctgagatttgaatccaggcctggtgcattcacaggagctgttcttgatgtttgattcccctgcaggacgcccgtctcctctccctgaggatttcaggtctccctgtcccaggaggcttgtgccaagatggcatcagctggagacacccaggcaggcccacgggatgcagcagatcagaacttcgactatatgttcaaactgctactgataggcaacagcagtgtgggcaagacttccttcctgttccgatacgcggacgactccttcactcccgccttcgtcagtactgtgggcatcgatttcaaggtcaagaccgtctaccgccatgacaagaggatcaagctgcagatctgggtaggctgggaggctggctgtgggttgggggtggggtccctccaggaaagttcattggagggttctttttttttttttgagacggagtctcactctgttgcccaggctggagggcagtggcgggatctcggctcactgcaacctccatctcctgggttcaagcgattctcctgcctcgaccttttttttttttttttctctcgagacagagtcttgctctgtcgcccaggctggagcacaatggcacaatgttggctcactgcaacctccgtctcctgggttcaagcaattcttctgcctcagtctcccgagtagctgggattacaggtgcacgccaccacacccggctaattttttatacttttaatagagatggggtttcaccatgttggccaggctggtctcgaactcctgacctcgtgatccgcccacctcggcctcccaaagcgctgggattacaggcatgagccactgtaatactgtgcctggcgggaaacagtattattcctgggggtctgattgcggagatgatactaacctaagacatgtttgaagtacttgtgacactagcgtggtggcttatgcctgtaatcccaacactttgggaggctgaggtggagcatcacttgagcccagcggttccagaccagcctggacaacatagcgagatctcatctctaaaaaaaactttaaacattagcccagcatggtagctcccgcctgtagtctcagctattcaggaggctgaggcaagaggattgcttgagcccaggagttcgaggctgcagtgagctatgattgcaccactgcattccagcatgggtgacagggcaagaccccatctattaaaaaaagaaagaaagaaaaaagaaaggtcccaggtgctggtgaccaacagggaagagttttgggtaccatcttagaggggaccctgggacccccattggaccgacctggtctgcagagtcacacctagctccctctcccaacttagccgctggtaacaatcatcgtggtagcaagagtaccaaggtgtcctgtcaggatggtaccatctggcccagttggttcttagagacaaggtcaaaggggctcataagtctgtgagaggccactgacccctgagacttggaacccctcaagggcaagcccaagtctctccctcatcagactggggagatcccttggtaatgaatccatgcctcccccatcagactggggttgtgagggcaggatctgtgtattctccatcagaccagaggttgtacaagcaagtctgtgtctcccccgtaaggctggggctatgagtacagggcagtgcccctctaagacaggggtggactgggaaacaggtagttcccagccaactgccactgccatttgtccaggacacagcgggccaggagcgctaccgcaccatcaccacggcctactaccggggagccatgggcttcctgctcatgtatgacatcgccaatcaggaatcctttgccgctgtgcaggactggtgagtgcttgctgatcatggacccctgatctttgccctctcctctgacccctaacccccccggctcatggctcaccactggtaactctgcagggccacgcaaatcaagacctactcctgggacaacgcccaggtcatcctggtggggaacaagtgtgacctggaggacgaacgtgttgtgcctgctgaggatggccggaggctcgccgacgaccttggttagtgcccagcctgggccacaggccctggtctcccagaaccaaaccctcatccccatcctctgattcagggtccaacccagtcactgatcctttgaggatctgcccaggaagatacccatgtgtatgccacatgtcccgtctaattgcaggggatccacgcgcaggaactcccactgccccactgcctatcccctgggaacccagcaaaaccatttctggaaattgatcctagagatatcctcacccatgtgggatatggtgtgtggagtgtagtagtagtattagtaggagtgaaacctacagatcccccccaggtgtctcacagttggagaaccaagtggacataaagtatattcacatggtggaatactatgcagccatggaaaaggatggggatgttctttatttttttattttttatttttttgagacggagtctcgctctgtcgcccaggctgaagtgcagtggcgcgatctcggctcactgcaagctccgcttcccaggtttattttatttttttgagttggagtctcactctgtcacccagactggagtgcagtggtgccgtattggctcactgcagcctccacctcccaggttcaagcaattctcctgcttcagcctcccaagtagctggtactactggcgcgtgccacatgcccagctaattttttatatttttagtaaagatggggtttcaccatgttagccaggatggtctccatctcctgacctcgtgatctgcccgccttggcctcccaaagtgctgggattacaagcgtgaggcaccatgcctggcctttttttttaattttgcgtggagatagggtctcgctatgtttcccaggctggcctcgaactcctgaccttaagtgatcctccctcctcagcctcccaaagtgctaggattgcaggcatgagccaccacaccagcccaaggggatgttctttatggtttgtttttgtttttgtttgagatggagtctccctctgttgcccaggctagagtgcagtggtgcgatcttggctcactgcaacctctacctcctgcattcaagtgattctccttcctcagcctcctgagtatccaggattacaggtgtgcgcagcatgcctgactcatttttgtattttcagtagagatggggttttgccatgttggccaggctggtcttgaacccctgacaggtgatccacctgcctcagcctcccgaagtgttgggattacaggcgtgagccaccgtgcctggctgttttgttctagcaaaatagtggatacgactgctttctttagtccaggagtcagcaaaccttttcttaaagggccagatagtaaatatttttggccatacagtctctatggcaactacccaactctgcatgacagcagccacagacaatgcataaatgaatgggtgtgactgtttgccaataaaactttatttgtggccgggcgtggtggctcatgcctgaaatcccagcactttgggaggctgagacaggcagatcacctgaggccaggagttctagaccagcctggccaacatggcaaaaccccgtctctactaaaaatgcacaaaaattagccgggcatggtgacagacgcctgtaatcccagctacttgggaggctgaggcagaagaatcacttgaacctgagaggtggaggctgcagtgagccgatatcacgccactgcactccagcctgggcaatggggggagactctgtctcaaaagaaaaaaaaaaaaaggaaagaaagaaactgatgcttgcaatcagtttttaaccccagctttcccataagccccatccaagccagcaccctatgtgcaaaattcagaaggcacaggaagagactaaggcaataacccactccccacctgcagttctggtctcccagcttctctgattcttgtatctctttccagaaatatgctgagcacccacaggcattgacaacacattggctacttttttgttttacacagatgttccctactgtatataccctttcctgcactttgaacttttctactaaataatatatcctagaaatatttctctgccgggcgcagtggctcacgcttgtaatcccagcactttgggaggccgaagagggcggatcatgaggtcaggagatcaagaacatcctggctaacactgtgaaactccatctctactaaaaatacaaaaaaattagccaggcgtggtggtgggcgccggtagtcccagcttctcgggaggctgaggcaagagaatggtgtgaacccgggaggcggaacttgcagtgagccaagatcacgccactacactccagcctgggtagaagagcaggactctttctcaaaaaaaaaaaaaaaaagaaatatttctccatcagccccagagctggctcattcttttgcatggctgtgtactattccatttcgtgtttccttaaccttttcctctgttgacagccatggagattatttctagccttttcctctgacaaatgcagctgcagcagtcatttttacatatatttctttggacacatgaggcaagaaatctgccagcttgattcacagatgttcttaacactttttttttttgagatggagtcactgcacctggttggtttttatagtcccggcctacacttttttaaaaaaataactttggccaggaatggtggcatgtgcttgtaatcccagctactctggagactgaattaggaggattgcttcaggccaagaatttgagaccagcttgggcaatatagcgagaccctgtctcaaaaaaggaagaaaataataactttttgtgataaaaatgttcaaatactctcagcacattgggagggcaaggtgggtagatcgctgaagcccaggactttgagaccagcctggtcaacatggtaaaccctgtctctacaaaaaaatgcaaaaattagctaagcatggtggctcacacctatagtctcagctactcaggaggctgaggtgggaggatcgcttgagcctgggaggcagaggttgcattgagccaagattgcaccactgtatgccagcctgggtgacagagtgagaccttgtctcaaaaaacaatgaaataaaatgagaaatgttcggccaggcgtggtggctcacgcctgtaatcccagcactttgggaggccgaggcaggcggatcacctgaggtcaggagtttgagaccaacctgaccaacatggtgaaacctcatctctactaaaaatacaaaattagccggtcgtggtggcgcatgcctgtaattccggctactcaggaggctgagggaggagaatcacttgaacccaggaggcggaggttgtgtgagctgagatcgcaccattgcactccggcctgggtaagaagagtgaaactccatctaagaaaagttcaaatacattcacaagtagaaaggaatgtataatagactttgataaaacattattcagcttaattaggtctcaacattttttcaatcttgaatcatctattcccccaaaatacttttcctttttttcctagagcattgagagcaaacccttgacatcgaaaccttttgtctgtaaacacttcactatgcaactccagctgttttgttgtcgtcgtcgttttttaaataatagagacagagcctcactctttcacccaggctggagtacagtggtgtgatcccaccactttaggaggctgaggagggaggattgcttgagcccaggggttagagaccagcctgggcaacatagtgagaccccaactctacaaaataagtttaaagctccctgtagcctcagacacctgggctcaagatgattctgctgcctcagcctttcaagtagctgggactactagtataagccagcacactggctaattttttatttttattttttgtagagatgaggtctcactatattgcccaggctggtcttgaactcctgggctcaagcagtcggcctgcctcagcctcccaaagtgctgggattacaggcatgagccacggcacctggttggtttttacatttttaagtggttgaaaaaaaaataatatgacatgggaaatttatatgaaattcaaatttgtatctataaatgaagtttttctgagacacagctatacccttttaaaagaattttttttttacacggagtcttgctcttgtcgcccaggctggagtgcaatggcgtgatttcggctcattgccacctccgcctccccagttcaagtgattctcttgcctcagcctcctgagtagctgggattacaggcacccaccaccacggggcctggctaatttttgtatctttagtagagatggggtttcactatgttagccaggctggtctggaattcctgacctcaggtgatccacccgcctcaacctcccaaccatttattttttaaatttttttttttttttgaggcaaggtctctctctggtgctcaggctggagtgcagtggcacgatcataactcaaagcagcctccaactcctgggctcaagtgatcctcccacctcagcctcccaagctagctgggatgccaggtgtactccaccacacctgcctaattaaaaaaaaatttttttgccgggcgcagtggctcatgcctgtaatcccagcactttgggaggccgaggcgggtggatcacaaggtcagaagcttgagaccaccctggccaacatggtgaaaccccgtctctactaaaaatacaaaaaaattagccgggtgtggtggtacacacctgtaatcccagctactcaggaggctgaggcaggagaattgcttgaacctgggaggcagaggttgcagtgagccgagatcgtgccactgcactccagcctgggcaagagagcgagactccgtctcaaaaaagaaaaaaattttaagagataggtcttgccatgttgtctgggctgatcttgaactcctgggcttaagcagtcctcccaccttggcctcccaaagtgctgggatcacaggagtgaactcacacccgtgctcagttgatgcctatttgttgatgcattgtctatggttgctatttttatggtaatcacacgtctgtgattacaggctgtctcaatacagaaaagggtataaacagtgcttcaagcgtgaaattgagtaattgagacagagaccatatgacccagaaagcctaaaatatttacgatctggccttttacagaggaggtttgctgacctctaagccataaccagtccctttccccttttattcttgccattgctttgttggagaaactggatctctgttctgtggggcagggccctggatccccagttagcctggaagtggtgaaatcagttaacgcccgcgatgggctggaatacttggaggtgctttccacacctacttgcggattatatctggggtctcggggtaaagggggattctcactttctgttattatgtttaaaatattggagtacaggccaggttcggtggctcacgcctgtaatcctagcactttgggaaggctgaagtgggcagatcacttgatgtcaggagttcgagaccagcctggccaacatggtaaaaccctgtctctaccaaaaatacaaaaattagctgggtgtggtggcacgtgcctgtaatcccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtggcacaatcttggctcgctgcaacctccgcctcccaggttcaagcaattctcctgcctcagcctcccgacagctgggattacaggcatgtgccaccacgcctggctacttttgtatttttagtagagatggggtttcaccatgttggtcaggctggtatcaaactcctgacctcaggtgatccgctgcctcggcctcccaaactgctgggattacaggtgtgagccaccacgcctggcctgattccaattttgtaggaaaaaaagccagacacacatacatgtgcacacacacatcccctacaaacctaaccccaacaaatgacatatttatatagaaaaagactaaaggctgggcatggtggctcatgcctgtaatccttgcactttgggaggtcaaggcagaggatcacttgagtctagcagttagagaccagcatgggcaacatggtgaagccccacccctataaaaaataccaaaaatcggctgtgtgtggtggcacacccctatagtcccagctacttgggagactgaggggggcccaagagtcaaggccgtagtgagttatgattataccactgcactccagcctgggcaacagagggagactctgtcttaaaaaaaaaaaaaaaaagatgaataaagactagaaagctaaatagcaaaacgccaacagtaattgtttccaagtgatgagattacaaattacttttatctctatctccatacatttctttgtgtttttgttttgagacagggtctcactctgttgcccaggctggagtgcaatggcatgacctcagctcactgcagcctcaacttccctggcttaggtcatcctcccacctcagcctcccaagtaggtgggactacgggtgcatgccaccacacctggctaatatttatttatttatttatttagagatggagtcttgctctgttgccaggctggagtgcagtggcataatctcggctcactgcaacctacacctcccgggttcaagcaattcttctgcctcagcctcctgagtagctgggactgcaggcacgtgccaccacacaaagctaaattttgtatttttagtagagacggggtttcaccgtattggccctggtctcgaactcctgacctcgtgatccgcccacctccgtctcccaaagtgctggaattacaggcgtgagccaccacgcctggcaccccccaaccttcttcttttttttttttttttttttgagataatatcttgttctgtcacccagcctggagtacaatggcacaatctcggctcactgcaacctccgcctcccaggttcaagtgatcctcctgcttcagcctcctaagtagctgggatcacaggtgtgcaccaccatggccagctaatttttgcatttttagtagagacggggtttcatcatgttggccaggctggtctcaaactccagacctcaagtgatccgctcaccttggcctcccaaaatgctggtattacaggcgtgaaccaccatgcctggccttaatttttatattttctttagagactgggtcttgctatgttgcccaggctggtctcaaacttgtgagctcaggtacccacctgcctcagtctcccaaagtactgggattataggctgtcttaatacttttctgtagtttctagtttctccagtaaatttctctattgaatgacatccaaaaaatgtattttttttcctttttaaaatttttatttgttttagagacagggtctccctatgttacccaggctggtcttgaactcttgggttcaagtgattctcctgccttggcctcctgagtagttgggattacaggcgcataccaccacgcctgattaatatcagaaaaataagctgggcacggtggttcatgcctgtaatcccagcactttgggaagctgaggcaggtggatcatctgaggtcaagagttcgataccagcctggccaaaatagcgaaaccctgtctctactgaaaatacaaaaattagcctggcatggtggttcacacctgcagtcccagctccttgggaggctgaagcaggagaatcgcttgaactcgggagacggaggttgcagtgggctgagatcgtgccgttacactccagcctgggcgacaagagcaaaactctgtctcaacaaaaagaaaaataaagaacacagatggtatgaggcaaagccacgcgtggataaggaaacaccagatttgcccaggaagacagtgggatggctttgatatctctgggctgacagtaggagatctaagttcatgtcctgcccctgctattgttcatttacccattcattcattcaaccattcagcagacagtttctaagcaccctctctgtgtcgggcactgggtacagccatgggcggaaatcctgcctgcctggagctggctttctagtagcggagacagataataaatgggtaattacacagctaactcattatgattccattttcatagttcagcatgacgcacagagaagacaggtccacttacccttggccacgtgtaacgtggcaggcgtttgtctgaattcctggcttaccttggtgatgtggcaggtggggctgcatggagattcagggacagctcctctcaggcagaccctcaggaaccttaaaaggatgcaggaagcccagcgtggtggctcacgctggtaaacccagcactttgggaggcctaggcggggggatcgctttaggccagcagttcaagaccagcctgcgcaacatagcgacacccccacctctacaaaagaaaaaattgaaaaattagccgggcatggtggggcacacctgtagccccagctactcagggggccaaggcgggaggatcgcttgagcccaggaggttgaggctgcaatgagccatgttcataccactacaccccggcctgggcaatagagagagaccgtttctcttttaaaaaaagcaatggaaaatgtgacttgatgggtctcctgaccatgcctttctgtgcagcagaaattgggtggaagctgagctatagccacctgtgggcactgccatggccgcagggcagcagaactcttcatgtaccctcccacctatactcttgcagccactgccttgtgacaaagagatcttaggattgtccagaccatggctgcagccgcagggtttcgttttgttttgtttttgagacagggtcttgctccatcacccaggctggtgtgcagtggtgtgatcatggctcactgctgccttgacctcctgggctcaaaccattctcctgccttaaccttccgagtagctgagactgcaggtgaacgccaccatgcccctctatttttttttttttaatagaatctcgctctgttgcccaggctggagtacagtggtgtgatctcagctcactataacctccgcctcccagattcaagcaattctcctgcctcagcctcccgagtagctgggattacagacgcgtgccaccatgcccagctaattttttgtctttttagtagagatggggtttcaccatgttggtcaggcgggtcttgaactcctgacctcaaatgatcctcccgcctcggcctcccaaagtgctgggattataggcatgagcctcctcacctggccgcccatctactttttaaaaaaatttattgtagagatagggccttgctatgttgcccaggctggtcttgaactcctggcctcaagcgatcctcccgccgtagcttcctttagtgccaggattacaggcataagcccctgcgcctggcctgccacagatttttatcattggtaggatcatcattcccattttacaggtgagcaaactgaggcttggagtggcaaaggcacacaaccaaggtcccacagcaggataaagagcagaactaggcttagaagccaggtttctgtgatgccacagctgagactctgcccctcaggggtcttacgagtgtccccaccttaacattcatccaggtttcgagttctttgaagccagtgccaaggagaacatcaatgtgaagcaggtcttcgagcgcctggtggatgtcatctgcgagaagatgaacgagtccctggaacccagctccagctcaggcagcaacgggaaaggcccggccgtgggggatgctccagccccccagcccagcagctgcagctgctagagatggcccccaaccccccacccacccctctcctgcctcggcagggactgtgatcgaggcgtgagccacagtggttatctccaagctcagggcaatcccttccctcctgtcaactgctccccgactcctgcatggctcattccttcacaatgtcgccgtggctgccaggttcctcaggcagccccggtgggaggctgcggaccatggggactcagctctgcatggcaggcagaggcccagggacactgacgtgcatgagcttgctgctttccagggtgtgttgagggtggccatgggtgacacgtcccactctttctgatggaggggcatccgtggtgccttctagcttagaaccattttccaggtctcttctgggttgggcaggactgatattcccaagctggtggaagatggttcatcttcctcgcacagtgtgggttcttggagttcatccagggaaggcggcgcctctttctcaggtcctgcaggctggtctctgagcctgcccccacgaactttctggattccaaggtgggatggtgatccctttgacccctgcagaccctctacttgcgaaaagcagcattgaagcagccttttcccattgtagaagggacagggagtcagatcccctcaaccccccggcttcagggaccccagaagtgccttccaagcttcccccaagatccacatcacccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttctttttttttttttttctttttgagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatgggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactctaggggcgcagcaccttttctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgagg

SEQ ID NO: 15626 - DNA, 7021 bp, Human
agaataaaactgtctcaaaaaaaaaaaaaacaaaaacaggccgggcgcggtggctcacgcctgtaatcccagcactttggaaggccaaggtgggtggatcacgaggtcaggagatcgaaaccatcctggctaacacggtgaaaccccgtctctactaaaaaatacaaaaaattagccgggcgcggtggcggcgcccgtagtcccagctactcgggggtgctgaggcaggagaatggcgagaacccgggaggcagagcttgcagtgagccgagatcgcgccactgcagtccggcctgggtgaaagagcgagactctgtctcaaaaaaaaaaaaaccaaacaaacaaacaaacaaaaaaacaaaacaacaggagaagatgatgacagacctcacaagagcttggccccagggctgaaaccccacccagtgctgtggttctgcggctgtgggcccatgggtgcccccaaagggtcccaggcagatggaggctcctggttggcgtggaggaaggaaaaggatgaaatcggctcccctggccaccccttctagcccagctgcagctgcagtccgtgggtctgagccgacccttggggttcatcggcccattttacagatgcggagcctacagccgggaggcgtggcggctctgggcggtgcagggttccggggcggggaggccgaggcgcccgccctccccgccggggctcacctgggtcagccctgagccctcgagcagggcggatcggccgctgcctgcttaaagctggggccgccaggagtgcgatcgcctgcggatctgcagctgggcaccggccgcaacgcccgccccgcgacggcaggtgagatgcgggcggccccgtgggaggggtctctgcctgtcctcgtcacccacttccttcccgtttgttgctgctgcagggctgggaatgggggggaccaagcacttcgcagggtgacccggggagatctgtgagccagtggcctcagcgttgaatgagagctctctcccgggtccgcgctcgcagggactgaagggactcctgaatgtccgcgggacgtgtcgcggcggcgcccagcacggaggaggcaggcagggaggtgaggagcaggtcagaccggccgcaggtgcagggcctcctgccctcccaggctgcggtcccgtggagggcctgcagacagctgctgagactatgagggtcagaggtctgtggtcacgcgcgctatcaccagctagctgcctcctgcctggttcctcctgcaggaatgggagtctggggggaggggagggtgtgggcaggacttcctggaaaagggaagcccgttggtgtttatgtgtgggatggagagagggcagggggaggacggggacacacgcggagtcccccacccagatgttgtcaaacacagctcccacaccagacacgcaacccatcctagagatgcaacccaggcacacacacatggacacacacaaaactccatccatagggattcccacccagtgccacgtgagaacacaggcgtgcatcgcagacaagccacacaggcctcgcaggctcagcatacatgtctgcagcaacaccatcaggtacagagccgaggcccaggtaggcatgctcagctgcacgcaggaagcaagacacacccagacacacacaggtaagcccttactcagagaaagaaggtgcaggagatgtgtcttgggtaatcacagccacagcctctcaagtgtgcacacacacacacactcacactgagatacacagacacacagagatacctggacgtgtcaagcctacagcacaaacaggcccctgcaggtccacccggaggctgtgtgggccgaggctgctgcacacgtgtgcccagatcctcccacccccaccccaatcccgtgtcctgctccagggaagtccagggctcacatgacccaaggggagggctcccgggacagccctcggagaaactgcatcatcctcactaatgatccacttcctcctcagggaataaaggctcagggaccggcagttctactctagagcccaccagcctctcagagcctccggtgactggcctgtgtctccccctgggtgagtgctgggcaggctaggtggaaggagggtgaaatgggcctgcagggccatcttggtacagctcgccctctcacagaccgcgccccccttccctaagccagcttgtgcagccttgtgcagcttgtgtgtcctgagaattagggcaccaaggggttcccgcaggggcagcctgcagcaagcagtctccctctatctcagggcaggcgggggtctcaaggcctccctgcccttgtcacagcccgggccacctatgcttgtctctcttctcccagatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggtctgtgcccaacagagtggggcaggaggtgggggcgggcagtggggagaagccgccttacctagtgaccttcctttggtgagggcagagggaaggtgatggggcacctttgggcgccgggagcattcagtgtctcccttatcctgacttggtgggaggatcggcatagccactgaccccagggaagaggcctgccctatctgtttgctacaggagacctttgaggacgtattctctgaccgctcccttcgcaaagtgccctggtacgtgctagccggaaaccatgaccaccttggcaatgtctctgcccagattgcatactctaagatctccaagcgctggtgagccaccctcagccctgccttccgagatcctcacatagcagggacacaggggccctgtggcttgagctgaccctgggacttctgcgcccaagatgtgcacccacgacctctatcccctccacaggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcaggtgagggccctgtgggtggggtgggagctgggtgaggggggtccccatcccagctgatgtccacatggctggggtcctcctgctgtttgagggtctcctgtggccttcagaatgtctagactgtccctcaaatcttgctgtctaaccaggaaaacactccaaagccagaataatatcttcgaattgccaatttctttctttctttcttttttaagctcttttttttttttttttttggagacaaggtttcattgtttttcacccaggctggagtgcagtggtgcaatcggggcttactgcagcttcaatctcccgggctcaggtgaacctcccacttcagcctccagagtagctgacactacaggcatgggccaccacatgcagctaatttttgcttttttttttttttttgagagggagtgcagtggcacgatctcaactcactgcaacctccgcctcctgggttcaagcaattctcctgtctcagcctcccaagtagctgggattacaagcatgggccaccaaaccttgctaatttttatattttagtagagacggggtttcaccatgttggccaggctgatctcgaacttctgacctcaagtgatctgcccgcctcggcctcccaaagtgctgggattataggcatgagccactgcacctggcccttgcgcattttttttgtagaggcaaggtctcactatgttgcccaggctggtctcaaattcctgggctcaagcaatccaccccctcagcctcccaaagtgctgggattacaggcatgagccaccacacctggccaccaatttcttactaagtgctctacctatgaaataggattaatacactcctaaaagtcaggaaattgaagccaggaggggttacatacctcaaggtgactctgtggttagggccagatcgagccctggaccttaggcagggctctgctcaaagctgggtctccactgaccccttgtcctccatcctcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaaccagtgccactggtgtgttatgttctcctggttagagtggctgggctcccctgagctgctgttccttgcctccatctcttaccccatccatgaccaagttgccttatccatggatgtgattataaaacccggccaggcacggtggctcacacctgtaatcccagcactttgggaggccgaggtgggcggatcacgaggtcaggagatcgagaccatcctgactaacatggtgaaaccccgtctctactaaaactacaaaaaaattagccaggcgtggcggcgggtgcctgtagtcccagctactcgggaggctgaggcaggagaatagtgtgaacccaggaggcggagcttgcagtgagccaagatagcgccactgcactcctgcctgggtgaaagagcgagactccatctcaaaaaaataaaaaataaaaaaaaaataaaatccaagcagaggccaggctcagtggttcacatctgtaatcccagcactttgggaggccaaagcgggtggattatttgaggtcaggagttcaagatcagcctggccagcatagtgaaaccccatgtccactaaaaatacaaaaagttagtcaggcttgctggcgagtgcctgtaatcccagctacttgggagtctgaggcaggagaatcacttgcatctgggaggtggaggctgcagtgagtcaagattgcgccactgcactccagcctgggcaacaagagttaaactctgcctgaaaaaaaaaaattggccagttgtggtggcaggagcctatggtcctagctactcaggaggctgaggcaggagaattgcttgaacccaggaggcggaggttgcaatgagctgagattgtgccactgtactccagcctgggtgacagagcaagaatctgtctcaaaaaaaataagtaaataaaataggccaggcacgatggctcacgcctgtaatgccagcactttgcaaggcctaggtggtcggatcacttgaggtcagaagttcaagaccagcctggccatcatggtgaaaccccatctctactaaaaatacaaaacttatctaggcgtggtgacacatgactgtaatcccagctacttgggaggctgaggcgagagaatcacttgagcctagggggtttgcgggtaaagggggtggagaggtgagggcggagattgcagtgagctgagattgtgccactgcactccagcctgggtgatagagcaagactctgtctcaaaaaaaaaattaattcaataaaatccaagcagaaagaagggtacaacataaagcaagtcttcctccaccccaggggcaactaatattaatcattttctttctctatatagtctatgcctccataatcaaaacattccctttattattttctttttttttttttcttttttttttttttgagatggagtctcactctgtcaccaggctggagtgcagtggcgtgagctcggctcgctgaaacctccaactcccagattcaagcaattctcctggctcagcctcctgagtagctgggattataggcacgcgccaccacgcccagctaattttttttttttttttttttttttgagatggagtcttgctctgtcgcccaggctggagtgcagcggcgtgatctcggctcactgcaagctctgcctcccgggttcacaccattctcctgcctcagcctcccaagtagctgggattacaggcgtctgccaccacacccggctcgttttttgtatttttaaatagagatggggtttcatcgtgttagccaggatggtctcaatctcctgacctcgtgatccgcctgcctcagcctcccaaagtgctgggattacaggagtgagccaccgcgcctggcaatttttgtatttttagtagagatggggtttcaccatgttggccaggatggtcccaatctcctgacctcatgacctgcccgcctcagcctcccaaagtgttgggattacaggcgtgagccgccgtgcccggccta

SEQ ID NO: 15627 - DNA, 15585 bp, Human; identical to SEQ ID NO: 11927
  misc_feature (1)...(15585): n = A,T,C or G

SEQ ID NO: 15628 - DNA, 31111 bp, Human
  misc_feature (1)...(31111): n = A,T,C or G
cggggagcgaggcgcggccgctaggtggcgtgcgaggcgcgtaggccctggtggccgcagccacgtgaccctggggaccgcagccgcgagctcaggcacgtgcccgggggagccctgtggcgccacgcgcagattggccccgccggttcctcaccagttcgggggatgaggcggggccccagctatgcctcagttcctgctgcggaccggggggctaccccagccggggacagaagaatcggcaaggatgagcgagtccggccgctggggccgcccccgcgagctccctccccccgcgaggcaggtcccctccactctccccgcactgccggagccggcaggtttccatgggaaccgcagcggggtccgcgcgcccaggagcagcccccctcctagctcagtttccgatgacggaaaccgggaggaacacggggtggggaacagaccatcgcttggggcccctagcgcccgcagccaggtcgccccggcgagcccaagaggggccacccggggatctgcaccgccaccgcccctattgcgcgggccactgcgattggcctgccctttccaggcgtggcagcatcccctggtgcgcgcactcccattggctcgatctctagggcatcttccagtaactggttatctcaagggccgcccctgattgggcaaattaggctctcctcgctggtggcgctctctgacagtctggagcctaaagggcgtgcaggaacgaggattgggtggggactgccgctctccagttagggggtctgggctacctcgccggcagcgccctcgaccggactgtcggattgctgtctgtggtgctgaagcctcacgccctggcgaccccgccccagtgtgtgctagttcccgcgccccgacgtaaacatgcaccggcgcccgcgcaccaaaggaggctgcgccacccccaacgccttagagagaggccaggttccccctagcagagagcgagcatgactccacagtcaggaggaccaatcacgagcctagaaagccaggacatttatgtggcagatccacccaccccagttctgtggggtccaagaaggatccgtggtttcccagagctgcatggctccagcgatgattgtccagaacactgagccccaaaccttttcacccccttcggagcagtgcggagtttccttgcactggggagtgccagtccttaccttttgaaccctagaaggatccagctcactcaaaaccaacagcgtcccagtctccttctgcagaagactagggccacagtagccaccctcccccgtggtcttgaggtggtctacactggtgcctccaaatctggggacccaggcctctgcctactaaaatattggttcctgatcccctgtccagttccctcagtggacaacacctctggaaggtcgcatattcaggccactaatacctcctcgctctgttggctcctccagctctaggagctggacggaggaggggagcccgtctcctggcccgaaagccagcccaagaaggggtgccagggtaggaagcaagggcctcgagggaaggagggcccaaatctggcaacccgagcacctaggatgcgcttttgggggattcagagtcccgaccagtgcgcgctcacttccacctgccgcgccgtcgggagccgcgaggaggcggagctcggtcgccgcagccaatgagcgacgccggcgctggcagctgctgctataaagggctgggggcggcggcggcgcggtccagagcgcggagcgcgcagcgcgggccggagggagggagggagggtgggcgaggggagaggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactgtaggtattcccctgtcgccgaaagggaatcgggacggggaggagttgggcccaggctccgcggagattgggcgggtgcggcggggggggtaggaccaggcctagctaggcccgggttgggggggtaggaccaagcctcggggcctgagagtgggcagggccgcgcccagagtgctgagggcgcttagagcttggtctgagagggccttagggagactgactgcgattcgggaggcgtccgacgccgccctggaggcgggattgccccctctccagcaggcctgatgggggaggggccgcggcggctaaggatgcttcctccatccaggcccagaccccgcaggccgcccaggcaaacgcagggcccgatcactggtgctgggccaagccaaagcgacaaagcgtccccgagagccctgggaaagcgggtggcgtcggatcgcgcgccccgggcctcggccgcacccgggaggcgggcgtctcgtcctcgagcccgtcgaccttgcggcaagcggggaggggagaggagggggcgcgcccggaggccccgcgggcccgccgccgctgctgccgcgtccctttgtttctcggcgcttcttcgcgggccgcagcctcgcgcgggcgcctcgggctgcggggagggggaggggagaggagggcccgcgggttgggggggcacctctgggctcccgggtctccgccccccgggagatggggtgggaggccgagacagcccccttaggccaggtccaggctccccacctcgccaaggctctgggccgcgaggtgaccttgagcgcggcccgcccgcctgctcgcccgcaccgctagccccgcgctcggtgctttcagcagccacggagctggtcagctcccgagcgcgcagcccctcccgccctgccacgccctgcctggccacgcccgggcacgcccatctaggccccgcccccagggccccgggggcccggcctcgcccgagccctcggattcccactcggcagcccgggcgtatcccgggggcggggctggccagttatagccccaccccggctccacccccgcccctgccgcgcgactccgctccccgcgccgccgcgcgtcctttgtctggtcccggcgcctgggcctccctcttccactcttcctatctctccgtctctgcgtgtgtgtctctgtgcattgtgtctctttccgggcccctttttcgagtcgtggctagcactgggggtgggggcatgattggcgctccctccatgcctaagcctctcccctcctggaccctgggacccgcccacctggctctgagaaatgaggtcccggaggcctggctcacctgctgtgtgacctcaggccgttcctttccctctctgggcctcgtgctgttcacccaggtctgggaactggagtgtggcctcctgaggacctcagaactcccgcaacagtccagcatctcctaagcgtcctctgatcggttctctcatttgaaaaaggaaactaatgcacaaagggaaagagggtgtggtcagaggtcacacaagggccttgaggacctaggttctccagtgagcgagccctggggcagagatgtatcatggggacaggctgggaggaagagaggtgacaaattaagaccaggaggaccctgcattgaagaagggcccagaagtaggaggctcagtcagcaccacgtggtagcccagcctcaccatgcatagccactcaatgccctattgtcgccggtatccaggcatctgtcactgtgactggggccaggggccgcagctgggggccgtgggggtcagacacaggaggttttaagaaaaaagtggcctcaggtgtgttcactgcaaaacccatacgtcagatgtatgtgcgatggtggaaaagaggaagagagagtgatgaggccagggacacagaacggttcagagagagggcaggacagtggagaagagagggaaacagaggaagaaagagggagagagaaaccaaaagtcgggggagacttagaagaagcactggagagaatgggaagcttccctaaccctccatcttttatctgccctcctcctccctgactttgccacccccccatctctgtctggggccagtcgccgaagtccctttgatgcccatgtagccaccatcccaggctgtgcacttactgcaggctggggcagggcgggtgtggcttccatcaatctgatccccattatcagctcagccggctcagccacagaggaaacgagatactggtcccgctaagctctggcacaaatgggagggagaacgggtggtggccagattagcaggctaggcctcaagaacctgggtctgaaccacccagtcacctcttcactctgctcaggttggggacaccatgggaggggggcagccagtaactctttcggctctagggtcatcggatcaggagtcagatgttgacaccatcccctccacctcctcctgtcaccctggacaagtcataggtccctgtgactaaccctcagtgtccccatctgagaaatggaggagacccttcataccattcactgtggttgtgggaggtcaatgaaaactttgcacatgctcagtggagttcaaaaataggatctagcacggtggctcatgcctgtaatctcagcactttgggagcccaaggtgggtggatcacatgaggtcaggagttcgagaccagcctggccaatatggtgaaacaccgtctctactacaaatataaaaagttagcggggcgcgatggtgcacacctgtggtcccagctacctggctgaggtggaagaattgcctgaacccgggaggcagaggtttcactgagccaagatcatgccattgcactccaggctgggcaagagagcaagactccatctcaaaaaaaaaaaaaaaaaaatagggatctagcatgtccagaagcagtggcttgtgtactgccaactgctcactgggctcttatagcaaatatcagcaactcaacatagaactcttacctcaatgagcttaaatgcaaattcagaatccatctccagggccagtcatggtggagctcacacctgtaatctcagcactttgggaggctaaggcaggaggatcgcagcctgggcaacatggcaaaacctcatctctacagaaaaagagaaaaattagccggctgggtggtgcaagcctatagtcccagctacttgggaggttgaggcagaaggaggttaaggcttcagtgagccatgatcgtaccactacactctagactgggcaacagagcaagaccctgtctcaaaaataaacaaggaaaagaaaaaccccacaaaactcttaatgaaccaggatgcaaattcagaatccagctccatacatgtgagacctctgtgccataccttccttaaggaagaacagaaaggcatagagaggtgacctaactatcagaggacagcatgaggagggtggagtctgacatgtgtagccctcagtaaatatttgttgaattgaattaatagactcaaccgatggagtgggtttaaatgtcatgatgcccagggcacggcagagagcaggtactcagcttcgctttgctgttattattttgttattatattactggtcttttcgttaggggagtgggctctaaagtccaaaccctggaactgaattcttttttttttattttttattttatttttctaatttttgagacagagtctttctctgtcgcccaggctagagtgcagtggtgaaatctcggctcactgcaagctccgcctcccaggttcaagtgattctcctgcctcagcctctcgagtagttgagattacaggtgcccaccaccatgcctggctaatttttgtatttttagtagagatgagagttcgctgtgttggccaggctggtctcgaactcctgacctcaggtgatcctcccgcctaggcctcccaaagtattgggattgcaggcctgagccaccaagcccagcctgaattcttgtttcaccatttgccgcctatgcaactctgttcctattccttcatttttttttttttcccttaagagtcagggtctcaccctctcgcctaggctggagtgtagtggcatgatcacgctccctgcatcctcaaacttctgggctcaagttgatcctctcacctcagcctcccaagtagctgggactacaggcatgcaccaccacactcagctaatttttttggaaattttttggtggaaacaagatctcactgtgttgcccaggctgctctcaaactcctaggcttaaatgatcttcctgtctcagcctccccagtcaccctgtcccttcattgagactctctttcctcgtgtattaaatggagaaaggaatctcatcatgttcaacggcaggagaaccacctggaagtttcacatgaggaatttttcctggcacacaacaggcacctcaatacatggttacgcgatcagttaagtattaatgttaggagacgggaatgcagagctgtgcagtgcatgttactgcatcactgcgggtgccttgcagacattgctaatcaacccaatgcatattccttttgaggccggatgtgtcttcagagtagtcctccaggcagccctcccaggagcaactcagccaattggagatgcaggggagctgaccttctgtgccatctgttttacaagagtaaatgggccaggcgtggtggcttatgcctgtaataccagcactttgggaggccaaggcaggcaggtcatctgaggtcaggagttggagatcagcctggctaacatggcaaaacggtgtctctactaaaaatacaaaaaattcactgtgcatggtggtgcgcgcctgtggtcccagctacttcggaggctgaggcaggagaattgcttgaacttgggaggtggaggttgcagtgagccaagatcgtgccactacactgcagcctgggtgacacagcaagactctgtctcaaaaaaaaaaaaaaaaaaagtagatggtgaccaggtgcagtgactcatgcctgtactcccaacactttggaaggcagaggcaggaggatcccttgagaccaggagtttgagaacagcctgggcaacatagcaagatcccatctctacaaaaaataaaaaattagctgggcatgatgaattgcacttgtagtcctagctactggggaggctgaggtgagagaatcacttgagcctgagagttcagggtcagcctgggcaacatagcgagacaaggcattggccataatgatgaaaaacagctctgcaaacagatccaggactgaaatgaatttccctattcatacgtctctgaattcacttttgtcacctgtaaaatggagaatgtgttctcagtcttttaagattgttgggagagtaactgaaaatatgcctcaaagtatttcccacagtgcctggcacacagtagatgctcagtgtagtggaatgctcattaaaatagcagtattaggccgggtgcggtggctcatgcctgtaatcccagcactttgggaggccgaggcagtggatcacgagatcaggagatcgagaccatcctggctaacggtgaaaccccatctctactaaaaatacaaaaaattagccaggcgtggtggtgggtgcctgtagtcccagctactccagaggctgaggcaggagaatggtgtgaacccaggaggcggagttgcagtgagctgagatcgcgccactgcactccagcctgggcgacaaagcaagactccgtctcaaaaaaataaaataaaataaaatagcagtattgccccatgcaatggcacatgcctgtagtcatagctacttgagaggctgagatgagaggattgcttgagtccaggagttggaggctgcagtgcactacgattgcacctgtgaataataactgcactccaggctggacaacatagagagaccccatctttaaataaaagaataataggccaggcatggtggctcacaactgaattctttttttttttgagacggagtctcactctgtcacccaggctggtgtgcaatgctggagtgcaatggcacagtctcaactcactgcaacctctgcttcccaagcaattctgcctcagcctccctagtagctggaattagaggcacccaccactacgcctggctaatttttttgtatttttagtagagacagggtttcaccatgttggcaaggctggtctggaactcctgacctcgtgatctgcctgcctcggcctcccaaagtgctgggattacagacgtgagcaaccgtgcctggctacaactgaatccttagcactttgggaaactaaggtgggaggatcacttgaggccaggagtttgagatcagcctggtaacatagcaagaacccatctctacaaaaaattaaaaaaattagccaggcatggtggcacatgcctgtagtcccagcttctcaggaggctgaggtgtaagaatcacttcagccccggaggtttagactgaaatgagtcatgatcataccactgcaccccagtctgggtgacagagcgagaccccgtctctaataataataataaataatgtaggtgtattatgaggtacggatgatggatgtgacaagcctgcttttaattcccatgatcatgcccatgacagacgtaactaaccaattccagatgctttacagcatatggctttagctactaccccaggccagtgtgactataatttggagtttgcagcaaaatggagcagaggctcagaagcactaagtagtctatctgaggacacacagctgggaaatgttagagctggcactgttcttggttggcagtggaagttggaaatgcacactctggatcagaaaaactcatatgcaaatccctgttccaccatttatatgctgcatgatctttggcaatttttaaaatatctcagtttcctcatgtattaagtgggggtgaagtgggggaggaaaaattctctttttaggattgttgtgaataagaacagaaaacttgcatgtagagtgctttgcacagtgcctggcacacagtagtagccaatatttgggaacaattaagatattggagcttgagtcagggatggttgagataatatgtacctgctggctgtttctagttgtgtggccacagcagacattgctaatcaatcacagtgatctttcctactgaaaactgtatgtgatttctttttctttttcttttcttttctcttttctttttttgagagggagtctcgctctgtcgcccaggctggagtgcagtggtgcgatctcggctcattgcaagctccgtctcctgggttcacaccattcccctgcctcagcctccggagtagctgggactacaggcgcccgccaccatgcccggctaattttttgtatttttagtaaagacggagtttcgccgtgttagccaggatggtctcgatctcctgatctcgtgatccacacgcctcggcctcccaaagtgctgggattacaggtgtgagccaccgcgccctgcctcttttcttttctttttgagacagagtctcactctgtcacccaggctggagtgcaatggtgtgatctcggctcactgcaatctccacctcccggattcaagtgattctcctgcctcagcctcccaaatagctgggattacaggtgcccaccaccccacctggctaatttttgtatttttagtagagacggggtttcaccatgtttggtcaggatggtctcaaactcctgacctctggcgatccacccccccttggtctcccaaagtgctgagattacaggcgtgagccaccacgcctggcttcttcttctccttctccttttccttctccttctcgttctccctctccctctccttcttcttcttcttctttttcttttttgttatacagtgtctcactatgttgcccaggctggagtacagtggtgccatcatggctcactgcaacctccacctcctgggctcaagtgatcctcctgtctcaccatcctgagtacctgggaccacaggtgcaagccaccatgactagctaatttttaaatttcttgtagagacaagatctcactgtgttgcccaggctgggcttgaactcctgagctcaaccagtcctcccacctcggcctcccaaagtactgggattataggcatgagccagcacgccttgcctaaatgtggtttctgaattcttcttaattcattcctctaggaagacactaccaatcagtatgtgtgtttgtttttgagacggagtcttgctctcgcccaggctggagtgcagtggtgcgatcttggctcactgcaacctccgcctcctgggttcaagcacttctcctgcctcagcttcctgagtagctgggattacaggcgtccactaccacacctggctaattttgtaattttagtacagacagtttcgctatgttagccaggctggtctcaaactcctgacctcagatgatccacctgcctcagcctcccaaagtgctggctgggattacagccgtgacccaccatgcctggcccagttcaggttttcaagtgagggtaaacctatgtgccaactgtgccactgaagaagatgtaaggaaatgctggctacttgaccttcttatgtccctgacagataaggtcagtcaaatcccagcactgtttgctgctgatttctgaagtggctttaaaattctcctctacatagcccttcatatagcccttgccaattgttctgaattttcagcaaagtgaaacagaggccctagcaggcatatccaaagacgcatagtgagttgtcagagccagtaccagcctggttgactgttacagtaagaaaattgggccaggttcagtggctcatgcctgtaatcccaacactttgggaggctgaggcatgaggattgcttgaggctgtgagtttgagaccagcctgggcgacatagtgacaccccatctctacaaaaaaaaaattttttttttttgagacagagtctctctctgtcgcccaggctggagtgcaatggcgcgatctcagctcactgcaaactccgtctcccaggttcaaggaattctcctgcctcagcctcctgagtagctgggattacaggcgtgtgccaccacgccccactaatttttgtatttttagtagagatggggtttcaccacgtgggtcaggctggtctcgaactcctgaactcatgatccacccgcctcggcctcccaaagtgctgggattacaggcatgagccactgcgcctggctcaaaaaaaaaaatttttttttttgagatggagtctcactctgttgctcaggctggaatgcaatgatgtaatctcagctcactgcaacctccacctccctggttcaagcgtttctcctgcctcagcctcctgagtagctgagattacaggcgcacaccaccatgcccggctaatttttgtatttttagtagagacgggatttcaccatattggccaggctggtctcaaactctgacctcgtgatccgcccacctcggcctcccaaagtgctgggattacaggcatgagccactgcgtctagcccaaaaaaatttttaaaaattagccaggcatggtggcgcccacctgtagtcctagctacttgggagactgaggcaggaagaatgcttgaacccaggagtttgaggctgcagtgaactacaatcacaacactgcactccagcctgggtaacaaagcaagatcctgtctctaaaaaaagaaaagaaaattgtagagtggtcttcacattccgagggtcttcatttcatttccaatgccagagcagataggctatgtgacttcagcacgttccttaacatctttaagcctcagattctccatctatcatagcaaagttaacttataccatttaataattaattattttgttttattttgagatggagtttcgctcttgttgcccaggctggagtgcaatggtgggatctcagctaccgcaacccccgcctcccaggttcaagcgattctcctgcctcagcctcctgagtagctgggattacagacatgcgccaccacgcccggctaatttttttttttttttgtatttctagtagcaaacggggtttctccatgttggtcgggctggtctcgaactcccgacctcaggtgatctgcctgcctcggcctcccaaagtgctaggattatgggcgtgagccaccatgcccggccttatttatttattttattactattatttttagatggggtctcgctctgtcacccagcctggagtgcaatggcacgagctcagctcactgcagcctccacttcccgggttcaagcaattcttgtgcctcagcctcccgagtagctgggattacaggcgtgtgccaccacacctggctaattgtggtatttttagtagaggcggggtttcaccatattggccaggctagtcttgaactcctgacctccagtgatcctcctgcctcagcctcccaaactgctgggattacaggcttgagccactgcccccagctttatttatttatttttgagacagggtctcactcggtcgcccaggcaggagtgcagtggtgtgattatggtttactgcatccttgacctcccgacctcaggtgatcttcccacctcagcctcccaagtatctttgctacaggcacacaacatcacattcagctagtttttaaatttttagtagagacagggtttcgccatgttgcccaggctggtctcgagctcttgagctcaagcaatccgtccaccttggcctcccaaagtgctggaattacaggcgtaagtcactgtacccagccaacttctaccattttagagtctttgtgtgaattaaataaacagcatgtcctcctcaacatatatgtaaaaaaatgctaaaccaccaaaaaattcagcaaattaaatcaagcaatgtatataaacaaaactgcaatatgcatgaccaagtttggtttatcccatcaagattgatttaatattagaaaatcaattaacggctgggcacggtggctcacgcctgtaatcccagcactttgggaggctgaggcgggtggatcacctgaggtcaagagttcgagaccagtgtgaccaacatggagaaaccccgcctctactaaaaatacaaaattagccgggcatggtggcgcatgcctatacttccagctactcaggaggctaaggcaggagaatcgcttgaacctgagaggcggagtttggggggagccaagatcgcgccattgcactccagcctgggcaacaagagcgaaactccgtcccccctcccgcgcaaaaaaaagaaaatcaattaacgtaattcatgacattaatgtattaaagctaaaaaatgggctgtgtgcggtggctcacgcctgtaattccaacactatgggaggccaaagcaggaggattgcttgagcccaggagttcgagaccagcctgggcaatatgccaaaaccccgtctctactaaaaatacaaagaaaaaaaaagtagccaggcttggaggcgcatacctgtagccccaagtactggggaggctgacgtgggaggattgctggagcctggaaggcagaggttgcagtgaaccaagattgccctactgcacttcagcctgggtggcagagcgagaccttgtctcaaaaattaattaattaaagctaaaaaatggtttcaattgatgtaaaaaaaaagtcaataaaattcaacatccttttttaaaaaagtcttaggatctaggaataaaagaaaatgttcttaacccgataaaggccatctagaaaaaaacccatagcaaagatcatgtttggctgcaaaatgtttaaagcatctcccttaacagcaggaataaagggccgggcgtggtggctcatgcctgtaatcccagcactttggcaggctgaagcaggcagatcacgaggtcagcatttcaagaccagcctggccagcctggccaacatagtgaaaccccgtctctactaaaaacacacaaaaaaatttggcgggcgtggtggtggaaacctgtagtctcagctacttggaaggctgaggcaggagaattgcttgaacctgggaggcagaggtggcagtgagccaagatcgtgccattgcaccccagcctgggtgacagagggagactctgtctttaaaaaaaaaaaaaaaaaatcaggaataaagaagccactatcacactgtagcccctgaaatgacaagaaaaatagataacaggtatagactgaagatgaaaaaataaaattgtcattatttgaaggtgttttatgttatacaataaaagcaaaagaacaaaatagctcagtgggaaaactgggggtggcaaggggagatgaaggcaggtaaatgactagtaagaaacttatgcatgaagcaaaagacataattagcacatttgggataggaattacctttggtgggaggaggcaaataaatatgtttagggaagggcttatgaggcttcaaagctactaaaagggccaggcatagtagctcacacctgtaatcccagcactttgggaggccaaagtgggaggatcaccagagcccaagagtttgagaccggcctgggccacatagtgagaccccatctctacaaataattttaaaattaaccagacatggtggcatgcgcctattgttccagctacttgggaggctgaggtgggaggattgcttgagcctggaaggtcgaggatgcagtcagacttcatggcaccactgcactccagcctgggtgacagagcgagaccctttttctaaaataaaagctactaaaaatggggccagacgcggtggttcacgcctgtaatcccagcacattgggaggcggaggtgggtggattacctgaggtcaggagttcgagaccagcctggccaacgtgccgaaaccccatctctactaaaaatataaaaattagctgtgcatagtggcatgcacctgtaatcccagctactctggaggctgaggcaggagaatcgcttgaacccaagaggcggaggttgcagcaagccgagatcgcaccactgcactccagtctgggtgacagagcaaccaactaacaaacaacaacaacaaaaacaaagaaagctactgttagatttacttttctgagagcgaaagcatttattttattttatttttaagatggaatttcactcctgttgcccaggctggagtgcaatggcgcaatctcggctcaccacaacctccgcctcccgggttcaagcaattctcctgcctcagcctcccgagtagctgggattacaggcatgcgccaccacgcccggctaattttgtatttttagtagagatggagtttctccatgttggtctggctggtctcgaactcccgacctcaggtgatccgcccgcctcagcttcccaaagtgctgagattaggggcgtgagccactgcgcccgacgtgaaagcgtttccggtgtgaaagcgttttttattttgtaaatgcacaggttgattttaggcctctgtttgcgtatatagtagtcatataagggatttcttgcagtaaaaacatcaggtgctttgtttccccccaatgcttattccaatatatggaatcccatcattattcccatcattagaataataaagtgacccctccccatgacgaagcccctataagacatggctaattcatcaccaccaagccactcattgccgcaggcccctggtgtggggactgggcggtgagcggatgcgacctgttatctccagcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacaggtgtggctgctggagttgcggggaggaacagaggtggtagcctcagaaatacagaggtgatgggggcaggtgggacccttgctgaggtgtctcgggggtaatcgaggcaggaggtggtctagggatgtgaggtctgatggggagatgggtataccccctaggtgaaggtctcaggagcgatggaggcaggtgggactctagcatcgaaggtgtcatctggaaacaggaaggtggaaacttggtggggaggggacagtctctcaggcctgaggtgggacactggcaggtgtcaaggctgggtgggaaggtcatcattctggttctgcccacagggcagagccttggctacgggtttgtgaactattctgaccccaatgatgcagacaaagccatcaacaccctcaacggcctcaaattacagacgaagaccatcaaggttggtgcctccttctccaatcccccatgaccgcccaccccaactgactgtccccaaccccctactgccacctacccgcccccatgcatccatgtccactgcctttcaggactcatccccagaggggctcaaatctcccctccaagacttcctagctggggtgggggcaatggctttccctctctaaacctcagtttcctcacctgtcaatggggacagtactggctccacgatctctggaggctcagggagtcagccaggccctgtaaggcagagtgaccagggtcctgtgagcagtcccctccctgcttttgtcatggaaatgggggtgggggcccatctgccatctggagcctaattagggtctgggagggcgggattggggcggcccatcccccatctttgtgcaacgcccctcccccaggacctcccttctcagcagctgcagctgggaccctacaagcccaggttccctgggggggaatcgtcatggaaacccccctctctgggttcgcctgggggtgtttgggctccgccctgcaaatctgctcccggaccctggaggaagccagggtcgggggggtggcccatctggcccccagttcaacatgggaacagaggtgcaggaatctcttccctttcctgatgtggggggttggggattggggtgggggagtgaagttgtgacccaatgggtcccttcatggccaacgagacccagaagcctcagggcatgaggaccccagaccccagtgacattgagatgcagcgtgtatgtgtgtgtgtatgtgtgtatgtatatgtgtacgcatgtgtgtgtgtacgcatgtgtgtgtggtgtgtgtgcatgtgtgtatgtgtgtggtgtgtgtgtgtgtggtgtgtgtgtgtgtatgtgtgtggtgtatgtgtgcggtgtgtatgtgtgtggtgtgcggtgtgtatgtgtgtggtgtgtgtgtatgtgtgtggcgtgtaggtgtattacgtgtatgtgtgtgtggtatgtgtatgtgtgtggtgtgtatgtgtatgtgtgtggtgtgtatgtgtgtggtgtatgtgtatgtgtgtgtggtgtgtgtgtgtctgtgtggggtgtgtgggatgtgtgtatgtgtgtggtgtgtgtgtggtgtgtgtatgtgtatgtatgtgtgtgtggtgtgtggtgtgtgtgtggtgtatgtgtgtggtgcgtgtgtgtggtgtgtgtggtgtgtgtatatgtgtggtgtgtgtgtggtgtgtgtttgtggtgtgtgtatgtgtgtatgtgtgtgtggtgtgtgtcttgtgtatgtgtgtgtctggtttgtgtgaggtgtgtgtggcgcatgtgtatgtggtgtgtgtggtgtatgtgtctggtgtgtgtgatgtgtgtgtggtgtatgtgtgtggtgggtgtgagatatgtagtgatgtagtagtgtgtgcagtatgtgaatggagagttggctagatgaagtgtggatgggtgcggcatacaacatgaacgtgggtgggagcgggtgtgatgtgggagcgagggttaagnnnnnnnnnnnnnnnnnnnntgtggtgtatgtgtgtggtgtgtgtgtgatgtgtgtgtgtgtggtgtgtgtggtgtatgtgtgtggggggtgtgtgtgtgatgtgtgtatgtgtgtgtcatgtatgtgtatgtgtggtgtgtgtggtgtgtgtgtggtgtgtgtggtgtatgtgtgtgtgtatgtgtgtgtggggtgtgtgtgtgtcatcttgagttgtgagatacagtgtttatgatccaggtgtcccgtgactcactgtggctctggctgtgacacaatggttgtgggacacagtgtgcgagtggctgtggccaggcacagtggcccacgcctataatcccagcactttgggaggccgaggcaggaggatcacttgagcccgagagtttgagaccaacctgggcaacgtgacaaaaccctgttcctaaaaaaaaaaaatttaaattagctgggcgtggcatcttgcacctgtagtcccaactacttgggaggctgagtggggaggatcacttaagctgaggcggccgaggctacagtgagtcatgtttcaccactgcactccagcctcggcaacagagcaagaccctgtctaaaaaaaaaaaaaatatatatatatatatatagagagagagagagagagagagagagacagagagagacagagagagagagagggagagagagggagggagagagaggctgctgtcaagtgcatctgtgtatttaagacttcgggtatatccctatgtgtctgtaggataaggttttttttttttggttttttgattttttggggttttttttgagacagagtctccctctcttgcccaggctggattgcaatggcgcgatctcggcccactgcaacctccgcctcccaggctcaagcgattctcctgcctcagcctcccgagtagctgggattacaggcacccgccaccacacctggctaattttgtatttttagtaaagacagggtttctccatgttggtcaggatggtcttgaactcctgacctcgtgatccacccacctcagcctcccaaagtgctgggattacaagtgtgagccaccgcacccggcccaggatgacgtgcttattatttgacaggtgcatgtgacactgtgactccggctgtgacctgatggggcctcagggatgcgtctggctctggcaggatgtttgtgtgtcaccgcgatgttgtgtgggtgtgtctacctgtgccctgctctgagggattgagtgtgatatcgtgtgtttgtgctgcgctgtgatgggtatgtggttctacgaccttcactgtaattctctgagactccctcctgaacgttgctgagaatgtgacagtggcctgtgtcaccctctggctggtttcatctctgaggctgtgcagcggggcggcactgcatggccttctgtctgtccctgggtgtttttgcctgtgtgacggtgttgcgcggtcagtcaggactgggcgctatggcagctgcccaaaatatctccagctgcctgccgcgggccaggccccatcccagggtggggtgtgggtggagtttggtccatccttgcccttgggaaacccatgtcatggagggatggaaaaggcctgtgaaaacctcctctgtgtctcagacggtgttggacctccaatatccacccaggatcttacccccaaatctaatccctcaacccaaatctgattcatcagcaagtaccctcacagctcctagccccatgggagagaaaaaaagaagagaaaactgtcaaatacattgacatgatttctttctttcttttttttttttttttttgagacggagtctcactctgtcacccaggctggaatgcagtagcgcgatctcggctcactgcaacctctgcctcccaggttcaagcaattctcctgcctcagcctcccgtgtagctgggactacaggcgccagccaccatgcacggctaatctttgtattttttttagtagagacggggtttcagcatgttggtcaggctggtctcgaactcccaacctcagatcatccacccccctcaagcctcccaaagtgctgggattacaggcgtgagccaccgtgcccagcatggacatgatttatttcttaattaatttatttatttttctgagatggaatcttgctctgttacccaggccggattacagtggtgcgctctcggctcactgcaattccgcctctcaggttcaagtgattctcctgcctcagcctcctgagtagctgggattacaggcgcccgccaccacgcccggctaatttttgcatttttagtagagacggggtttcaccatgttggccagggtggtctcctactcctgacctcaagtgatctgcccacctcggcctcccaaagtgctgggattacaggcgtgagccaccgtgcctggcctggctgtgattttaaaaatcattattatggacatgacaatggctgatgtgatttttttttctggagaaccccaggtgcacaaaattatattaatcagaccctgccccccattcactctcaaactgctttatctattttgttcatttttaaactagttatttcttttttttttttttttttgagacggagtctcgctctgttgcccaggctggagtgcagtggcgcgatctcggctcactgcaagctccgcctcctgggtttacgccattctcctgcctcagcctcccgagtagctgggattacaggcacccgccaccacgcctggctaattttttgtatttttagtagagatggggtttcaccatgttagctaggatggtcttgatctcctgaccttgtgatccgcctgcctcagcctcgcaaaatgctgggattacaggcgtgcgccaccgcgcccagctttaattagttatttctaatggaggcatacactctcacaactcactgtctcaactcactgtcccaaacaaaagccagaagacaatgacccctatctatcaagaggttaattagaagaaacagaaaatagaggctgggcacaaaggctcacacctgtagtcccagcactttgggaggccgagggtgggaggattgctggagcccgggggggtcaaggctgtggtgaaccatgattgcatcactgtactccagcctgggcaacacagcaagaccccatctcaaaacaaacccacaaacaaaaacctcacttaacaagaaaaagaaagaggaaaggaaggaagggaaggagggagggaggaaagagggagggagggagagtggaaggaaagaaggaaggaatgaaggaaggaaggaagggagggagggagggagggagggaggaaaaatagatacagcagacataagggggagaattgctgatgaccacgccccagcctcttccccagtccctggtgacaggtcacccactgagcatttgagaggtggacttccctaccatgcttccaggacattgataaacacacaatgaaacaaggtcacacaatattccctgctttgtaaatagacttttctgtcccccattttacaatactcaccagtcaccaccgtttctgggaaataaatatatatgtccatctttttctctttttttttttagagacagggtcttgctctgtagcccaggctggagtgcagtggtgtgatcatagctcactgcagcctttaactcctgggttcaagtgatcctccagcctcagtctcccgagtagctgggaccacaggtgtgcaccaccacacccagctaattttttttttttttttttttgtagaggttgtggcggtggaggacgggggtgagtcttgctgtattgtccaggctggtctcaaactcctgggctcccttgatcctcctgccttgaacttccagagcactgggattacagccatgagccactgcacctgacccaccatttttttaaacacctgcagagagtttcgttgttgggttggactataattaataatgtgattcagataacagtgctaaaatgtgtctaattcctagttaggagaagtgctttgagaaagagtaataggggtggtggggggaggacaaatttagatgagagaggacagggaggatgtttcaactgagacccaaagaaagaagaggaggaagagcattccaggcagagagaacaggcaatgccagggccctgaggctgagacatgcctggtgtgtttgggaaaaatgggggaagttcaagttgctggaacacagtaattggggcaggaagtagggggagatgagggcaaggatgtcatggggaagaatgtgcagggttttgcggtccaaggaaaggactttggcttttctgctgaggaaggtgggagccatagagggttctgagcagaggggggatgcgacctggctcaggtgttcacaggcgccctctggctgccgtaggggggacagacagtgggggatgggagcagggggggccagggtggaggctgctgcactggtccaggtgatcagtagtgaaggctgggccagggtgggacagtggcagtggggtgaagtgtgtggattctggataaggaggaaggtagagcctacaggatttagagtgggttggatgtgcatgtgaagaacaggtgtcgagaacaacctgaacctggggacatgagcacttaggaggacagagttgccattagtgagttggggcagattggaggcgggcgggagcaggaggcacccgtgctgtgtatgaagtgcccttgacacccccatgtggggcacctggatgcagttgccaccaggggtgcagactggggacatttgggagctgatgactaaagacctgagtgtccctggggggcccagtgtagctgggaagagaaggggccagtgtcttaggtccactctctataggagtgggaagagtggctgggtgtggtggtgcatgcctgtagtcccagctacttgggaggctgaggtgggaggatggcttgagtccaggagttggaggctgcagtgcagtatgattgcacctgtgaataataactgcatttagcctgggcaacacagcaagactccgtctttcaataaaataaaaataggccaggcatggtggctcacacctataatcccagtattttgggaggccgagatgggagaactgcttgaggccagaagttcaataccagcctaggtaacacagtgagatcctgtttctacaaaaaaaaaaatttaaagattagctgaggccgggggaggtggctcacacctgtaatcccagcactttgggaggcggaggcgggcggatcatgagatcaggagctcgagaccagcctgaccaacatgatgaaaccctgtctctgctaaaattataaaaattaggtaaggcgcggtggctcacgcctgtaatcccagcactttgggaggccgagatgagcggatcacaaggtcaagaggtcaagaccatcctggccaacatggtgaaacccgtctctactaaaaatacaaaaaaataaaaaaaaaattagctaggcgtggtggtgggcgcctgtaatcccagctagtcaggaggctgaggcaggagaattgcttgaacccggtaagcagaggttgcaatgagccgagatgtcgccattgcactccagcctggcgacagagcaacactccatctcaaaaaaaaaaaaaagaaaaaaaaaatgctggtcaggcgtggtggtgggcgcctgtagtctcagctacttgcggggcttaggcggtaggattgcttgagcccaagaggtcgaggctgtagtgagctgagatcacaccattgcattccagcctgggtaaaaaagtgagatcctgtctttaaaaaaaaaaaaaggtcaatgtttgttgatggactgtcaagcatgtgatagtgatgtgagccggctattcaaggatccctttggggtcacatgtcaccccagggagacatgtcctccctaggtggcaggtccccatcactctatacaggcagtccaagttgttacagccactgccatgtcccctctcccatatctgactcagccccaccccacggtgacaactctagagatacttattgagtgacggatgggtcacttctgctaactccgtgatggtttagacatggcctcactctctccatctgtgaaatgggtctctgcctcacccctgtccatctgaccccctcacccaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtcaggcagtcagggagggtgcacctggcgggggcgctgggcaaaggcagtcaggtgggaccaacgtggggaaaccgaccaagatgccagggcatgaagcagggaagggagaagtggggttacacaggaggggacagggtcgtcgtgatggacatccctgccccctggcaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggtgagccccctgccagccagatggccccaggccgggtgcccccaagcttgcaaccctccctgaaccccattcctgccgaagggagggatgccgggagggtgcgcacacatgggagccaaggagcctatctgtcaggtgccaaggccagccactcatatacagcaggccctcaatgtgtgctggccgcgacgattggcattcttggtgttaaaagattttggcgtcatctgggttccagctctggtggcccctttctcttttgggcacgtggctgtagctctgtgcctcagtttcccatctgtaataacaccaaatatttcatgagtctttgctgtgtgctagacacccttatttttctgcaacccgatgagaacagagcttgtgttgtccctgttttatggacggggaccctgaggcacagagaggtgttggggtttgcctggcccaaacagagcagagactcaaacccaggacctggagtccaagctcatagccactccaaggggagacaatggaagccccttgtgggcccccgggtggccggggcaagttacccaccccctcaagtgctgcgagaatgttggctgtggtagttactgtcgcctttgttaggagttatctttccccagggatcccagcgcctgggcccagaggggacccgccagccaggagggggaggatggatgaggaggccagtgcaggctggacagcggtggggcaggcgagaggcggtgcctgagtgaccacggttccgtgccaggcagtgtctagccgggcgggcggggagcaggcaggcgggggcagggctctgctgcaggcctgttgggtgggggtggggagggcaggccgacggtgtcacagcaggggggcgtgactggaagccacctctgaccaccacctctgcctccacaggctggacaatttgctcaacatggcctacggcgtcaagaggtaacagtgaccccgccccactgtccccacccctcaccatccatgcccctgatgcacccctccccagctcacccccagggctgcaggcttagccttgtttgcctgggtcttggagtagcatggccattgagagatgtgacatcaaagccagacgtggtggttctcgcctgtgctcccagtgtttcgggaggctgaggggcaaggagcacttgaggccaggagttcaagatcagcctgggcaacatagtgagatccttctctacaatttttttttaaggattagcctgatacggtggtgcatgcctgtagttcaggctactcaggaggctgaggcgggaggatcgcttgagcctaggagttggaggctgcagtgaactatgatggtgccactgcactccagcctgggtgacagagcgagaccttatctccaaaaattaaaaaatgtggctgggcgcggtgtctcatgcctgtaatcccagctactcaggaggctgaagcaggagaatcgcttgaacatggaaggaggaggttgcagtgagctgaaatcgtgccactgcactccagcctgggcaacaagagcgaaactccatctcaaaaaaaaaaaaataattaaaaaatgtaaaagaagatctcagtctgagtctagtgggggaggagacagagaaatgaatggtgatgaaagctgtgaagtagaaggggtaacagaggccgggcgcggtggctcacgcctgtaatcccagcactttgggaagccgaggcaggcggatcacgaggtcaggagtccaagaccagcctggccaagatggtgaaaccccatctctactaaaaatacaaaaatttagctgggcacggtggcaggcgcctgtaatcccagctactcgggaggctgaggcagagaactgcttgaacccaggaggcggaggttgcagtgagctgagatcgtgccactgcactccagcctgggcgacagagtgagattccgtctcaaaaagaaaaaaaaaaaagaaggggtgacggagacccagcagcagagaccccccagtcccatctgaggcaacatccacacaaaggcagagtggaaagggagttcctagcagtgggaaaagcctgtgcaaagagggccagaaggagcgagtagtttgttcctcgtggtcaggattgaatggttcaggcccttgggtcctcccttcccagctgaggggtttaatccaagggcgggattgccagtgaggaatgtgagtggagccaattctgtcctttcattaattcattcaacagacacctcccaagtgcttactaggtgttgttcaggggctggaacaaactcttgcagggaagatgaagttgatgataataaatatatgatttgaaaaggaaagccgggtgcagtggctcacacctgtaatttcagcactttggaactccaaggtggtaggattgcttgagcccaggagttcgagaccagcctggctaacgcagcgagaccccacctctacaaaaatttttaaaaattagcggggcatggctgggtgcggtggctcatgcctgtaatcccagcactttgggaggtcgaagcgggcggatcacctgaggtcgggagttcgagaccagcctgatcaacatggagaaaccccatctctattaaaaatacaaaattagctgggcgtggtggcaggtgctactcgggaggctgaggcaggacaatcgcttgaacctaggaggcagaggttgcagtgagctgagatcatcccactgcactccagcctgggcaacagagcaagaccccgtctcagaaaaaaaaaaaaaaaaattagtggggcatagtggtgcacctgtagtcccagctacttgggaagccaaggcaggaggattgcttgagcctgagagttcgagaccagcctaagcaacatagtgagactgtgtcaccacaaatcataaaaaaaattagctgggtgtgagggcgcctgcctacagtcccagctgctcaggaggctgaggcgggaggtttgcttgagcccaggaggtcaaagctgcagtgagccatgattgcaccactgcactccagcctgggtgacagagcgagaccgtgtctctaaaaaaaaaaattgcattgcaggggtcacaccattccaaggtcatggcacagtcaggggtcataaaggtgtgaagggtcacaacggggtcagaagcatgcggggggtcagggcagagcccgcgtgacccccaaagtagtcccctgtcgctcatcgccaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaaagacaaaaaaaaaaaaagaaaatattttggcaggttatgtttaccaactggggcgggggtggggggggcccagggagcagggcttaggggctagcagcccacggggccacacagagaaacaaccacgcagacagtcacaccacggggacacacggacagacgcagacggacacagcgacatgccccagacacgttaagggactggttggccaaactcagacacgtggacagggatagacagaaagagacagaagctggggctacgtccatgtggacacagaccacagatgtgggcacacgaatccatccacctgtccacgtgcacacgtgaatgtagcgatagatatttggacatcaaatttggacaccaggtcacggagaaacacaaacaccacccaggaacacgcagacatatgcccatagcatcccacaggcccaggcaggaggtcccaccccagaccctgccccagacgctccctcaccctctcggccccctcgccctggcccccaggttctctgcagagatctctcctggacccccagcggtctccttggcgcccacgaacacaggcgtgcacacgcagcgcacatgcattgagacacacgatacctcgttccaccttggcgtcacggtgggctggaggcagcccccccccccacaacacttgaggccaaaggacacccctgtccccggggctcagcctccccctgggccgaggccttggcccacacagctgagggagaggcccagccctgagcctcccccaccaggactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagaggg

SEQ ID NO: 15629 - DNA, 19601 bp, Human
ggccatgctggtctcaatgtcttaggacattgccaaatggcccctgtggggcaaaccaacccttttccaacaagaaccactggtttacaccttatggtactttgctatgtgccaggcactgttctaagcactttacacatttcaggtacctatgttgtactgttactatccccatttcacacatcgagaaactgagaacaattaggttactcttagtcccccaaggttggacaactattatgcagagccaggattccaacccagaaaatctggctctaaaaatctatgctcaggccaggtgcagcggcccatgcctgtaaccccagcactttgggaggctgaggaggaaggattgcttgagcccaggagtttgagaccagcctgggcagcatagtgagaccccatctctacaaaaagtaagaaaattagccaagcacagtggtgtatgcctgtagtcccagctactcaggaggctgaggtggaaggatcgcttgagcctaggaggtcaagtctgcagtgaactgttatccaaccactacactccagcctcaacagcagagcaagaccctgtcagaaagaaagaaggctgggcgcggtggctcacacatgtaatcccagcactttgggagccaaggccgtggatcacttgagatcaggagttcgagaccagcctggccaacatggtgaaacccagtctctactaaaaatataaaaattaggtgtggtggcacgcacctatagtcccagctagtcaggaggctgaggctcgagaatcgcttgaaccttggaggcagaggttgcagtgagccgagatcatgccactgctctccagcctaggcgacagagcaagaccctgtctcaaaaaacaaaaaacaaaaaaaaaaaaaacgcgggtgcagtggctcacgcctgtaatcccagcagtttgggaggccgaggcgggctcacgcctgtaatcccagcagtttgggaggtcaagagattgagaccaccctggccaatatggtgaaatccctctgtactaaaaatacaaaaattagttaggcgtggtggcgtgtgcctgtagtcccagctactcaagaggctgaggcaggagaatcgcttgaacccgggaggcggaggttgcagtgagccgaaatcgttccactgcactcccacctggcaacagagtgagattctgccaaaaaaaaaaaaaaaaatagagaaaataaattacaagaaagtatgaagtacagttcagtcggttctgaacccatgagaagttttaagagacagagaaggaaaaacatgaactaagtatgagtttttgcccagaaacggtttacctagactcatgctggagaaatacctttgtcacaccatgaagattggatgggcactgttgacccctgaccctctgtaccctctggagccatcttacctaacagttgtatctttttatgtaactcagccacctgagagtgcacagagggcttccctgcacctctgtggaaggatcctcccttggaacggcctggggtccacgcctgggctgtgcccttgcctcggaggtggctgggtttgcccgaagcctccctgcccttgaccctggaagagggcgtcgaagcctggtcctgaggaggcagggcgttggcggaggccgccctgcacagaggagatgtcatgatggggttggggctgaaggcccctaggggttagggggataactaggagtcagtcgcccctgtcagggatccgtcagctcggattcctagggctctgaaaaatgcactttccgaccgctaggtggttgcgctccgcatctctcggttgccaggtaaccgcctccccgtctctctccactgtttccatggagatcacccgcgttccgtggctgacactgcgttctcattggctgaggctgcatagaggggcggtcccaacagtgggcggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtgtaggtgtgaacgagcgggtgggagggcacctcagtttcttacagggggcaaccggagggtgcatgtgtgggtgtggacggcggaggctgttaatccctttggtctgttggcgggaattgggtcacaattgggcacagggagcggaggttttgagatcttgagatcctcgccattgatttgagcaaagtgagactggccaggattggggagatcgctgcccctcgcccccatatcggaaacaaagtgaggcctcattgcctggaagcgatggaggaatccaattggctggaagtagccctctcccactgaccgggatccgctttcttcctgcagcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccagtgagtcctcctgttcaccctcccgccaggctggaggtgggaggggccaacattgggccttagggataggcatttacagccttttgactcagtttcccggtagtgctccgctggtggggatgggaggacagaggtggtatttggtggagaaggcgcttacctgccctgggctgagcttcctgtaccccgcagatcatcacttctacgatgagtccaagcctttcacctgcctggacggttcggccaccatcccatttgatcaggtcaacgatgactattgcgactgcaaagatggctctgacgagccaggtgagccttttctctgttcatccatcagatgtttattgaacactgctcagtgccaggccctgtctgtgtgaccaagatactacctctgctggctcccctttgagtgggcagaaacaagctcagaagtcagtggtcagtgttatggccccgggcagctggaggagcccagagtcgtcctcctcccaagcctcggggtcagagaaggctcctccaaggaggtgaggtttcagttgaatcccgaaggtgctgcagatggaggggtcaacacgggcaaacccctagaagtgggagacagggtggggccaagagcaatccagcaggagacagaggtgaagggagaccctggctttttgtttttgtgtgttttgaagagacagggtcttgctttgttgctgaggctggagtacagtggcatgatcgtagctcactgcagcctggaactcttgggctcaagtcatcctcctgccttggcctcccaaagtgctggggttacaggtgtgagccaccgtgcctggatgagaccgtgtctttggttttgtttttgttttgagacggagtcttgctctgtttcccaggctggagtgcagtggcgccatctcggctcactgcaagctccgcctcccgggttcacaccgttctcctgcctcagcctcctgagtagctgggactacaggcacccaccaccacgcccagctagtttttttttgtatttttagtagatacagggtttcactgtgttagccaggatggtctcgatctcgtcaccttgtgatccacccgcctcggcctcccaaagtgttgggattacaggcgtgagccaccgtacctggccttgttttgttttgtttttaatttttttttttgagatggagtttcactcttatcgcccaggctggagtgcagtggcatgatcttggctcactgcagtctccacctcccgggttcaagcgattctcctgcctcagcctcctgagtagctgggattacaggcacatgccaccacatccggctaatttttcgtatttttagtagagatggagtttcatcgtgttggccaggctggtctcaaactcatcacctcaggtgacccacccgcctcggcctcccaaagtgctgggattacaggtgtgagcccccgtgccaggtggagaccctgttttgaagggcctcagtgagaagaggcaggaggcggcactggagagctttatttcgagccctggctgtgcagtgtacaactctttccttcctttggtttcctttcctttcttgtgctgtgtgcagtgtgggtcaggggctcttatctgtggatggatgggacatgtctgtccctgagctgactccgaaaaccttccctcccttcttcctcacaggcacggctgcctgtcctaatggcagcttccactgcaccaacactggctataagcccctgtatatcccctccaaccgggtcaacgatggtgtttgtggtaagtgaagatgcaccaggattctggaaaggtggtagagggagggagggaggaggcactgccaggtctgatcttggcttctgcctctgccacagactgctgcgatggaacagacgagtacaacagcggcgtcatctgtgagaacacctgcaagtacgtgggtgacagtacccctcccatcaccccaccccaagactttgcctggctccacccagtgaatcgggcccactctctcttctgcttttctgtatcgggttctctgtctgtgccaggtgccttgtgaatcctaatccccacctttccctctagtctggaagcaggtaggattgtttcccgattcaacagatgggggaactcaagtttagaaagggaaatgacttccccagggtcacataggagatagcagagccggcacttggactctaaactttccattgtcacgctctgcagcaggtcctgaaaaccgaaacacccacaggcaggtaaagtatacaacggaaggaggccaggcgcggtggctcacacctgtaatcccagcactttgggaggctgaggcaggcggatcacgaggtcaggagatcgagaccatcctggctgacatggtgaaactccgtctcactaaaaatacaaaaaattagctgggtgtggtggcgggcgcctgtagtcccagctactcggtgggctgaggcaggtgagtggcgtgaacacgggaggcagaggttgcagtgagccgagatcgcaccactgcaatccagcctgggcaacagagtgagactccgtctcaaaaaaaaagcaaaaaaaaaaaaagcatacaacagaaggaggccaagtatgaggcaatacggaggggtggggattgtggcatctaggggaacagctgttctcaattcctgccagctgatccttttgtagttcataggcatgatgatttatttttatttatttatattttttgagacagggtctcactctgtcgcccaggctggagtgcagtggcgtgatcttggctcactgcaacctctgcccttcgggttcaagcaattctcacacctcagcctcccaagtagctgggaatacaggcgtacccccaccacgcctggctaacttttgtatttttggtagagatggtttcactatgttggccaggctggcctcgaacgcctgacctcaggtgatctgctcgcctcagcctcccaaagtgctaagccgccgcgcttggccacgatgattaggtttttatgcacgtgtgagagatacgcctcccttaaaccttgttgcgaccttggcgcattacctgtctgatatgaaaaaataagacccggctcatggtggctcctgcctgtaatcccagcattttgggaggctgaggcaggaagactgcttgagcccaggagtttgagaccagcctgggcaaaatagcgataccctatctctataaaaagtaaaaaaaaaaaattaaaaagtaaaaataaaaattggaaattataatttaaaaaattactggttgggcatgtggctcacacctgtaatcccagcactttgggaggctaaggcgagaggatcaccttaacccaggagtttgagaccagcctgggcaacacagtgagacccgtctcagaaaaatttttcttttctttttttttttttttttttttgtgagacagagtctcactctgttgcccaggctggatggagtgcagtggcgcgatctcggctcactctaacctctgcctcccgggttcaagcgattcttctgccttagcctcctgagtagctgggactacaggcatccaccaccacacccggctaaaatttgtatttttagtagagacggtgtttcacaatattggccaggctggtctcgaactcctgacctcatgatccacctgccttggcctcccaaagtgcggggattacagatgtgagccaccatgcccggctgaaaatttgttaaaaaattagccgggtgtgttggtgcgtgtctgtagtcgcaggtactcaggaggctgaggcaggaagattgcttgggcctgggaagcagaggttgcagtgagctaaaaagtaaaaaaaaaacaaaaaaaacacaaagtcctatcagttgttggcagatggtgtaaaactctctggattccacatcttttaaatagaaggtggattgaacacaaccaacacacttctttttttttttgagacggagtctcactctgtcgcccaggctggagtgcagtggtgtgatctccgctcactgcaagctccgcttcccgagttcatgccattctcctgcctcagcctcccgagtagctgggactacaggcacctgccgctacacctggctaatttttttttttgtatttttagtagagatggggtttcaccgtgttagcccggatggtctcgatctcctgaccttgtgatctgcccgcctcggtctcccaaagtgctgggattacaggtgtgagccaccgcccctggcccacacttttttttgagttagagtctcgctctgttgcccaggctggagtgcagtggcatgatctttgcttaccccaacctccacatccgggttcaagtgattctcttgcctcagcctcccgtgtagctgggattacaccgtgtagctgggcgccaccacgcccagctaatttttgcattttcagtagagacagggtttcaccatcttggccaggctggtctcgaactcctgacctcaggtgatccgcccgccttggcctcccaaagtgctgggattacaggcatgagccaccacgcccagccaaccaacacacttagtaaccagattgtctttttgtctgggagtcatgatttctgttctgtcttctgtggtttttttatttgttttaattatgtgtaaagacagggtctttatatgttgcccaggctggttgcgaactcctgggctcaagtgatcctcctgccttggcctttcaaactgctgggattacaggcatgaaccactgcacccagctgatctcctgtctcttgagagttgatatctagctccacctcctggcactccctagtcccttccctgaccccaggggcttacagaacccactgttcctctttcaaggacaggaatgaaggatgctgatgttgagagaacctgggaggaaggcttgctctcatctttcccagcatggcttggtggggggccacagctggattgagctattttggaagaggcagacctggtggatcctaagtgccccactggtggtgcctgtgtgtctccgcaccgcagagagaagggccgtaaggagagagagtccctgcagcagatggccgaggtcacccgcgaagggttccgtctgaagaagatccttattgaggactggaagaaggcacgggaggagaagcaggtaaggaacccgcgggggctgccccagggtgatctgggccttgaggcctcatagtgtgggcttgcaaggctggggaggggtttgcccctgactgctgttctggggcaagtgactgcctttcggagctttgctttctcagttgtgtgctaggcgtttagtcattggctaagtataatagttcccgagggggaggctgtcagcttaggtgtttatcagggcctcgggcatcagactaaagcaggctggaagggcctctctgcctcctggggatgggagggttgcttctctgtaccccggatctgtggtgccattgcctgtaagatgggctgatgaccagatgactccccagttctgatgttagaaagataacgtcagccagtagcagctggattaattccatagggtgggtgctttggggtccctaggtgtgtgtctctccctgccttgcctgtgtactgggcaggaggctggaaaccgacctggatttgcctcaaggcattcattgctagtgggagggacagccagccagggctgctggacaaagggaaattcggggtagagacttcttgcccagttcctctccctctctgccttgggggcaggaggcaaggaaggcttcttggaggaggaggcctctatctcacatgaaatctgttgggtaatttggagttagccaggtagagtgttccaggctgaaggaacagcatgtttgaagaaccggaggcagaagagcgtttgggggtctgaatgttgtcagggcgactggatcctagtaagatagggatggggcaaatggggctggagaatcaggcaggggcctgattacctgggcccttgcgggctacattgaggcgtttgggcttctctccagagggctacagggaaccccagctcgggagagagacccagcttggtgtgtgttttggaacatctccctgctgccctgtggagtagaggcagggaggtagtagtcaatgaggaggaggcagaacagaggagagctggtctcttgccttctgcccacccagaaaaagctcattgagctacaggctgggaagaagtctctggaagaccaggtggagatgctgcggacagtgaaggaggaagctgagaagccagagagagaggccaaagagcagcaccagaagctgtgggaaggtatggcagaaatggccaaggactcaccttcagtcctgggtgggagcaggtctgggcctaggagtctcccgctcattatctgttgtcagtttcagcaggtttttgatcatgctgcccatcgccttgtgtgctttgaggttcgcttggattgtggcatatgtcaggagcctcctttttaaaaattgtttaaataatttgttttttgaaacagcgtctccctctgccacccgggctggagtacagtggcgtgatctcagctcactgcaacctctgcctcccaggttcaagcaattcttgtgcctcagcctcctgagtagctgagattacaggcacctgccaccacatttaactaattgttttgtatttttagtagagacggggtttcacaatgttggccaggctggtcctgaactcctgacctcaagtgatccacctgccttggccccccagagtgctgggattacaggcatgagccacctcgcccggccgcctacttccttttaacatcaatgtagattttgttatatgactttagcaggacttagttaatccagtgaccatttttcctatcaggtgtttggtatttgtcttcactaattgtaagagcttttttgtggctgggcatggtggctcacgcctgtaatcccagcagtttgggaggccgagacgggcagatcacctgaggtcaggagttcgagaccaccctggccaacatggtgaaacgccatctctactaaaagaaaaaattatggccgggcacagtggctcatgcctgtaatcccagcactttgggaggctgaggcaggcagatcacgaggtcaggagattgagaccatcttagccaacatggtgaaacccatctctactaaaaatacaaaaatcagctggacatggtggtgtgtgcctgtaatcccagctactcgggaggctaaggcaggagaattgcttgaaccaggaagttggaggttttcagtgagctgagattgcgcccctatattccagcctggcaacagagtgagactccgtctcaaaaaaaaaaaaaaaattagcctggcatggtggcatctgcctgtggtcccagctacttgggaggctgaggcaggagaatcgctggaacccgggagacagaggttgcagtgagctgagatctcgccactgcactccagcctgggtgacaaagcaatacttcatctaaaaaaaataataaagagctttttctatctggggtttggccctttgtctgcaactgaagatttttttttagtttatttatttttgagatggagtctcactctgtcgcctaggctgaagtgccaatggcccgatctctgctcactgcaacctctacctcctgggttcaagtgattctcctgcctaggcttcctgagtagctgggattacaggcacctgccaccacagccggctaatttttgtagttttagtagagacggggtttcaccgtgttggccaggctggtcttgaactcctgacctcaggtggcctgctttggcctcccaacgtgttgggattacaggcatgagccacggtgcccagctctgtctgcaactgaagatattatttcccttcttcatttgtttttggtgctagagcctggtgttttttggtaaggccacattgcatgtagaaagggaattcactgtctggctctgtctgcccctgaatctttgtcgtgttgcaagcttcctttcacttgggtctgggcaagctcaggcctgattttcctcaggatgtgttctcagtgtggagctgtggaatcagagggaagcgccatgttttgacccagattcccaaagggtggcggggctgagccagggctccgagggtagatggcctggattgggccccaggctacacctctcactggctaggtgattatgggcaggtcccttcacccacagaaaggtcagggacccctcaggccctcatctgtgagactcagaacagtgtcagccgggtctcctgggacatgcgggatgtcctggggtgacctaagactctctagaggaaataccagctgtttttattctgtttgtagaggaccaagctggagcttggtatacagtgggaactgaatcctggtatacagtaggaagttaatcattggagccgctgttgtggctgctttccgctctgcttaggttagagtagcgacagacaaaggagggacttttgggacagaggctcggtccccttctgtccggctggcccctcttcctgggagcagccctggggacccccaagatgcccccaggaccggtctccctccctgtatcctccccatctcccagcatccttggccatgaagtctcattcctgccagccctgccccgacatgcctctgccaggtcctaaacctaaagtctcagtggtcgctctcctctccccaaccccacctcccacctctgaccgtctgcgcactccatctgcgtctccccagaatctgcctctgctccgtgcttcttcctcagtccccagcctgggccagcccttgttatcacctggcttctgccctcgcccccacctctgtcccaacagtggcctgacagggctgccctctgccacctgggttcccacctccctgctccagccccaccagtggccctcctgcctctgcactccccaccttgtcccggtctcccccaacacaaccaggcttcaaccattcaccttgctcttcgtctgttctcccctggtaagggcagggacctttgtctcctccacagtcgtgtcctcagggtccagcatggggccaggcatatagtaggcgcttggtggcaaacgaccctgtggggtgcgggggctgatgggagccggtgggtgggcagggggtgacagaggtggcttctttacagagcagctggctgctgccaaggcccaacaggagcaggagctggcggctgatgccttcaaggagctggatgatgacatggacgggacgtgagtgtcccctagttggagctgcccacctttccgtgggcctgggtttccctccccgccaccctcgcctctagaaaccagccagatcctccttgggttcccccggcgtggggtccaggctgatcccaagccccgtgtgaccccgcctcttactcgtggatggccaggtccaggatgccctgggcgaggagatagggggaccaccctctccccaggagctgggcacagaccctcagcctcagggagtgtgtctaggcatctagtgatcggatggcttttcccagccccactacgctctggggaaagccagacctgggttcgaatcctggctgtgcctctgagcttgctgggttacctggtggagggtggacttttgggggctgagaggcacacggggagcctaggagatgtcaggtgccaaggagcagggggcttcagagggaccgaatgggcaagggtgggggtgggctttgctgggtgggggaccaaggcagatggcagcttcaatgtgccgggtcctggggtggaaggaggtgccacctgggtgagttggtagagaggtcatcggacatttgggggtccaggtatctcccagtcccaccccttactttgagctcctttggggtcatggagtcctgaggagggggcaggagggtggggaggcccctacaccttgaggtcctgaagcaagttccagggtggggccctgcagggaagaacaggtgggccacatggtgcccccaactgagagccactggggcctcacccctccagtctgcttctgccacgcccccgcagggtctcggtgactgagctgcagactcacccggagctggacacagatggggatggggcgttgtcagaagcggaagctcaggtacccccggctgccccttggttggggacttctagggagcattgccccagggtgacctcagggcacaggagggggaccaaggaaagctccttgctggcctgggatgcctcctctgggtgagctgggatggcagccactcagggccgcttcccgcctggcaggacccgggatggagccaggtcgcgctggagcccgtttccccgcacctgcccccactctacccgctgttgagcacccaatccccttcctcccccacccctgtcctgccctattcccctcctcccccacaccctcgtcccctgtctgtctcctttcctatcctcctccttccccgtggcccctggcttctggcctcccttctctgcccacccctgggtttctccctctccatctgcagcctgggccttggcctctcccttggagggcctggccctctctggtcctgggctctctcttcctccatctgtacgtccgtttgtccatctgcttctctctttctgtctcagtgcccccaaccactccagcccctggtctcctcctcccctcccacgggcctgtgctgccccctcctggccgcagtgcctcactggcgtggccctggcctggtcatcagggcccggggcccagccctcccgtgcctggcaccgcagcccgggtgccggggtggccgagatgggggacacgtggtggcctagatcttgacaccacccccaacacacacaggccctcctcagtggggacacacagacagacgccacctctttctacgaccgcgtctgggccgccatcagggacaagtaccggtccgaggtcagtggaggagaagggaggggacttggtcctcccaccacactgcccccaccccgcctcacaaaggagctgcctctggttctggcacctggccaccctggccagctgggtggccccagcaccccccaccgagaccccccgaccccagctgtcggtcctccctgcaggccccgcaggaggggcagagacaccgaggctgccccttgggctgtggtgtgagcctgagggtgtgggtggaccctgagtccacaacaccgaccgcaccgctcacccgccaggcactgcccaccgaccttccagcaccttctgcccctgacttgacggagcccaaggaggagcagccgccagtgccctcgtcgcccacagaggaggaggaggaggaggaggaggaagaagaggctgaagaagaggaggaggaggaggattccgaggtgcagggggagcagcccaaggtccgtgtttgggggagaagtggagacagagagggtgggggaagggctactcactgaccctgcccctgccccaggaggccccaccgccactgtcacccccgcagccggccagccctgctgaggaagacaaaatgccgccctacgacgagcagacgcaggccttcatcgatggtgagggtgggcgggggccaggctcctcgggtgggcccagcgtttcctgccgtggtggcacaggtcgagggaagatcctgagcttagaccctgctctgactcggccagcacaagccccagtatcttggggagtccaggaagggggcctagggtaagccagtcccaccctcgccagccccaaggggcccttctgcctccccaagggccgcagcttgtttgtgtcactcctggccccactcgctcaggagctgggagcctgggcagcaagtcggggctgctctatagctggtgaggccctcaaggctgtcggggtgaagtccttggccagagcaaaatgagggtatgggagcacacagccacatccatggaaccccgttccccatcctcctggatggggttgaggacatctctgacctccaacccctctcccagctgcccaggaggcccgcaacaagttcgaggaggccgagcggtcgctgaaggacatggaggagtccatcaggtagcgggggctgaggagcggggacacctgtcccacagcgactgctccttgactcccaggggagctggtgatggggaatcactgaggcaaccacaggctgggcctggtccctgcagggagggtccctgggaggtggcagggaggacagcctgggcaccattgctcagccagaccctcctgtgtctgtcgtcctgggtcaggcactggcgtccccagctgccccttaaccgctccgcctccccttccaggaacctggagcaagagatttcttttgactttggccccaacggggagtttgcttacctgtacagccagtgctacgagctcaccaccaacgagtgcgtcccaggaatgcaggggcccccactggcagggtgggaggcgggtggccccggaagtggcaccggcagtttcctgatggttggggaaccatctgcgggtggggcccgagagtgctgccttccatattgagggggagcagaagccaggggccaggtttagggttggtcattggagttggaggtaccctgtgtgtggggactggaggaggcggtggggggtggctgtgggaggaggctggaatccctgcgttccccaacccatatgtcccggtcctccacagatacgtctaccgcctctgccccttcaagcttgtctcgcagaaacccaaactcgggggctctcccaccagccttgggtgagtggcttgggctggccccttccctctgcctcctcctggtgccccgacaccggcccagccctcagcaccctgtgtctctcacagcacctggggctcatggattggccccgaccacgacaagttcagtgccatgaagtatgagcaaggcacgggctgctggcagggccccaaccgctccaccaccgtgagtgcctgcaaggcaggggagctggggcggggagacccaggcctggcccagccgaaccctctcgagcacccgtctgcccatccccaggtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctagctggatgggcgcagaggtgggcggggaggtggagtctcgtcggcctgccccagcaaggggaggcggcgggccctgaggaagatggacccacatggccactctatcaacctgtgtccccatgttccctgcttttttgttttgtttttttgaggtggagtctcactctttggcccaggctggagtgcagtgatgcgacctcagctgactgcaacctctacctcccgggttcaaacaattgtcttgtctcagcctcccaagtagctgggattacaggtgtgcaccaccatgcctggctaatttttagtagagatggggtttcaccatgttggcctggatggtctcgaactcctgacctcagatgatccacctgccttggcctcccaaagtgctgggattacaggcatgagccaccacacccggccatctcctgcctttttttttttggatggagtttcactcttgttgccgaggctggaatgtggaatgcaatggcgcgatctcggctcactgcaacctccacctcctgggtgcaagcaattctcctgcctcagcctcctgagtaattgggactacaggcgccgccaccacgcctggctaatttttttgtatttttagtagagatggggtttccctgtgttaaccaggttggtctcgatctcctgacctcgtgatccgccctcctcagcctcccaaagtgctgggattacaggcttgagctaccatgtctggccatcccctgctttttaaaaaaagatttttttacttttgaaactaaataggccaggcgtcgtggctcacatctgtaatcccagcactttgggaggctgaggtgggcggatcacttgaggtcaggaggttgagaccagcctgaccaacatggtgtaaaaccccatctctactaaaaatacaaaaaaattagctgggtgtggtggtaggtgcctgtagttccagctgctcaagaggctgaagcacaagaatcacttgaacccaggaggtagaggttggagtgagccaagatcatgctactgcactctccagcctgggctacagagtgagactctcaaaaaaaaaaaataataataataagagaaaatagacaaggtctccaggctggtcaactcctggcctcaaatgatcctcccacctcagcctcccaagcagccgggactacaggcaaacatcaccatgtccagctgtccccagctttctaatctggtctttctcttgccccagaacctcaagaaggcatgaagccagcccctgcagtgccgtccacccgcccctctgggcctgcctgtggctctgttgccctcctctgtggcggcaggacctttgtggggcttcgtgccctgctctggggcccaggcggggctggtccacattcccaggccccaacagccttcaaagatgggtaaaggagcttgccctccctgggccccccaccttggtgactcgccccaccacccccagccctgtccctgccacccctcctagtggggactagtgaatgacttgacctgtgacctcaatacaataaatgtgatcccccacccaaacttgtctgtgtctgcctcgctttgctggggtgtggaccggggtgtgggcaggggttgagcgcaggggacgcagctttctgcagatcccacccgggcctcccccaccatctggggatcactcctgaagataccaggtggatggaccctggaccatttctgtcttgagcatccatccgggcccgtgtcccaccttccctgggtctcatctgtgctctgtggaggccaagggttccctcccggggccaaagcccctgctgcagacagacccaggcccagagaaggacgggggcctgggcgctactacacaggctgctcctgcgtgctccccgcgcagcggtgcagagatcacccaaggccttaagattctgaacttttattttctggcatgaaaagtacaaataattaaacaattccatgtaaaagtctgttaccgcggccaggcctgtgatcccggtaataaatagtctaaacgcaacgcgaagtgttcttgttgggttttttttttttttttgtcttttgttttgtctttttttttttttttttttttacagttttttatcacctccaacatggactctgtcgtgatttgaaaccttccgaataaataacaggatgaagggaggggtggaggggctgagccccctcccccctggcctggcccctgccccccagggacgtggaagccccaagtccccctcgcctgggagccccggcctggccccctgcggggaggggctggcctccagggagggggcctggctgggctgagttttgtgttttagaaaaagaagtcccctcccagtcttgggggtggcaggggcctaggcctcggtggggggggggtgtgtggggaggtgccccctctctggagcctggccccccccagggtgggggacaaacccagcccttattgctcggacgccctgctgcaagcttcccacgcggacgtgcgtgttcccgaatgcagagggcggaggggagagagccccaagagacagcaggggagaggggtccctgccctgctgcaggggagaggagagagggcagggaggacttaaaaccacgagaataaataggttcgtgtatcaagaacaagctagggatttcaccagctaaataggactgaaaaaattctcaagacaagagcaaaaagaatcccattggtgacctggacgtcgctggccgtggggactgtcccgcagagcacacgcccccgcgtgccactcggctaccattactgttattaataattattattactttaatgattccacttccccttttataaataaattaggcataaccatgtctcggcaaaacttaaagaaacaaagagaacattgtcgttcctttaacttgcaaaccggatgaagtaacagaaatatacacggatgtccttacagggcaacgaggagaataaatagttaacatagcaataagttaaaactacaagaagctaaattcagcaaaaaagtacaagaaagttaactggtgccagtttatgtcttttttttttttccttttttttttttaaatctcttctgtgtgttttctttttttgttgcttttttttcctcttctgtttgtgtttttttgtcgcttttttgatttttttcttttttgttccttgcagcagaagctccacagacgtttaataacaacaccgggaggggtgggggagagagagctggacagtcagatgggggcgccatagccagacaccaaacgtggggacaccgggggaaggcaacttaactatagctaaagtcgggggttttgcaattctcagttccgatggggccgctgagtggggtggggagcggtgcgagggctcccaggggctccggcctgtggcttctgttggaattttttttttttaaagaaagaaaactagggcgatgcaatgtccagacagaagccgggggccggggctcgagatcgggggctgtgtccactgcaatctggaaagacgaaaaacccaacaaaccgaaagggga

SEQ ID NO: 15630 - DNA, 112705 bp, Human
  misc_feature (1)...(112705): n = A,T,C or G
aaacttaaagcatattttaaaaatattttgcatgtataaaattccataaaaaagctgagtagacacgtatatatgttttactttgaaagaacattttccattttagattttcaaattcctcagcccagaataagggaacatcagggaacatacaggaagtggtctcccagtcacaatgaccacatactgcaattgccttgctcttcagtctgggtttctgcttcttgttacagtcatttcagtgggcgtcactcagctgcattgtagttttcaggagcagttgttcaggggggatttggttcattgctggtgtgacatatgaatgacgatcacccaggaagttctgatgacgtggcttctctcaacaatgtttgctaagcttctttaaagcctctttggctcttagggaaggtgtgtttcaaaacctgtaacaggagtccccgcctagaatggctcttcagtgttactccttcctcccagcggaagcagcctttgttttttgttggtttttttttgttttttttgtctgtttgttttgttttttgagatagggtctcactctgtcacccatactggaatgcggtggtgtgatcacagctcactgtggcttggtcctcccatgctcaagagactctctttgcctcagcctcctgagtaactgggaccaaagacatgcactaccacacccagctgatttttttatttttagtagagatgagatcttctcttactgtgttgcccagtttgtctcgaacttcttggctcaagtgatcctcccaccttggcctcccaaagtgcaagtgaaagccactgcaactggccagaagcagcctttgatgttgggtctactgctgccctcagcattgaaagaagtttcaaccatccttttcacattttttttttttttctgagacagtctcactctgttgcctaggctagagtgcagtggtgtgatcttggctcactgtaacctccacttccctggttcaagtgattctcctgcctcctcctgccagagtggatgaatggttcttcttcttcttgaccatctaatcattgtccactcagactttaaaactctgcatcaacatcaccttccaggttcttccttctctccactatgcgatgcctggcattgaaaatttctgtatatgactttatcatggtgtgttatagttatttaatatagctggggttacaggtgtgtgccatcacgcccagctaatttttatatttttagtagagatcaggttttaccatgttggccaggctgatcttgaactgctgacctcaggtgatccgcctgcttccaccgcccaaagtcctgggattacagatgtgagccaccacgcctggccccttttcacatttttttatacatggataaataagatagagattagaattcttacatgctaggtgtattttccctctgatagttttacaaaatagtctaggtgtagaatgtgtggaacagacttcttttgtgttttctaatcctagggttcctgggtttctgagaatttgtttgtcttgaagattcctttaagccatatactccttgcatgcttgtctgtgcccctgccttccaggtactatgggtgtatgggggttccttctatcttgagttttcaattttattttttgaaagagaatacaaaataggttgggtcctatgccaccttgtcagtgatatggttgtgcatactgttgatatcagttaaaagggtgatcacaggagcatatatatatatatgttttttttttttttgcataaggccataagttaaacaaagaattcaaacaaagacagtaggtatatgagtgagaatgctttaattgaactggtatttgtacaaggtgacaccctgttgcataccacacacctcctccctgagtgactcagccgctgagcaagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtaagttgaattatacttgcaaacagaaatacatctgctgtatgtgcacagctttctctgtgttccttacaaatgattaaaattagaacttactgtattatctttgtcttttcttcctgtaaattttgacagcctccagctggctgttagctctgctcttccttgctgtacttttaggtcacattgcattgaacttcttggcaattttacacgttatgggcatcacagaaacgagcacctatttgattttctgggtgggagctgtcagctggtgaatcctgccacacaaaggataataaattctttaagtgaagggaccagcacctgctggtttattttctcaagcgactatacaaacattttttaaaggatctttctgttttcataaatgatgcttttagtgaaatagtgaactcaaatattgctttatagttaataagtcatatttatttttttctctactgctaaaaatattgcaagttgctgagctatgagagagagagaggtttatatttatgaggtttttgtctccaccctatcttccccaaataagaaaatcaccatttctcacttgaaagtaccaaggagtaaaggcagggtgtgggagcagaataagggtacatggttcctcacagggatctgtgggcatctggccaacttctctatggtatattctgcattctaacctaaggagtgattaatgtatatgggggcaattttcaaactttattcatagcctagtcctgaaaaaccagttttgggagacttttgataaggctagaagagttcttttaacagagctttcttttataattaatagctaagctgacttgtgttttttctcatcatttctatttatgatacagagctgtgggattcaaatgcaggggccactcacagcttgcaaattgcagctctgtgtcctccagagaggtgcccccacagcatacctggctctatctgtagtacttgagttctcatggcttcctattgctgacaaggtcacctgcagtctgagagggggttagacacaccagtgctcatttcccaaaggtttacagaagaattttacaacttggctttcaagtgtttatagtaaccagaaaactaaagtgtagcaagtgtggataattttatttttcataaaatgtgattacatttaaaactgtctttcacttccatagtttataacgtagataaagccttcctaatatatgtggtgctccagtgtttaaagtattggaaacatcaatttgagaaaactgagaaatgacaacagtaaaaattttagtaaaacattcagatgatcctaaatgtcgggatatgcatagaatgccaacaacaggccagaatttttattggaatgttagcgtcgtataaatcttagatctaattgacagaatatttcaactgaaacggagcataggcccatctagtctaatgcctgaattttctagttgagaaaatcaaagcataaatgttaagcaacttgtgaagatcagagtagcagaaccagaacacgatgccagattgcttgtcttttgtcttactgaattttctcaatattttttcaaatgctttttatcataaaatatgtagtagcaataaatgagccacactccatcacagactgtggttacccagcacatgtggaaatattatagtgtgtatggtatgactaagacataatagaatacgttttccaacttgtggcttatggaatcagtgttgccgtttattatatttatgagattttcatctcaggagccagtagcccctcagcagggaggggatctgatgtatgtgtgttagctgtggtctgtacaatcagaacacccttgcctcgaatgccattctgtaggtgatgcttacctgactgccttctcagactaccagaattatgatgaaatacctgagaggttcatattcctggggactatgtaaacaaaacaaattttgaatgactgagctcatactgtggaatgaactgaacacaattcacgaagccgtcaaattaagcaaacattgtttaactgagagtatcttatacggttcaggcatcaactcccagcatttcttaagagtgaggggataaaatctttggccttgcagtccaagggaaatctttattggttccatatggcttcgctttctgtcattgtcctgcttctagaccatttgttgatcattttccattttctttggctgggtactttgaaataaagattttaggtattaattgctgcatacatagctggagttgttcaaagctcacttctgaatcaaaagtcttttttttttttttttttttaaatggagtctcgctcttttccccagtctggagtgcgatggcacaatctcgggttactgcagcctccgcctcccatgttccagcgattctcctgcctcagcttcctgagtagctgggagtacacgtgtgcaccaccacacccgactaatttttctatttttagtatagacggggtttcaccatgttggccaggctggtcttgaactcctgacctcaagtgatgtacccgccttggtctcccaaagtgctgggattacaggcatagccaatgcgcccggccttaatcaaaagtctttatcagttatattccttaagtgtttccagcttaccattgtacaaatggtaaactgtgatttttttccatgaactggtgattttgaagctcgggagaagctcttcctcacatggatgctttgccaaatgacagctacacgtactagactttcatttcatgtcgattactaaattttttaaggacatgagtcatccttttattgtgatacttaattggaacagtgaattttatagctacctattcaatgacaactggtttacttctagatacaagaactgatcatcctgaatcctccttgtaatagtatacttgatagctctaaaaatctgaataatttattctttgtctgtagacccaagtttccctgactctaaaatgtgattacgtatccttcatatgaagcctcctggggaaagacagtgaactataagccatattttccaaactgagatatatacatcccaggagactgtgtcaatgttctagaaaatgcaataaaattatgaaataagcatggcacatgtctgtatggagagctaattttagttaaaaagctttggagaaaactatccctattgccctgccctctccccagttctccccagggttccctcttttgtcattagagatgctgtgtgtaaaagtttaaaagaaatttatatacaaatgcatgcagtgagctgaaatctagatagacttgaatttgaaccatgattccatgtggacaaacggtgacatgtatgagtatgcctaactcacagcaccagcagataaaaagaaaaattaggattcttgatgaataattaatagacatataaaattatgtaattatatattatatacatattttataatatacatagcatattacataatgggacatatatgtataaaatatgactcacaatagcacaaaaatataaaaatctagaaaaaatctctacaagaaaaatttaaaatctagatttaaaaaataacaacattttatagtaagacataaaggtgaaagcggaccttaaatgtcagttcttcccaaactctttttatagaatctatgcaattttagtcaaaagttccaatagaatatttatcttggaaacttagaaaataattttttttttttttgagacagagtctcgctctttcacccaggctggactgcagtggctctatctcggctcactgcaagctccgcctcccgggttcacatcattctgcctcagcctcccgaatagctgggactacaggcgcccaccaccacgcccagctgattttttgtatttttagtagagatgaggtttcaccgtgttagccaggatggtctcgatctcctgatcacgtggtctgcccgcctctgcctcccaaagtgctgggattacaggcgtgagccactgcgcctggctgaaacttagacaataattttaaagttatctgaaagaaaggaataaatgagaatagctgatagaatttctaaaaaggaagttaatgaagggtgctgtgctactagatattaaaaatgtatgtatcagaaaaacacaataataaaagtagcttgtttttattgtaagaaactaaagacagttttcttgaggaaaacggatagccacaaagcacatttaagaatatgtaagaatttaaagtgtgacaaaggacgtatcatatatcaacgagaaagggatttattctcccattaccaaagtaaatccacatggattagagagattacataaaacaacaaaatatattgtaaaaattaaaagaaaaataaatatttagttaacctcatgtttgttcaacaaatattcctctagaactgattatgtaccaggtactgtgataagttttgaaaatcagctgtggagaagatgggcttggccactgctcttaagatgtacaatgtgtgaatgtgtgcgggtgtgagtatgtgtgtatacgtgtgggttgggggtgggggaagattattcagccatacacacagtcttaggtgatgttatggaaactctttgctatttgaacacatagtagggctcataactcagcctggggaggaaggagtggggcaagtggcgatggtatcacagagtgattcctggaggatatagaatgtgtgatctggaaggtgaatggaagtctttcctgaaggaaaatgaggggttgagggaagttcaggaagaagagtgtttcaggcatagatagaataagcaatagctcacaggtgatgaaaaggatggagccccaggcactggaaggagttgctgtggctgaagccagagtgtgagtgggaagtggggagttgggggaaatgaggctggagggtatggccttgtcagccttgttatcagttcgattttatcctgacagaaagggaacacccttgaacgactttaagtaggtgatgactactttggcaccagtgaggaggagagtggattaagtgaggaagtctggagattgagaatgtagctgggaagccgttggaatagtcaggagattatggtagtttgaattggtgtcttgcaaatagaaagatacacaagagatgttgaattataggacttgacgattgcttggatttcaaggtcagaaagaagattgatggatggtctacaaagatggcttttaaagagtgaaagtggaagaaattataaagggaaaaatagggaatgcaaaatcaaaagcttctgatacaaaatttataattagaagctaaatgaaaaactagtaaagatgaatgttcctgacatataaagaaaatgagaaatcagtaagaaatatataataattgtcaatggataatttataaaataagaaagaaaatgccctgtaaagtgaagaaaaatatgcgagtaaaacaaaatgattctactttcacctattatattattaaaaagattaatgaatgataattctaaatgctggcaaatgagtgaacactcatatgttgctggtggatgataaactactataagatttacggaaagaaactcgacaatagggatcaagaatattttagaaattatacatcttggcaagtaatttcacttctcggattcattcaaagaaaataatcagatacttggtgaaagacttttgtatggttttttagaaacaacagaggaatgatgttacattgataaataaaatgagatattttgtagctgcaaaataaatatttaaatattcttaaatggcattggaaaatgcatatcagtaggctctaaatgggcaaagaaaaaccctggaagaaaattacagtgattgattaaaggtgtctgatttttttttcctttctttatgctttcttgtattttccacattttatatatgctttcttgtatttccacatatgttctaaatatagtgagaaagatttatgttgtgtaaaattgggatacagaacagctacatgacagagcttttgtgaatatgaaatacagtaaagtatttaagataactaacagggttttggctcatagtctgtggtcaaaatttgagtttttactcatttaacttgtattttcagctagaactgaaaatagcccctgatggggctcaggtgatagataacttttattggatagcttttttattaatgaatattagaccagtgttttttgtaaaatgaaataattataggccactattcatgttaaagcttgctgttatcattctgcagaaaagatgggctgtaagaaaaagagctggtgagggttgtgtattaaaaaccagaatcaggccgaggcaggcggatcacgaggtcaggagttagagaccagcctgaccaacatggtgaaaccccgtctctactaaaaatacaaaaattagagaggcatggtggtgcgtgcctgtaatcccagctactcaggaggctgaggcaggagaatagcttgaacccgggaggtggaggttgcagtggccgagatcacgccattgcactccagcctgggctacagagcaagattccgtctcaacaaacaaacaaacaaacaaaccccagaatcaacagtgagaaaattgtatggtaggggctttcatttgtgctacattctggactcttgtttcaccagcagtaaacaagtttcccaatgctaagcttagattgtgaggttgtgtgactgaagaaatagctgctttctaaccatcacagaaggctaaatgaatctttcccagcctgatgatttttggatttccttttaggctgtgtattcaggctaaacacagttgtttgtttctgagagactatttaaaaatggatttaaatagacttgttaatatttacacttcatgaagtactgtttgttttccccttacatatatttcttgtacttttaggtggtaattagttgtttgatggtttgttttatttatcttccaaaagataattcttctgtttattgatctgtaattatagagcccctcttattcttctactgaaaatggttttatggcatttgtccttttccagttcctagggattttccctgtttcattgatttccgggaaacaagtagtggtggggttggcactgttaccgcaccctgaaaccctcaggactttttcagaagcaaaagtgaataccaccagggcaatttgccaccctgtgtcattttctagaccccttttctgtatttgtttatttattctactttagctttttttttttttttttttgagacggagtctcgctctgttgcccaggctggagtgcagtggcgggatctcggctcactgcaagctccgcctcccgggttcacgccattctcctgcctcagcctcccaagtagctgggactacaggcgcccaccaccacgcccggctaattttttgtatttttagtagagacggggtttcaccgttttagccgggatggtctcgatctcctgacctcgtgatccgcccgcctcggcctcccaaagtgctgggactacaggcgtgagccaccgcgcccggccaactttagcttttttatattctccatcactaaagagatttgccctgggcaactattgacatttggtcttttataaagatagtaatttataaaaatatattagaagcttgataaattgattgaaagattttggggtagttaaaatatccaaatgtcactctatgtaaatctcatgatactttggtaaaatgatcaaagaaagtctgctccaattcttctctgttgagctccaccatggatctccattgttgccatctttatgtccatgagtacccaatgtttagttcccacttataaggggaaacacttggtatttggttttctgtttctgcattaattcgcttaggataatgacctccagctgcatccatgttgctgcaaagaacatgatttcgttctttttttatttaccactttttagtcgagtaaatttcttcctgttgactcctttttgtttcccgggcttctgagataggtactgtgcgtcaggctgatttgagtttgaatcccaactgggcgattcactagttatgtaacctcaggcaaactactcatcttgagactccttccagaaaagaaatctgcctacatttcgaccactgcccacatttccaactcctgccctatccttccgcaagaagactctgacttcactgaaaccattcatcattaagtttcattaaagaacaagtataataatagtaacaacctaaaggcatgtaaggcttaaatgagacaacacctataaaatataagctcaaaatagttattattattgtaggaccccaaatctcagcagtcagaattgaagtccttgtttttttctcttttcttccatcatcctttattgtgttaatttactttctgctgcacatctttttttcttttctgccttatttctccttttctctttcctctatgagcccttctttaaccaattttagtttctttgttcacacaatctttcttaagagaaagttagcagggagtggtaaagacttcgtgaggtaagccaagaggcattatgtccttgggtgggaagggaagagtgagatttttaaagtctttatgctgagaggacccaaaagatgatgaagattctagctgagctgggaactggcccaggaaattcttggcactgggacaggaagagctggggctgagatcaggctgggggactgaagtgaaagttggctcagggaattcttggcattgggacaagaggagctggggctcagattgggctggtgggaggagtggcaattgggtcacctaatggacctaaatgctcccagaggaagtgctgttattagagatagaaaatactgaaggaaattgagtaagggcatggggagatgaggagaagctgaaaagaagacaaaagtaagaaataggagatgctgatagtttcaaatgcatacaaaaagagctacgaaagttgattgatttcatgattcagaactttagcagagtgatttcatgtaaaacctaaagacaaatgtccttgggcagaagcagtaggcagcagataaaaactagctctttctggtgtttggccacaaagaggaaatgaaagatgggccaataattgaaaatattttttccctctctcctcagactttgacgttatgattttacatcataattttcaacacatgcattcagtgcttcataggtaaaggtttttctacttcccagcataagagagacagcgttcacacatcttttgtcataatattacacttctaaaacacagttgctggtgtctgtaatcagtaggcatatgtactggcaacagccttttgaaaagccaagattagagtttcatcttttttgtgagaagctaaaaacttaattggaatgaaactgaaacgtggcacttagaaataaatccagttagctgaactgaggctaccaaagtgtcaatatgtgggtgttgagtagatttgaagctcaggataacctcagtacctgaaataagtaattcctttaaagaattacaaaacaataaaatttggctgcattttttttaatactaccagtttgagagactagtaatccctaatccattccacaaaagggcatttttaacaaggatattattcacagaaacatatattgttgaactatttctaaaaagaaatatccatgtatatataaagtactgttttatatcctggggaagatggaaagaacactactgcagtaaaatgtctgcggaagtagaggtcgatgagacaggaatgtttacaccttagaggctttacatggaagcttctagaaatggctctggggccacccaaagagggggcatgaggagatgatttgggtgacatggacaatgggtcctaagagaagaagagagcagcgaggctggaagaggttgtgtgaaagatgtaggagagatgccaaaagggaaagaaagactcaagagcagactttctctggcttgggccatctggcaggggccttcactgatttggcagcttgcatctttgataagaaaaatttaatttcccacagtattactcatttatatttcagaagaaaaacccagcatccttatgaaactattatcacctgtaaatagaatacattatagtttcctttctcagttagcttgatcaatggccagcactggactacgagagaaaatgaaacgttatcaagctatccagtatgagatagattcagggaaggagtccagtcaggaaccatgtcaggccacttcaggccacttctggctgcagtgtgttcattggggagtgagttttgaggctgagctatcaggaaatgttggggcagccattcattcctgctgctcctctcacctgctctcccatgatcatcaatcatctgggactccaggcatttctctgagtgcctggtatgggtcatatcacatggcactttgagttacatgtagtatcacttactgaaaagagctctggtgttgcagtcacacagacctaactgcagtttctgattcttcctctaactgtgtactttgggcaggttatttaagctctctgaggtttgggatcccataattatagataatagtactggcctggaaggattaaataagataatgtgcataaaacatgtggtacagccggtggtacttggtaggggcttaacaagtgatccttcttgctaggaacatttaacacatatgttttgttgataaaagaatcacacatatcttttgtagactcctgtcaacttttggaccttctatttgctgcacgatggcttagtgacatggaggaagagcataaggcttgagtaacaacaacaacaaaaaaaaaaaaaggaaaagaaatctcttaaacaaacgaggcggtttatttttctcttggaaggagaagttcagaggtagataatacagggctattgtggcaactccatgacactgtcaaggaaccgggtcccttctaacttcctgctctgctatttttcgtgtgtgaatttagtccctatgattgcccacagtcactaaggtccaagaggactgctcctccctcctgcaagccaccttagtttcagaaaagagtgggggagcacaaaaggacatattcttcccagggacttccacttcaattgtaatagtcagaactacaaatgtgtcactgctagcttcagagagcctgagaaatgtggctttagatatcagtaagaaagaaggggagaatggatatcagatatgcaatcattgtctgccatgagtccctacttggaaatctccagatcatcatgactggacctttccttattgtcctctcccattggaacataccacacccagccccccaaaaatttaagataaatcttaaacattttaaaaaatgtgagtaacatttgtaatttaaaagagagaggcgtggcattccggaggaattcttaaagtaaaatttagatttaccctgaaatctatagtgatgattactaactgctttaagaatgaaaattctttttttaaaataaaaaaattcatgatgtttcacatatgagactaattatattttcagtaatttactggttgacaaaaaggtatgatggatttggtataaaaatgctttgatgctgagtgcagaaggatttgcaagcagaccctatgcaattaactcagtgccactgccctccatccctcactctctcatcctctgcccatctggaagtttgcacccagggttaggtaccatgctgggatggctgaggtcttgatcaactctcagatcatcagaaattcctgcaaagagctctgtagaggaaaacaggtatctcttcatcattttatatttagggatagctccaatcagacccaacattctgccatagggtctgatattttcatgcctttgttagctaggtattctccagaaggcctggttaaatgagaacaagtgaaataagacatttgaacaagctcatggaacttaccctctttctctctgttaatgactagcctcaggtatcctataaacacccccactggcttcatcccagaacctctgggatgctccctaggaacagtttccagtaaacccactttctttccctgggacttcccagttgcctcttccttagtatatagctctctggccaaaaccccagatggttgctgtgttttaaattttctttggtattctacccatatcccacctcagtcctcctctgacctaggcttctgctgcccctttagggtctgctaggaagggaggaaagttcaaacaataataatactttatatgattttataggaatttataatttacaaagcattatctcatttaatttccataacaaccttttaagattgctataacttcctctttgcagaggcagaagcagagacttagtccaagtagctaatgagtgacgaagctggggacacacacaatctggggctttttagcccaagggctgtcaatcatttttctgcctatgccactgctaacacattaagatgtcacctgttcaggcatattttacttcagattggctagtagagagaaagatcctgaggcaaggagggtcagatggtttttgacagtttgagggacatggaaagttctggagcataaagggaagctaaggataagatctaatggggaaaagaagggtgttgacattaagatgggcaggaagtctgtataaacatcagcgtgcatctttaactctctgatatggtttgtctctgtgtccccaaccaaatctcaccttgagttgtaagaattcccacgtgtcgtgggagggacctggtgggaggtaatttaatcatggaggcacggtttttttccatactgttctcaagatagtgaataaatctcatgggatctgatggctttatgaagggcagttcccctgcacatgctctcttgtctgccctcatgtaagatgtgactttgcttgtcatttgccttctgccatcattgtgaggtctccccagacatgtggaactgtgatccaattaaacctctttcctttataaattacccagtcttgggtatgtctttatgagcagggtgtatagttccattgtgcatatatacccttttttctttatccatttgtctgttgatggacacttaggttgattcaatatctttgttattgtgaatagtgctgcaataaacatgtgatgcaggtatccctttaatatactgatttcttttccttgggatagatacctagcaatggaattaccagatcatatggtagttctacttttagttttttgagaaatgttcatactcttttccatagaggttgtactaatttatattcccaccaacagtgtatgagagttctcttttctctgcatcctcaccagcatctgtcatttttgtcttcttaataatagtcattctaactgaagtaagatggtatctcatttggttttgacttgcatttctttgatgattagtggtgttgagcattttacctgttagccatttgtatgtctttatatataatatatattttaaaatagcaggtgctcaattgaaataacagagaacacactacccaatggttacatgttttggtaacgtggtagaatatcacattctcttattgtcacataatctgctataccccattgttagttcacatagacattctcttgcctgtgattgactttatccttgcaactctcattctgctttcctgtacaatagtgtgactcttttcaaaccacaaatgggaactaggatccgatcagaagacagaaagttttaaactaggatgttcctgagtatgtgtgtttatattatttacgtggcttctgtttgtgagttccacagaagcctaggcctgcttgtctttattgtataagtttaacagctgcttgcatagttcagggtcagagagcatattttcaggccacaattatgaatgatccacgggtcactcaagacaccagtttaacatttaggagttgatacagatgcataccagggagagctcaattgttagcagtgtgtggaggtgcccatgaggatgggactgggataatcttgtgaaatataatctgattccattttattctggcaaaaccgcacgggccatataagagtgtcttttctgcctctccagctcaaagatggcctggcctgctgccagttttttttttttttttagttgagatataatttacatgccataaaattcaccattttaaagtgtaaaattcagtgctttttaaaaaatatattcacagctgggtgtggtggctcacatctgtaatcccagtacttcgggaggctgaggcaggtggatggcttgaggccaggagtttgagaacagcctggccaacatggcaaaactgcgtgtctactaaaaataaaaaaattagccagatgtggtggcacacacctgtagtccaagctactcaggaggctgaggcacgagaattacttgaacccaggaggcagaggttgcagtgcggcaagatcatgcaacagcactacagactgggtgacagaatgagactttgtctaaaatatatatatatatatatatatatattatatatatatatctccaaggttgtgcaaccatcaccactatctgattccggagtattttaattttaccccaaaaagaaaccccattccctttagcagtcactcttcattcacctctccccttaacccctggaaaacactaatccactttcttttctatggatgtgactgttctgtacatttcatatcaatggaatcatacaatgtgtcctcttccgtgtctggcttctttcatttaacttaatgtttcaagtttcatccacattgtaagatgaatcagtattttcattcctttttatgctgagtaatattctgttgcacagagatgccatgctgtgtatccattcatccactgatggacattggggttgtttctactttttggctgttatgtgctaccatgaccattcatgtataagtttttgtgtggacatgtttttaaccaaaggaatgttggggaatacacagagaaggctgtcctgtgaaggtttgtttgctgcagcagttcattgagaggctgccctggtaccaagcacttgaccagagctcatgggacttccaaggagtgagatgctcagggccaggcaaacccctgcatccacgttcccactctcgctttaacaccagggcagcagcctagtcttgcagtgactcctgatgggcattagtgctgtttgctgaggagggcgtggcttggtttagaagcccgatgcagcctcttaacaccttggacatgttgcatcctctctctgagctccggtagtctcatctgggagttggagggaccaacagccaccccacagagtttatgtgaaaaatgagagacaatgcctgagaggtcccctgttcagggcgggggctcaaccagtggatctttattctattagcaattgccctgtgcaatagaccattcaaagagggcacagatcaagggcagtgtagaccaaagctctttgaatgacttgcctattttataactcttcaaattacttttttcataaggactccatagtttgctcaggctgttataacaaaataccacagacgggtgacttaaataacagaaaatcattgtctcacagttgtgggggctgggcagatttggattactcctgaggcctctctccttggcctgcagatggccaccttcttactgtgtcctcacatggcctttcctctggtgtctctttgtgtttcgaaattttctcttcttacaaggtcaccagtcaggttgaattagtacccaccctaagggcctcgtttttttgtttgtttgtttgtttgttttattattattatactttaagttttagggtacatgtgcacaatgtgcaggttagttacatatgtatacatgtgccatgctggtgtgctgcacccattaactcatcatttagctttagatatatctcctaaagctatccctcccccctccccccaccccacaacagtccccagagtgtgatgttccccttcctgtgtccatgtgttctcattgttcaattcccatctatgagtgagaatatgcggtgtttggttttttgttcttacgatagtttactgagaatgatgatttccaatttcatccatgtccctacaaaggacatgaactcatcattttttatggctgcatagtattccatggtgtatatgtgccatattttcttaatccagtctatcattgttggacatttgggttggctccaagtctttgttattgtgaacagtgccgccataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccaggacctgttgtttcctgactttttaatgattgccattctaactggtgtgagatggtatctcattgtggttttgatttgcatttctctgatggccagtgatagtgagcattttttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgtgaaaattttctcccattctgtaggttccctgttcactctgatggtagtttcttttgctgtgcagaagctgtttagtttaattagatcccatttgtcaattttggcttttgttgccattgcttttggtgttttagacatgaagtccttgcccatgcctatgtcctgaatggtaatgcctaggttttcttctagggtttttatggttttgggtgtaatgttttgggtgtaatgattaagtctttaatccatcttgaattaatttttgtataaggtgtaaggaagggatccagtttcagctttctacatatggctagccagttttcccagcaccatttattaaatagggaatcctttcgccattgcttgtttttctcaggtttgtcaaagatcagatagttgtagatatgtggtgtcaagaacagaacaagagcctcgttttaacttaatcacctctttaaaggccctgtctccaaatatagtcacctgctgagatactagcggtggaaacttcaacatacgaattttggaggaacgtgacttggccaataacaagcacccagggagcacctactctctcccagatgctgggaatagaaagaaaagatttaggcctttcccactggaaacagtctcttgggaggtacagaaaaataagcagataattgtaaaatactctttctccatataccctgtcttttgtctcacaattgcatttactgtctctgcagatgtgtcattaattatgcattcagcattttgaccacctgagaattccagtgcaatcagctgagaactctccaggtctttatcggctaagagaaaaaaaaatatatcagagcccatttagaaacaggaaagaggctagccaaaagtcctgagacacactaccagacagaggcaaaatagtcactagttgagctttaagtttgcctttaggtatttctttaccttcattttgccagagtttatctatgcagcctccaaacacagccagccaggggatccctgacactcccggtgtgctcagctgcccaagttcaagtctgtcccatcccttcccacatccaaccatacgtctcctatgtctttgctctctgcttgtcaaggtgatagagtatggagttaaaacttactgagcacctactgtgtgctgggcaataattagacactttacatatgttatctagtaatatttgaacctcataatgttcctatttcacctcatgatacaaataagagacctgagctaataacatacctaaggtgacacagtcagtaaacagcatcacttagatgcagttctttctaactccactaagatcttcagactcttggttattcatgcagcaaacagctgcgggtccctgtgaaggtaatggtcatgatgaatacattggttcttaatccacatcttaggtcaggtttcccagaagccgtttctgagaggcatttgggtgcttgtggcttattgaggctgtgctttcaggagaagggagtgaggcagggggaggccagcgaaggaagtgagcaaggatgtgctctctgctggttgaactacagccggatcccagctctgaagtgcgagtcactggatagaagtgattctatcttgaggcaagggactgaccttttttatcccgagtcagtcagcaggttgtagtgagtggggaggttgtgaaaccagtcaggcctaacagcgaagggcaaatcctcaaggaaggtgcagtcatgagcctgtagctgccaagcttcagactggtgaggggaacctgatctggacacttacagcctccacctctgatcttctgcagtgctactgacattccagaaacagaccccaaggaaaataatacgttgacccaaagcagtgtgtctttcctacttcaggtcctatggcaagttgttgcaggaaatactttcacattagaggataggaggtgggggcttttagaaccccaaattatagctatagacagctgtccaataatactgccttaagtccaatagcattgatagtttaacaaagtagttttttatgtacattattcatttgatcatcgcagcaacttaggaagtagatggcaggtttcaatagcctcattttgcagggaggttaagtggttcattctcagacgttgaacgtgataaagatggacctaaaacttgcttctgacttgagcttgaatgcccctcctatggtccatactacacagtctgggtgagatggacactggaaaggacataataccccacctagggtgaccagccatccaggtttgtccaggacttttctggtttgaaaactgaaagtcccactttcaggaagacccagagctaactaaggcacacaaaggcccccaatatatttatgatccacaaaagcattctaattttaatttctttcaatcacaagaaaaatattgatataataataataataatgaagccagccaggattatattcatactaacatagtcataagatacaattttaaatttgtgtgtgtgtgtatgtctgtgtgaataagaagggaccctgaaggcaaaagcgcctaggacccataaagtcataattcagttctggggaactggatcagtcctgggcagactggtgctgtgggttaccttaaccccttaacaccagaagagtagttcaggaactttgagttttccatgtggcggttgcctaaaatcaccagtgtttctccaagtctgtgatttccatatgcctggctgctttccttctaattacacagcagtttcctgagtttgctttggcttttttcaggaagcagctgaggagcccttctttgggcgttcacagtgtgctgtgggttcagcacaatctctctctctccctcttgactatgcccagacacttgtctaactcatttttctgtccccagcaccaggctcagtgccaggcagactgtaagcattccatgcgtaattattgattgaataaatgaattcactgatggcctgattctaccgattgcttatgatacaacactggaatcacaaaactccctgtgcctcattttctccatctgtaaaacaaatatgttggaagagatgaactcttgggttcttaggggcactttatgtcatgcatttgttatgacagatcctgtgactatgtcactgtcattgaaaagtgaatctcagtcatgaaacagtcacttacaggttctcagagtcattgatgtgctttctctatttcccatttttcttttaggtccttactggaaggcagcatgtccaatgttaccttgagaaaaatgtctcccacaggaaatggtaatgtacatgatgtttctctcactcagaaaactttaaaattttggaaaaacaactcacagatctcaattctttaatacagatattgaatgcttagaaacaacagtctaatttaattagcattgcaaagttaggcttaagaaaaagtatacttgccgcagcttttagtcatgtaattggaattcaatttttttaaaattaataaaaatatctttttaaaaatatgaccttctttgtgtttggctcttacaggataaaagaattaagttacttagaatcaaatgaccaggacttattgactattactatgtattataaaaacagtcttttgtgggcttccagggtatatttcttatggggtaaaaaggccaacccactaaatcctggctcagtttatcccaggctgggagttctcctttcccaggaactggatggggcctcatgagtggcactggcagtttcagttggcacctgagcaactttatgtgttatctttggtgatggggtgtgggatctgttctttcttgctggtgcatcctactttgaaacagtactggacttgccagcccagattgatgctggccaatcagatgtgcctctcaggattttcaggttaacaagcccacgctcaactccacactattacatcttccagtctttcatgtttctgttgatagagatgaagagcaccactcagggaaccacacggaagcagcaggattttcacgaggtgaacaaaagaagaactttcttacaggataacagttggataaagaaacgccctgaagaagaaaagtaagctggtgtggagcgtggtgggtggacagaagggcagagagaggcattatctgtttgggaagctaatgctcatctgaaaagtgaatacttttctcctgaaacactttgttgcatggtctaatttttggtgagacttagtaagcacaaataggttacatatcagagtttcaagaatatttctgccattttaaatatccacatgcataagagagtgtgagtcattactgagagagagcctggttattacctaggatagatgtttgtgcttacttggtaaactgaaaagaaaacatgactttccagtttccaaaaaggtaacagttaatccatgatcggacaatcctgctctgttgatcatgtcagctgaaataaacaaaaagagtgtaattccaaatttaacatataaaattttggtatgtacaagagaaatttaaaaaattaccgacttattttagttccatctacttctaagtactgggaaggtgggatatatggtattactttgtaagtacttacaaccaacaaaattttgtttgttttgagcattgcttctactagctgagaggtttaaagatttgaaaactatggccataggcatatagcctcattggcaatatagatttgcaataggtatttgtccagcaataggtatttgtccgattatatattatgttatgtgtatattataaattatgtagacattttatgatttctttgttattaagcttggtgttagatactttacatataaagcaccactaattttacaataaaacacaacgtaggtgttatatctcctcattttacaaaagagggatctgagctcagagaagctaagtaacttgtctaatggcacatagctatttagtggtagagttgagattttaacatggcccattgtttttccattacacgaatgtttctcaaccaggggcaattttacctccagcagacatttggcaaggttgggagacatttttgttgttaaaattgaggagtgcttctggtatttaatgcgtagagaacagggatgctggtaaacatcctataaatcacgggacagctcccatacaaaaaattatcaaacccaaagtgtcaatagtcctgcagttgggaaatcctgcattataggatacttactctaaactatctacaaactctgcagatatggttatttgaggggcattcttgtgaatgttaaatttaaaatatctattaatttctgttattgagtattatttcaaggaaatatatgggtgtttagagatttagagactcacactaacttttggagttagcgctattggacaacaatcatttccttccatgaaacagcatttattgcttctgtcaaagcatttccaattttctgtagtgatagtgtcatgtgacatgtagaccatacattttggattgccaatatttacacagacgagtgacgatagaatgtataagacaaatcacagttgggaggaatgttgcttttatgccaggcatgctttcccaggaaaacccagggaagccagcttggatggcataggagctactgaatgaagggaaaattggctttgatgcttccctgattcccccagcccagttctgggctgtgtgttataattccgcctcagataaaaacatgtctggtatctgctcctctttcaaaaatttcattaagagatatggaggaagataggaaagttctctcggggtctttgagaatgtatatttgctggcattgtttcatttttactgtttatgtttctgtttaattgtctactacagttcttttatagcttcattaaaaatggtaccggaggccgggcgtggtggatcactcctgttatcccagcactttgggaggccgaggcgagcaagtcacttggggtcaggagtttgagaccagcctggccaacaggaagaaaccctgtctctactttaaaaatacaaaaattagccgggcgtgttggcgggcacctataatcccagctactcaggaggctgagacaggagaattgcttgaaccgaggaggcagaggttgcagtgagccgagatatcgcaccactgcactccagcctgggcgacagagcaagactctgtcttacaaaaaaaaaaaaaaaaaaaaaggtaccagagtgttaagtaatgttagtagagcataaccaggaaaaatgtggtatttcaggttttgttgggttgacatgaaataggttcagttactttctgccttggctcaaatccaaagacttcactacgtgttttgacatttcctgaaagggcctgtactttcagttccactgtacaaagtaagaatgatattactttgagattttacatatgaaggtcgattgtagggttgaccagtaggaaaagcaatgatttggaatgaaaatatctgggtcctagacccacctctgttacttgctaaccttgtggtcttaggaaagccacaaaatcccctatcagttttctcatctgtgaactggatatgacagtgtcttcgctgcctaattcataggattattttaacaactaactagagcaaactgtattctcatggttcaaaagtaggctaggtctcctgtgaattataaatctccttaaccacaaatattggtactgagtttcccacattttatgaaggagaactgtcaagtccaccaacatacccagacgtaatgggcttacttaaacttaaacacaatttgtggaaagcttttgtatttgacttcatgccaaaaaggactcttctaatacatataaagtaaatgggctcatattcccacagtctgataaaacacaacacaacacaacacaacacaacacaacacaacactcattcattgttgaatcatgtggaaacctcatgggataaatgatcatttgtactgacaaacttgtttcttttctcatgctctttcaagtggtgactggttaaaatagatacataattttgtgttctcacaactgaagtaaaatgaattaaccttgccaaaaattgggagctcgcccgcatgtctctctcatttagtgcttggtcaacattgtggtaactttctatgtgacatacttttgttctttctttgcagagatgaaaattacggtagggtggtgctcaaccgacataattcccatgatgcattggacaggtgggtgtttagacatgttacatcatgagcagaaacacaaagatggtagttttcagagaagacttgttcaagacagctgaatatttgcagcatgccttgggctttccccgatgttctgggcatgtgaaggagaatctgtgatatcatcagaggtttccacaaggaaactctgcctctccagaaccatgacttggaggcagaacataaccaaccctctgtgcatcccactgaggtgatcctcctgacaggcagggaaaggactctcatagaaacacgatcatatcaggccgggtgccatggctcatacctgtaatcccaacactttgggaggccaagttgggaggatctcttgagcctaggagttagagaccagcctgggcaacatggccagaccctgcctctaaaaaaaaaaaaaaaaaaaattaattagctaggtgtgatggtgcgcacctgtcgtcccagctactccaggggctgaggtggaagaattgcctgaccttgggacattgaggctggagtgggcagtgatgctccattgtactccagcctgggtgacggaagaagaccctgtttctcaaacaaacaaacaacaacagcaacatgaccagattacatatctctgaaccttagggaaaggaagtctaaaatacagaaataacaactacagagttcacttgctttatgggacagtacctttctttttggaaactcctgggctagtgggaaaacatgaactgatcctcagtggcaaatagactgatcaaagcaaattagtagaaaaattaagacaaaacagtaatcacaatgatacaaataatctcagattgataaaaatagggaatattcttaccacaacacagttgtactcacatccatacaaacaaccacacccatcagaagaacctaattatttatcagacacaaattttatctggtctagtagcttgtgtctgtttgtcatttaaatgtaattagaaagggagtgtgaatgtcttctatggtgtggatcttaaaaagttaagcagacacttgggacacgtctattttggaaacttttgtttatgaatttctgtcaacccttttaaactttttcataattgtgacctgttttaagggtgctgagcttataaccttctacacagagttgccatttcattttcctgatgccagctttagttcatctgatttactgttctgtgatctggcagactctctgccgaggccctgtccttagtctttatggttttgaagatcacagcctggttctcagctggctctgattccaccaacaaaggagaggctcaccatttgagtccagccacctctatgttactcacctttctctggaacatttaagaacagaaatgcttgtgttttttaagtgtgaaatacgcttcatattcttaatgtacatacaatgtgttttaggttaacaagagcttaatgcctttcatgcttatttcatattttaaattgtattcgtttcctgaacccttcctcatggtggccaacattgtggctaaagtataatatcagtcttttaaggaacaaaaatctgtaagccctagacatttccctcttgacctataactaacatcacagaatcaatctccctaaaagagtagggcagattatttttctcctggtacttgctcagagggtatcacttgtcatttttctgctctgcagaggatgtctttaccttgatgcccactgaacagccactttggagcacctgctatgtgccagcattgtgcaaggtgccaggaatacaaagatgcatagaacataatctttgacctgaaaatatccacaaatgaaaatactaaagtttatcacggaaagtgctatagtagaggtgtgtgagtgcactatgggaatagaaaagaggggagactaactctgcctaaataatcagagatctcaccaaggaggtggtctttggtgttggcgatgatgcttgaaggattatgaggaaaaatttcccaaatgggcaaggctggctggtgggcatggagcaaggaaagaagcacttccagcagagatgacaatgtgtgcagagagctggcatgagtggggtctgaaaataaaggaaaataaataatacactgtcatcaccttagataataccttcatattatccacaattggaaagtttgaccatgtacatgttctggtagatcatttaaacatgtcaaataaggatgacagccaaatagcacctgtaggaggcctcctgtgcatcagtagctgtgttaagagctgcaaacaaaacaaagtccctgcttccacagaacttgcatcctagttgaaagtgagggaggggagagaatgaaaataacatgttgaaacatgtcttattgtgataagcagtaggaagacaacggccacctagagacatagtgatggtgtctggggaggggctgttttctgcaaggggacagatggccctccggcacctgcttgcatttacacatttacacacgatggtgaaccacaccatgatttcactctggggttgtattaaaaattgggggagttgtatttggcatttttcttcactctttttcttgccttaactgatgctgttccctctacctctattcgaaaatgttcacatctatttcccctccaaggcccagctcaaactgcacttcattccataaagcctcctctggtttgtatacctagaaatcagctttctcagcttagaacttccttacaccttacccaaacctcttttatggcactcactactttctgtctttggatgtacatacctgatttatccgtcttgctctgtgtagatagcagctatagttattttattctagacttcctgatatttctcagtacaacagtgttgattaatatagcaaatgttactttctccactactaatatagcaaatatgctttttgcactattcctagccctttttatattgagtacatccaaatagttgcttaatgaaaatatgccacatcaactttaaaattaaatctttagtatctagtcttagtacttattctaatgcaatactttggatatgatggctttaaatgatacttagaaatacaaacacaataaataatggggaattctccaaagagcttgcttgctttatatcatagggttatatgaggcattaaacaggcttttttaaatgtttgatcaatctgatcaggatctttcctttgcttccatgatcacgattccttctactgagtcttctatcctcttttctgttattttctaaattccccccccatttttgctcatctgtcttgctctcctctctttgcccttgtctctcctcttcttcttcctatcactcttctctcttcctcttttccttctatccttcctttctctcacttcccactttctccttttcattttccccagcttttcctgtttccttcctttcctttcctttctttcctgtctttcccctccttctgcctgtaagttcccttctttcaaccctgtccacggtgctgaatattaaacaaagcatttatggatttagtccatggtgctggtttatggcactgctaaaactctgcaaacaaaatatagttgagtataaaagattgagttcctattatgtagaaataaacaacattgacaagagtacatattagttattaaacattttgagtgttgtgttgtttgttgtgttgtatgatttacgtatccttacccctaatttgaatatgttacattgttgtcagaaataatagaagccagagaagaatcttttattagcataggatattggattttccataatttattctatccaagttggaagatttgggtattagaaatctatctttccttggtaacatgtatatttcctactgaaataggtcaaaatattgccatatgtatgataggttttataaactttttttttgtaattgatttgatttttttttttttggtaattatgtttgctacaggaaagtaaatgagagagatgtgccaaaagctacaattagtcggtacagttctgatgacactttggacaggtaaggggcttttgaaccatataaatggaatgcataacatattaaatacattttctaataaagttatgaagtatttaaaagtttaccaaaataaggtttgaatcactgatattttattcccagggatggagggctctaagaattgaattatcttcttcagatctcactaaatcttggctagatgcatttccaaaatctttttaatagtagattgatatgaaatattcttagagacactgatttgagtacagctagggtgggtactgtgcagaatctgttagttcaatataggtttttttttttttttttgcgaatatgtataatccttgttccaacatttggttcttccacactgatggtggaaaaacgttagtccatgcaactgctttatggagagactgtaaattttaataatacaatagtttcaatccactccaggacagagacgttagctctttactttctctttagaaggtgaaaatactcttttgacactggagtctccatagggctgatagaatgagtccaacgtgtgtgcctcctgttagttccttcttacatggagggaaagggctcatctctacagggaaaatagggcaacttctattcaggttgaagtataaatgccacaaatcaaatttttagtttagatttggtagaggcgcttagtaagcataagtaaaggacaaagttagcatctttaataggagtcttttggactcctattaaataggcaccataagtacccaaagccagtgctagttgagtttactccctgcagctaaagatgtgctgcaattgcaggcaaaaatggcacctactgggttttaagcaaatacatggtaacttacagcatccaatagattctaaactcagactatgccagtgttgattaatgtagcaaatgtatataccttctgcattattcctaggctttcaagtcagtcaccctaatagaggacaatcaatgctggtatcctaaagagttggtctttctcttttaaaaattatcatccttgtcaaaaatgagtttgtagtgtatgtacaagatctcatctccacagcggtgcatagagaagaggtatataaaatacctctgtccattcatcctggtcttgcagatggttaattgaagaaggaaaccctatttctaggaatgaattttaaagtgagataattgagactcaagtaaggtggaaaacctaagcttttgtaggctgtgcatctgaacgtttatgtcaggccagccgagatacagcctaggaatgtgggaaatagactagacctcacaggcaatgtagttaggtcattctcagccttagctataaattagtaccactgagtgggctcttaaactttattgatgccttggtcctactacccctcactccccaaattctgatttaattagcctgaggtggaactcaagcattttttttcaagcttatagagtaattcttatgtgcagctgagattcagaaccaccaatatagctcaagcccttcattttataccctcaaaagcaggcccagagattacatgatctatttacacactttagtggtatgtttgggcaaagtatcctggcagctcattcccaaggcactaaatgtggaaatagatttgaggaagagaacacaggggttagtaaagaaaggcaagtcctgttagcaggagctgaacttctgtaatacagaccactccaaaatgtaagacatgaaataattttaggaggaagatgatcaaatatatctggtatgtgtgcatttgcattttaataatgatgcacttgttttaatgaatatgagaaaagtactgagtttacgtttgaaaagttccctttaaaatatacttatgtgtgtaaaatgtgaggtgtgcaaaagaaacataaataaatgtgtatgtagcatccagagacagtgggttataactaatttggaaaacctaggttaggaggccctctagtgctccattgtgaaagtataacttctccttcggcttttctgatcatgttgctaattacattgtttggtatttcaagtctccaagacagatttttattaaaacaacctattttatatcacaagttgacagaaatttaatttccaggataaatacaaaattaatctcccacagcaataagaaatcaacatacatattggaatggtggtttagagttctctccattaccattgatagacttattccccgggtagcatgatagagactatgagaggtgactaaagagtaaaggaaggtctgttaacctaatatatgagttttgggaacaatcatactacagaatcgaatatatgacattggatcccagtgaacgatttgggagatagactactttctacttgtgttaccaagagaaagccatgcaataactctgagactccatttatttatctataaaatgaaaatcattatacctaccttgtagggatgttctagagagtagaaaaaacatatcaaatgaccagcaagaagtactaggtatgagacaaggaaagaaggaacaggggccgaagttatgagatcccaccgttggcatataatgataaccttccttatttgtgctttctgactcaagaagcagatgaacacaccttttctagatctatgagattagaatgattaaaatctctaatgatcatttggactcattacatgtattagtcaaagtaaactaatttgtcaaggtagagtaactttttaacaaatctgcttcctctcttccaaatctaatggtttaacacactataaggtactacttgacacatcagagtccaatgtgatttgctggagtccatgaagtgactcagggacctaagttctttctatattttaatgccgccatatttatgctgccatgcataccaaagccatagtagaagggggaataaataacaaggaagaccaccaggaggttttacaatgggtctggaagtggcagataacgtatctgcccacactctttagtctagagctcaatcacatggccccaacttaattgcaatgaaggttggaaaatgtggtctccctgattgctcagaaagaaaagaaaatgtgttttgcaaacacataatattgtttatgccacaaaccttaaaaaaaaagccaagtagttcattgatgccttttactgacataggaagtactgtcattgacaagatatatcattagaaaataatgaaaatgaaaatagagttaaatgctcaatgagtcagaaagacaaacaggcaaaaggcataacacttaaaatttcaggctgggtgccttggctcacacgtgtaatctcagcactttaggaggtggaggcggatgggttacctgaggttaggagttcgagaccagtgtggccaacatggtgaaacctcttctctactaaaaatacaacaattaactgggcgtaggggtgcgtgcctgtagttccagctactcaggaggctgaggcagtagaatagcttgaaccctgcgggcagaggttgcagtgagctgagatcacactactgcactcccgcctgggcaacagagcaagactccatctcaaaaaataaaataaaatttcaaactatattaaaacaacctcataagtagattttgtcataagtggtttctttttatttaaaaattttctaaaatgtaacacttgaaaaatagttctctttactagagaaaggctatgttgttaagctattctagcatgaaaatggtctgaaaggagtttgataatttaaatatttatccagacttttgtcttgtttctttataaaggatctcagacagaaatgatgctgctaaaacatataaggccaataccttggataaccaactaaccaataggtaccagtatctactaactatgggaaaggctcaagtataatatttttctaagtgttacctatgtacttgcaattcttcaatcctacttgatatctttctgtaaattcttagtctctatcattactcctgttcatggctagaataaaaccttgttgtttagcttaagaatcaagagcacttgtagctccaaatcaccattcttaccacatttatgtttctgtttaagttgtcctggtggcaaaattatgaaataggtgcaaatgcaaattttacattattattgttaaggaaaattactgaacccaacaaataaaaatattgggcttaaaagatactaaattttcagaagaaaaaaaattctttggaatctagtacaagagacaaaatcatgaaatcatcttatgaaatttattaaaatatgatgctttctatttctttctctcaccagtgtctaacttttaaaactctaaattcaggaataattccaaatagatgcaaatgttcattcttcattgttcaaactttgctttctttctctcttaccaggagcatgtccatgtttagatcactggaagtaacaaagttgtatgtattctttctaattgtagtatatttctttttatgtattcaagaaaaaccagggaaaaccacctcaggccaattttattggaatacagccatgcccctattgctctggcagagttgagtagtagaagacaataccaaaatggtctgtaaaggttcaaatgtgactatctggacttttgcagaaaaaaagattgccaatcattactctatccaaacaccaaagcttagatcatcctttctttcttcttctttattaaaatctagactccttattttttcccctacaggacttttcttccctctactctcacaataattaacccttcctccacacctcacttccttccccacccacccttcacatctatgcctcctccttcagagaaaattgaattgggaaaacatggggtgagctaaaaatctatttaaatggaacacattttccctggaatgtactactgatggttataagcagcccaaatcagacagatttataaacttactttatttttgaattcctatttatgtataaagtaatttatacactggatcacacctctcagtgcttgaaatgggcctgggtcacttccatttttgaggctctgcatatatgaataaatgccagatagagacttaagatggtatgatttaaaattttttattaagcaataatgcttctaatgcaaaaaaccgcaacataattagttagtcacaatataatcacaggaataaaagaaatgtgaatctgtagcacgccagaattgatttgtctgaatttccgacagttaatgtcattttatgaatcacttctttattctattcctttagttttagctagttctatgagaacctgacaacttctaaaatatgtcaactaaggaagaagatttttggctgtttttctatccccaagtgaaacattttatgaacagagagcaggcaggaatatgagtagaatttaagacttttcaaaggtaggctgaaatgaaaaagtttgagagtgggattaattgttgttcttgtcattaaacaggcaacctggcggttcattgaatgccaacacctccaacaccatagcatccacttctgctactactcctgtaaagaagaagaggtaggatgaactcactgtgtctacctcttgctgatacactatgaaagactgcattagaaagcttcctcctcttttttgtggggatccagcatctacattctgctgttcccaaacttcagctctttcccccagcaatctctttctcaaatatagagtcttgttttcaattcctgtagggccttgaatttctaggaaatgttttagatgatagagctcgcatgttaaatgacagactacttgaggtagcatgtttcatggagtcctgctgctgggaatgccttaacctgaaataatgatgaatgtagggccacatgctgccatgctcctgaaaccggcctgtatctggagatgccgcctctgctctgtggattgggctggccttgcttccaaatgcagagtcaaagaccctttctggagacatccatctgtatttgtttggttcttgcctcctccaccgacctcctctgcatggtctcccacattctgctggtgctgagtcctatgtaattagcaggtacagaggagtagttggaccaatggtgaccaaatattcttcatgagacagaacatgatggtgaaagagatgtttgcatgttgaaaaaaccccagggctatgaattgtgatgcaaatggaaaacaagcatttacaaacatcagtgcttttaaattttctcaatttccctgtctgtacctgggtccatgctctgtacagggtaggtgctcaatgtttgttgatggactggctgactttgccatggtgctgctggagaaaaatgactgattctgttttttccttcaacaaaattctggctgtagctgcaaagtcttagaaaatgtgattcatctttccattgaacccaaatttcatgtcccttgaccctttgcctagtaaaaacagattcctaagtttgaaagagaaattttaggtcagtcagttccatctcctatctagtgcaagaatctttcctccgacattttgggcataattcgggaccactgaagccatcaataagattctcactattttgggacacatctttgacttgctctcctgggtagcatctattccttacattgagctggaatctgccttgattgactcgttccttgtcttagttgagttctgcagcggctcagagaatagacctacttaaacaatttaaatccagctttcctgtctgccttttcttctgtagtgcatatcattctcatctgaatatcttcagttttcatccatatcttgatctttctgcttagcaattgctaccaactaaaattatgacctagtgatgtgaggacatctttctaattgaggttagaactgaaggtagtgctgctataatattcacttacgctttcaatatttttacttgtcagagttttctatcagtttcttttctttttcttttttctttttctttttttttggagtgtgcagtggtgcaatttcggctcactgcaacctctgcctcccaggtttaaccaattatttgcctcagcctcccgagtagttgggagtacaggcacatgccaccacgaccagctaatttttgtatttttagtagagatggggtttcaccatttttgccaggctggtcttgagctcctgacctcgtgatccacccgcctcagcctcccaaagtgctgggattacaggtgtgaggccctgcgcctagctcgctcacagttnnnnnnnnnnnnnnnnnnnncgaggcgggtggatcacgaggtcaggagatcgagaccatcctggctaacacggtgaaacctcgtcccagcaactcggaggctgaggcagcagaatcgcggagggcggagcttgcagtgagccgagatcgcgccactgcactccagcctgggagacagcgagactacatctcaaaaaaaaaaaaaaaaattatattttgaagctgggcgcagtggctcatgcctgtaatcccagcactttcagaggccgaggcaggtggatcacctgaggtcgggagttcgagaccagcctgaccaacatggagaaaccccatctctactaaaaattacaaaattagctgggcgtggtggtgcatgcctgtaatcccagctactcaggaggctgaggcaggagaactgcttgaacccgggagacggaagttgtggtgagcggagatcgcgccattacactccagcctgggcaacaagagcgaaactccgtctcaaaaataaaaataaaaataaaacatatatatatatatatatagagtagagtataagattgttatttctgttgtgaaatagttcagacaagcagaaaaatagggagaataggagaataacataataaacatatatgaatttactatctagacttaacaattgtcattattttctagatttgctttagatttctttttaaaagagatgtccacgttacttagtgctaaaggaaatgagaaaagaggtttacttggaggaacagatagcctagaatataggacagttacttcctacttcatttatgaaatagtgttcattttacttccaaggtttggtataatctcattgtctttttaactgtcaaattattttcagacatgtgggtgggatcagcctttcaatcacaatgtttattaccgtgtcatttcttaacaggcagtcctggtttccaccgccccctccaggttacaatgcctcttcgagcacaggaaccaggagacggtaagggaaaggtgtcaggcgtaattgctgtgccattagatggaagaacatgtcagacattgacaacatataattgtggatgttttgggataaattggaggcaatctcatgaactctcagctctgtacaggagagtgtccagtggttgtaaggtcagggctaccaagtaccctgataggacatctgacaaactgctaggaatgagtaggtggctgtattagattgctagggttgcttagagccaaaataaatgagtgccacaaactgggtgccacagactgccacgaagtgccactgggtggcttaaacaacaggaatttattgtctcatggttttagaggccagaagtccaaaatcaagggttcagcagagttggttccttctgaggactgttagggctcccctaacttctggtggtttcctggtaatcattgacattgcccagttggtacaagcattgacctgatcgctgccttcatcttcacatgatcttctccctgtgtgcatgtctgagtccaaatttccctttgttataaagcaactaatcatgtctgtcctactacagtatgaccttatcctaactgaactaattacatctgcaatgaccctatttctaagcaaggtcacattctgaggaattgtggattaggatttcaacatgtgaattttgggggcagaggggacacaacccttaacagtgacagtgggagagaacagagtcaggcatcagacaggggttccaatgtgggctcttgatgcccagctgcctccaggctgtgcagaacctggagaactggatgaggatatgtgtggcaagttgttcataaacgttaagcgacaaatgaatattttctaattttattttttgttgagagtaatagttataactaaatgatagatcaggtagaggacaccttattctacaatttccatgctaggaatgccagcaacaattcaatgtaataaatatttaataaacactgctgtgtgccagatattattctaggatcttgggatatatcagtgaacaaaacatggagcctacactctggtctttaaagaatcatgttgtataatcgatatcatcactaactcagaaacaaaaacaggtctcctatttagtttacttttcaggtatccaaagatgtttttatgtctcaacatctagaatattttcatgtttcaatgggatcagtttttctaattctgactattggaaaagaaaatatttttaaactctgtgcttatttcatattagattggtttattttatagaattttcctctactgtgcagacttctaatgtctctttcatttccaagtaatggatatgtttagaaatacatgtattttgcaataatttgagtgggctctataaggatgtaaataaactgtagttgatcaatagacacaaagagctcaagttgctttttttatatctgtcattacatctatctatctatctatctatctatctatctatctatctgtctatctatctaatctatctctgtctgcttgtctgtctacctatctataactaaatcaaattactgaacatgttgagcagtcacaacttggaatcacatttacctactgctacaatgttttattttagaacctgctcatctacagatgacttccaattacatgaactgccatgtatgaattacatttggagtttaaaacattctttcccctcaggctgttattagatacttcgctatgggtgatacctttgatataaggagctatctaagtggggaaaatgttgactaggagttaactagttattattttttctgagtattgttaagatccattcaattttgtcttgatagagaataactggtacttttcttagatatatttattacttatttaaaaaataacttcatatttttgtcctcaactcatcattccaattgttcattattccaatatcattataaaaagcaactggttatataacagtgtaaaacatggaaagattattcatgaattaacatctcatgctatcaatgcctgttgaggttgtggatcggtttgcacagagctgatgggacttggctctatgccctccctcacaatttatgcactgctggatgtgatttacatggaagatgaaatgagttacaatgttcctatttctgattcttggctcagatccatagctccgaaactaagggaaagaggagattattaggctaggttgatcagtttatatatccattccatttttagagtcacagattattaatataatggctaaacgaaaagacttctctttgagcattgaaaataatgtcatgccaagccttcaggggaaggagagaataataacaatatagcaatgcctttgatttttgaagtgattttctttggaagagctcaaagtacagcttctgtttctcacctttaatgccagtacattcccagggctgagaaatagcctttttagtaaattctggaaagtagaagcaattattaaatgatgaaagggagtaaaggcttcacaaagatatctttgttcccagaggagcccaaagaaaatggaaataggtcaaaaacagataaaaatgggggactatgattgataacactagctaatagctcaatgttaaacatttccctttatctttcactaatacactggtattcatctctcccccttctctcctctcctatcttctccaaaagaattttctcgtaagactgacaccctcactttttctgttcttaattttgcaagcttttactttttcaccacctaatctttccctgaaatttcattttctctcatacatctttttctgtgcagcacacttgaaaagaccatcaaacttccctgtcatccaggaatgagtcctttcctggaatttcctcccttgacctctctgtagcccttaacaccatgggttatcccatctctcatttgtccctttcttaatttatacactatggaaaaaatcaagttcagattaaaaacttgtgttgtattgtgttttgattaaaatctattacaagcccaatgtaaaccacacccaaagggacttaaactttttttttttatcaacagaagagctcataatatcatacctttgtttaaatgtatatctatgcctatgactatgttagtctatctttataattaatatatctattcctacgtctacatctatatctatacttacatgtaattgtatgtttataattaacacaaggctggtgaggttaactacagctgaaatgagaaaatagagttttttaaaattatcatattttatagctaaagaaaaaatgaaatttcctgagaagtgtcattttatgtatgatatacattagttatgcaataagagagttcagacctgggtgatcaaacaaaattttggagttaagactcgaatatctttgaaagcctcttgtcctatttttgtaaatgttcacgagagaatctaattcataacagcaagacatggcatgtaaagtttttaatttaaataaaacctttggcccttctagcttatttctaagcttgcttcttggtcattgtgatttcaaccattgggatattgatgttttctgtcttctttcttctcttgctaagaatggaaataaccaatacagtgttttgaattatcaagatatgccaagcagattatcctttgaagtcttcttgtcagaacatgttttcttttcattttaatcaagactgaatcagaattttagctttataactgttgttcctcatcacattcctctgtctctcctcctacctctgatcaaattcctgcttcactggtttccccattttccatgttcaaacctctttcatcttaaaaaatgtagttcctaaaaatttgatagcctaatcttacaaacctactcagctgacacccttcctctctttccatctcagccaacattctcggaagagttgatgatgcttttcatctccattttctgcttcctatcaccattagttcatggaaacagctctccctaagtcactgatgaccttgcttatatcagtctgtatgatcttgtgacccttcaaagggcaccactgactctttatgcccttatgaaatctctcttattgtgtttcgagaaccagcacactcccccaacacactctgctggattttctttctttttcgatttctcagcccttcttacttagtctcctcagcttcctcatcattttctatcaagccattaaatattgatgctcctaaaggctccaagtccctcttctcttctcctcttgttctgtgctctgcctttcaacagcagcatccagctccagggtttcaccggccatttgtgtgctcgccacttcttcatttatatccactccagatctcttctctgagttgcctttgggtagcccactgcccattgtctcaaagacaccagaaactcaatgtgttcaaaatgaaatccatacttcttcatcctaacctggtcccccatctcattctcctataatggtagtttaatgggaatagcattgactctctaaattactttgggcagtatggccattttcacaatatcgagtcttcctattcatgaacatggaatgtttttccaattttttgtgtcctctctgatttctttgagcagtggtttgtagttctccttgaagaggtccttcgcttcccttgttagctgtattcctaggtattttattctctttatagcaattgtgaatgggagttcattcatgactggctttctgcttgcctgttgctggtgtataggaatgctagcgattttcacacattgattttgtatcctgagactttgttgaagttgcttatcagcctaagaagcttttgggctgagacgatggggttttctagatataggatcatgtcatctgcaaacaaaaacaatttgacttcctctctttctattcaaatatgctttgtttctttctcttacctgattacgctggccagaacttccaatactctcttgactagaactggtgagaaagggcatggccatgtgtattactctgttgccacactgctatgaagaaatacctgacactgggtaattcataaaggaaagagatttaattgactcacagttccaccttgctggggaggcctcaggaaatttatgaccatggaggaaggcaaaggagaagcagggaccttcttcacagggtagcaggatggagtgaaggcaagcgggggaggatgccagacacttataaaaccatcaaacctcctgagaactcactcactatcactagaacagcatgggggaaactgcccccatgatccaatcacctccacctggtcccgcccttgacacatggggctcatggggactacaattcgaggtgggatttgggtgcggacacagaggcaaaccatatcaccaggttttgatctgatttcccttcaatatttcgcttctatgttacttctgtcctgttctctcagctctacactaaaccagctatagtttccttgatgtgtccaaatgccacttggataaggtcttaataaagatatgggatggtgggagtggtagcaatatattgcagaagcccacaccaaactacctaaaatgaaatattggccatccctattattgggcgtttcttgttggctgatgtttctctgcaggccttaacctgctgctgttttgctcaatagcccctcactcctttcttccaccttcactctccagccccccagttcctgttaactacttatgccagggagtttagtccttgtttttttccctgcgctagcctgtccttagagaatcttattatcataacaaaacacaacatattcactttttgagaggcattctatgctactttttaaaattaaatttttcttgtgtagtcattcagtcattcagtcacacccacacttaaaacatcaaagctgtcatggacctctttgtattccttactgtgtttattcaatcatcattgcagcgagttccagggattagggtgctgatggagaaaaaagatatgaccatgaggtagcagaggcataccacaagcctaatttgggtggtgctttcacaagttttgcttctgagggagtcactcaccacatgagaacctccaaaggcaactgcaaagagaccaccaccaagaaagggaggagggggaaggaactcctgggggagcagggatcagagaaagggctttcatgtctagttggtgtcactcagcatcatgatgggagtcccagagcagagaactctgaaaagtggcaggagctttgggtcctttttggccccaaacgttggagaatatgaatgtacaaataaccataccataagatcaactgtgggggcatgagaagaacatcagtattctctgggagatctgatgttgtaggaagagcttctagcagggaactcagagatcaggtccccaaagggatgtgggatttgggggaaggaaagaagtaacacaatgctaggtttttaagcccagggtgattttaagcatggtaatgccactaatcaatgtgggaagaaataggagcagaatagggagtacctaattggtcttaagcagctgacactgtgctttgttttgagcaggtagagtctgggacaccggcaggatatatttgtagcagtgattcccaagtaaagataaacagctacaggggaggaaggagtgtgctcaggtaaaaggcaggttccaaagatctaggtttgggaatgaacccaaggatttaaaatgtagtatctttagagtgaagatacctgttgagaaaagattaaatgagaagaaaatgaaagttgaactttgatgtatgtctgtacattaggtgtgttggggggctaaggttacatggtaaaggtaaggtgtaatgagaggtaggtagggtgaaggcagtgtgggtcgatggattctaccatctcaaaccaacccatccttcaagaagtctggcatgaattttacttcctcccgaaagctttcatactctaaggtgttacttttgtcatctggactcagaaggcttattatctttgattctcatttagcaattaattgtgcattactttgacacatcacttattattgcagtgtactcatcaactaaatggcatcatcttataactctttgaatcatcaagttaatttatccattgtagtttgtcaataagtacatattgattgatagattgattttaatatttcttaatatctactagacaatgaatttccctcaacctgttatcttatttgtctttttgtagttgtgctgtattctatgtgctaagtaacacctctctctcttcctctctgtgtttctccctgtctctgtctctttctttttccaaaacaattgttgggctctgccaggagtacaaaaaggagtacagagagaaaactcagcttctaccagggagtcattttgagccaggattgttaaacttgaaggctggccctcatcaagggagggtccttgggagtatgataaacacaaaggtcaaggtagacacaaaatatgtggagtgtggagagggaggcagtagacgttgtatctggagtagagtaggctcaaaggaggcaatgccagaggtaagccttaaacagcaagcaagagtaagccagatgcaaaggggaggtgtggatggaggcattccaggcagaaaggagaggaggagcaaagttccagtgccagagagtacggtgtgtatgggcgtgtgtatgtgagtgtatttgtatgcatagaactataggcttcctgtccatgggacattctctgcatttgtcctttatcaattatgtttagtggtagcatgaaatccagtaattccaaatctgatgttatgtgggaaaatgtcttttaatgtaagacactgtgtgcagatatccactcataatttgtggtaagcctaagaacccttttagaatatcatgtttctattttaagagttaatgttgtgctgttatgtaatttgagctctgaccatatgctgtagatttggaatatgtacaaaagaaagtgcaagtgtcatcaatgtagaaaattactagaaggtcagagccatgttcccctcttcccacttcttttgttttatgatctgcccgaaagcctgatgcaaagcgtgtcagcagtcacttggggatgtcttcatttttcaagttcttaaacactttcttgtttttgagacttttaaaagagtggtagcatttgccggacgtgagccaatggagggaataataggagccatctggagaaatattcaggtgcatcacaaggaactagagaaataacagttctggaaagttgaatttctttctgatttcagaacctaccattaaatttttgtattctgtttttggtaaattcaaatgattctaactgtgtatttaggtgacttggagattcagtggttaaatggcatgtaaagctcatttaagaacctcatggaagccaaactaaagtacttgcttaacagacagtatgaatatttatgaatgttattcattattctcatttaggaacaataatgaagccaccactagaaatgaatgtgctttttttctggaatcatttttaaagatagaaaagaaaataatatttgataaaattaaagtagtagaaacgcatctgggaaaattaccatataaatattttctacataatttctcatccttatttgttttgacctcttctccttcagtggttatttcacttcctgttagctgattggtagacttggaggaggaaaaaaatatcctgattgagaagtgagttgccatggcaaccttgcactacagttatatttttctgtctgtaactataaatggtaaaatgtaacctttctaattatgctgcaacatttttaactctattggtaccaaatcctctacaaagtttgatgtcatgctaaataaaagcaatacatcttatttttatctcaacaaaaaaatatttatattaactggaatctcttttgtagaaattaagattctatgacacgcaataaaatatcaaaatacagtgatttaaaaatcttacctgaatgcctagattgctcattctaaacattcaaaataattaaaatattagcctgagtttaagtttattatttttaaaatgtgttgtttgaacagaacaaggagaaacctaattcgcaatctgtaaatgaaggtcttaacctttagcaatgaattattttttcttcagtcctatgggaacaacctagacagtccctgatttcctaacactagtttgaagtaactcatacatttgaacaacaaatgcaaagcatcgctgctttgcccaacccagattcccacctctcctccctctcttggagctcttgttgcctccgcccctgccaggggggctcctggaaatatgaggaagcagggaagctctaggttcaaaagtaggataaagaaagaagctaggagaatcaggatacctagggtcaagcactctgtcaaaaacgtcaccttgctccaatcataaaaaccaaataatttgattttttaaaaaattatttcaccatttctcctagtattgctggaagttctatcgactagagattgtaaatttcacctcaattagaagcatggcaggttaaagggactgtctctggtcattcaaatcttagtgtcagttatataaaccaggtttctttcctgctaaaactgggcagaattagagcatgctgagggaatggaggcttgcattgtgtggaggggagtggaagatggctttggaggaagaagactgggaggcagggaggcctgagtacagtgaagtataggtgatagggacatgctgtggtgtagggtttgggagaggacaatgggagtgggggatgggggtgaaaggaccaacattttgcttgggactgtcttcatactaggcagcccatctttgtcctctcatctctctgtctcctctcttagctatgtgcagaatgtcatataatggaatcacacattatatacacccttttcatatgtttgcatgtgtttgtttgtcatctgtgtatcttccttggtgaagtatctgttaaatatttttttgaaatggagtctcactctgttgcccaggctggagtgcagtggtgtgatctcggctcactgcaacctctgcctcctgggttcaagtgattctcatgcctcagcctcctgagtagctgggactacaggtgcgtgccaccacgcctggctgaatttttgtatttttagtagagacggggtttcaccatgttggtcaggctggtctcgaactcctgacctcagatgatcctcctgcctcggcctccgaaagtgctgggattacaggtctgaaccatcctgtaggcccaagtatcttaaatcatttgctcattttattcctgctggtttgtttacttattgctgagttttgagagtttcaaaaaatacattgtgcttggaagtcctttgtcagatatgtgaatagcaaatattttttccagtgtgtggcttgtttttcaattctcttaacgatgcacttttgagagccaaagtgtttttttaatttaatgaaatccaatttatcaagctttgttaaataaattatgcttttgttattatgtttaagaactctttgcttaactaatgatcacaaaaatttcttctgttttcttctaaaagtttgtagttttatgtttgacatatagatgtgtgatccattttgagtagactcgttagtaatgctaacttttttttagttcacttgataatagttgaaatatttttatgtctttgagaaaacatctaaggacaaaaagctgctatgacttaagcaatacttaaatttgtgtatctttgtatctactgaccaataaaagttgactcatgttcttatagagccaacttaaatttaaattttattaaccacaacagcatctacatacctttaaaaagcacagtacatgaacgtcaaggtacttgtggagtggaggattccctgcaatagcgccaccctcccttattcatgtagtggtttaccttccacagatctgagccaatctcctccttttatagacaaataagcagagttttggagggtaacagagctttttccagagtcaaagagaaagttggtggcaaagctagcctagaatctagaatctagatctctagaattctagtccagtgcaagctccattactaggttatggtttactgactggccactagaaagcgaggcatcatcacagtaaccattcttttgaacatgtgccttgcattctccaagctcttcgaaggcatggactacatcttttctagtctttgactgcccagttacggctcatatactgttgtgtgtcctaacattatgaatggggcagttgtggagtaagtgctttttgagcaaggaaatatttcagatcaaccaatttttaatagattcgcagtgaaaatacctggaagagaattggttgtctacagtatgatatagagaaaaaacaagggatttaacatcagaaagaccagtttgaaaccctggctaagcacaatagaaagtgaaaacaaaattcacagttaaatattagagacaatgattctgtgttcaacctagatttgtgctgcagtaatagacatgttcacacagccagactcaaacagaagtcacagagccaagcatgttatgcaaaaaagccatgaggaaagacgtgatatttgcagcagcatatggaaatgaagtaatatagacagctttctttacagtgttatttcttttagctttggcctttgagctacagtctgcaagtgttcacatgtttctcgtgaaatccacgttttttattcctgaaagctcatcatgatagccactagtgtggtggcatatatcctgcaggacccttgaggggtctggggatgggtgaaggggagagccagggtcaacttacccaagcttaaacatcgcatctcaaagcagaattcaatgaagatcattccaatgaatgtctcttgtttccttctcttcagaacgttctggccacagcttcctgcctcgctcttgcattttaatccccctgcttggcatcacatcatgctcctggcacgacatgaatgactcctctcattgcccgccccaccccagggcttgagttctgtcatctgtggctgtcattgcagtgatgcaaatgaaagctcctttgaggtaaatggaagtcaacatggcatcgcctggctcctggcccagcaggggtgtaaatgcatcacccttggaaataaacatgcttctctgcttttcttggccttcataactgcacatccatctttccctttcctgcgtattctccagaccatttcagatctacttctactcccctgatccacgcaatccatatttacccacctctttgaggccctagacattttaaaatggaagaaattgagtatgtcattaacatgactgtaacataagtaaagcttggcaccatcccatttctattttttgtaatcctcctttccaccttgttacctctttcctgcctgtcctcagacatctagtgttctgtacagcctcattattacccaggactgatcacctccttccccctttcctctgcctctggaaggaaagcatgtaaccaatgaatccacacagatacactaaagactgtatcacttgatgcatacacccaacacaaggatattttccgagaaaagaagatggtggcaatacaaacaaaatactgtagaatctgccactaagccaggatgggaagactatttccatgtaaattgctcttccagaaatatcacacaacagaatgattcagccaagtacctggcacctagtaggtgttctgtaatgggattgacagtggaattctcctatgaggaagctaaacttgcacagattttgaaagttgcaaatccgtctttggtacccatttcctccctgccaaagaaattcagccaatcacttcctccttcattcttatgccatacacaatcctagtacttgggatatagctgtccttttaggaactttcagttcagtgtgggaacagaatatcatgtgtaatccagaatagtgtgatatgtgctgtgaatagggttgttatgggggaatgtagggatgtatatagcatggctttgggtatcactggagatagatactcctaaaccaaagtctgaagggcaaggagagaatttccaggtgaagggaagaaggaggtgctccacagcggggagagaatatggtggggtgcattaggaagggtaagagtttgtcacatctgcagccctggggtcatgtggggtgaaaacaacaaccactacagcagaagacactatttcctgtgtggaagccaagcatgcgcgcgctcttctggcttcaatgtcaccatcaacatgagagccaagagacccaccatgcttggtgctccactatccatcacccacggcctcaccaccactctgctgaaagttctcaggactcattccattatgtcctttccatagaccctcattgaaaccccagtcaggtcatttcttatcacctggaccatctccacagagctctgtacctccctgaacctgacccaacctaatatcacactgagctctcaaacccttccactccaccttgctgagcgtgtcatttgtcattgccaaaatcctccactcttcagcctcccctctgaatgatctcccacctttttgttgtgctcttccagaggaccctgcttccacagcctgtctctcaataagggctgttttccctctaaactgacatatcacagggtccggatgaaggtaggggtcttgtttgcttctcatcaccacctgctgttaattttaactccctcctccctgaaactctccatctcctttgaagccatgcccttgtgagcttctcatctttgttggagtcatctgaaggtctctgagacactcacactcattctttgaagacttcagcaccacgctcactgtctttcccaaaccctcctcttgtcataatgcttggtgatttcaaaatccatgcagaggatccttcccctccctgaccactcacctttgtgaccttctccccgatgatcttgttcttcccactactgcagccattgatagatcttgccctgtaaataaccacataccctacaaaattacaagacttctacttcaaagctttccctctctggctcccgctttctctctgtccagctcactcccttcagtcctttgattccaggaattcctcagccccatcacaatcaccagtccattaattctaccagttttttcacagtccccactactcatattctcatttccctccatgcccatctcaaactccacagcccccattgtaaccccttccttgaagaccccttccactcccttgccatcattctctttgttgcactcacttggctgaattgtaaacgtggctaatggtaaatccaactctcagtctattctgttcctcctccccaaccagttgaatatggcaagaggaaacaatgccaaataacctgattttaagcccatgagtactaacctcaactgagccattggtatggcccaaggatccttcaagagacagcacagcatttggagggtttatgcagccagactttccctttcagattcccagctctgccccttatgagctgcatcatcatgagatatttatctttatgttctgtgcttcagtgttttaatctgtaaaatgggaagaagaataatacttatgtctgggattgcagtgaggatttcattagttaatatatgtaaagtgcttagaaaagtttctggcacataatgaccccatataatagtacatcatcatcatcaccatcttactacgtttcctgggtccacttactcttctgcttgcctagaaaaccatttcacacattttctccgcctctttctttctcacacagtcctaatccctactcaacctcctcactttgaatcaatgatcttgattgttattttactgagaaaatagaagtaaacaaaagagaaccttcctcactctgagtcaatgaacgtaccccagctatactcatctagttctttccctcttgctgctgtgaatgagccctctgtacttccatctaagatcaaccaccaccctgtgccttaggtcccatcaattctcaaagtcatctgtctagtgatttccccctctctctcctgcatcaatgattcactggatcattcccatcatcatacctacatgctgtagtaaccttcctcgatccatcagcctcgaagtagctacccatttctgtcttcctactttactgccaaactgcctcaatgcctctatctccttgcttccccattttttcctaaatccactcgtatgatttttttttcttttcccaccatcgttccatcaaaactgctcttatcagggtgaccaaagaccactctgttggccaaaccatggtaatttcccagtccttgtttttatttgattaacagtagcatctgaaatggccaagtactctttccttgaaacttttctcgcttggcttctgggatgccacgcccttctattactcttgtttccttcttggccactcctcctgattcttttgctgttttcatctcatattcttgacctctaaatattgcagggcctgaaggtccaacccctggccctctttttgtctctacttacactgactcccttagtgatctctgccagtttaaagcattaaataccatctctaagctaatgatggctgtatttatatgctttttctccagatagcctcatggcttactctattacttcctgcaggtcttggttcaaatttcacctgacagagagaccttcccagtccattctaaataaaataatcttcccattccatcagtctatatctccttattctgttttattattattattatttgcacagcacttttcttcttctgacatatatttatttgtatattgaaagcctttgagaacaaggacattacccagctcacagagagccttccttgcacatagaaagctaccaataaatgtttgttgagtaaaaacacaatctcattcagtcctgacaataccccaacaatcctattagaaagattattacagatgaagaaacagaatcaagttaacctgttaccacacagctggcaattcaggcagcctgactctagcccacatgcctatctaccattgctacagaagccagaagggtacacaggatcagagggttcttttaccaggtacagagtttatgttgaggacaaatagagaactgctggggtggtagtggtggggaacacaggggagtgacatactcttagtaaggtgctgactccatccaaaatgtgcacataattgcccatctccagttcctacctcattaagtcctgccaactcagagactgctgtggtgcttcattggaaagtttaggctgacggtagattgtatatatgctttgtcagcatcaaagtggcctgtgctgacaatatttaagtcagatttagttaagagcttcaaatcaatgctaccttgaggtctctgaaattaaagccttttcttgctgtttccatagcagcctgatagttgacataatccccaaagaagcttatatattaatacccaaggaccatttacagttttcatgcactgctgacctgaaatgccatgactagagctagatatactagcaaaatattgagttatttaaagaacatagtatagtccaaactatagtgaaagaggattgggttttcaagaacctgattaaataaactttaaaaatacacatattttcaatatttgacttctttaaagtttagtgctccatggattctgacctttcaggtacctcacacatgggggttgtaagatgcaaaggatatttttatgtaggcaataaatgcattcagttaatagatgctaaaatttaccatgtttccatggtgaaatgaactgctgttttctgttttaaagggaaccaggtgttcaccctccaatacctccaaagcccagttctcctgtttcttctcctaaccagctgagacaggataataggtaagacctagtactccagaatttcttgacaaaatgaagttcaagggaaatgaaagtaaatggactgtgacccgctgtgggcaaagcatgaatgttttgtgtgcacattccctaaagaagcgcctgtagaactttttctaattttatttcccaacacatatgtttatttatgtttgtctttgaatactaatggctaacttgtcttaagaaaatatgccttcaagataaaaatggaacaatattcatgttcagaaagtgtttgtacacagactttttatatatttgctcctaatatacaaatataaatacatatatgtatttgacatgtatcacatataatatacatataaaccatattaaaaatgtattttttgttcatgtttgttccaagtcaagtttcccactaagagatacagattctgatgaacgatgttcttgaaactttgtgttaccactcaaatccttgcttatgttacaaatacctttgagtagttctttaatctttttttactgaagggatttgtaatttatttcaaaactatcacaaattttgaaaggtgttctaattgacttgtctctgaatcaggaaaaatagacttgcttctcagctttgaatctctgtcactctataattaatacttggaaacaaattcagagatctgaactcttcccatgtgttacatttaaactgtttaatatatcttgaacaatttttcaagatgtacaccccacatttccattattattgtgagattaaaaaatagtaactcaacggagattgactacattacatctccttgattgcctactgttgcttcttttgtatttttgctcttcgatggtgatttttttgacaccacgtaagacacaattatgaaactattctttaataagacacaaccatagaactactttttagtagacacaattatagaaatattcttcattaagagagtaacttcagttacaaagttttgactgggcagcaggactatgtagcaataggtgttaaaactccaggtttgaatttctgttcagtgaaactgcacaggatctttgaaattttgtccataggatgagagcataattttttaaattgagtcaagagaatatttcttcactgaactaattaaaaatatagatcagatttataactttttgtttgtatgatggttataatgatctcttaaaaatatcttctcaagctttttaatcttacattatttttcctctaactcttctagtattgagcaattaaatcccaatttgaatagaattgttttaaggggctaaaattaattggccttagtaccaccgatattctaatctaaaatcagcatcactagagctacaagcttgtttaaatttaaaggaagctaaatttcacaggaacttactactcaaatttctttattctaccaatgatctaaaaaataaaattgggacaacttgcatgtttttttgaagtcctgactactttaatcacagcaagatgattttaatgaaagaatatgaaatggaagtgtttcctatgtaattaacacatgtcctcaggagtacaaaaaatagtcgaatatagcttcttgagaacaagtaggaatgtataagtaggtcaaccagatactttaaaaaagagtagagaaaagtcttaaattgtgccagaacctaacataataaaatttaattctgtcagcttagtatggtcattcccaatgtagtaggtgtacttgaaacatagactcttcttcccaccttttatgaacaaatatatttcttgatagtattcaaatgggataattctttaagaaaaaaatccctttgatgcccataacaaaaattaatattttaaaatgttatatcattatctgatagagataagtatgaaaatgctttattgatggagaacaaaaaacaacataaacatatttagaacttataagtctagatagatccagtggtttacaaatatgcgataaagatagattaaattacaaactcagtatactggagttcccgccaacccaaagaatttaagtttgttatctcaggtagtgttatggttccaacaaacactgatctttttgtacataaattttttaaaataaatttcaatttatcaaaaagtgttttcttttctgactgatataatcttctaactttgaaaatataggcagatacatccacctaaaccaggtgtatatacagaaaccaacagatctgctgaaagaaatataaggtacactgatttctatttatatctatgtaactgtagtaatgataaagtatgctttctcagcacattaaaaaatgcaaggcaattaataataaggtagacaaaatcagttttccaactgactccaaaatattaataaatgtttttgtaggcactttcagaattttgttccttttaattctatcccaaactttccattaagaaaactaccaaaatggtgtgaacaaggtaacaggataagatcaaacccactaaaggcaggaaagcttgctcacctctttattcccaggacctgctctgaggtctatgatatagttggtgtggatgtataaagaggtggaaatacagttgttcagttgaacttgtgttacaaaatcctgcagcatcaggaagaagcacattgatgccatttgttaagggacattcaccaaatgtcgtcgggggggagggtaaggtggcattccccaaatgtctggtctcccgatttacacttctaatttatgcttgttgtcttgcacatcctatttagtctagcatttgttctggatgtgtcttctttttctcccttttctaaggaaaaaaattactttttgaaaatagtttttaaacagtgcaattttataggtctatcaatatgataatttttcagtcaaaagatttttatgactgaaaaaattactttgaagtttaaaacttatatacttttcattttttatattatccccgtttgactttcagaagagtgccattctaaaagacacatcacatgtattctcttctttggagaaagtcatgtttcccttgttctgaggagcttacagcaccactcttggcattccccaacctgtgttctatgtgccacaggatgtcaatgcatgttctgcaaaagaagagttcagtgtttcactacatttaggaaacacagtttaatagagttttctgccacagaacttttcagaatctttagtgtgcttatgtgtattccaaatcagcaaaagtcggttacatttcccaacttacttggctacaaaatcctttcttcatggaaccttattaaccatctatgagatactgagttcttttcttttcttcttcttcttcttccttttttttttttttttgacaggatcttgctctgtcacccaggctggagtgcagcagagaacttatagctcactgcagcctcaaactcctgggctcaggagatcctcctgccttagcctcctgagtagttgggactatgcgcacaggccaccacacccagctaatttaaaaagaaatttgtatgtggagatggggatctccctttgatgcccaggctaatcttaaacttctggcctcaagggatcctccttccttggcctcccaaagttctgggattacaggtgtgaaccaccacacccagcccacagttcttaattactataagaattttcctaattgttccttttatgatccagggatattggcattgatctgatttggaatacatgagccctctatgtgctcaggtgcttccacctattctagagtctgagaagacaaacattttcacccctttagggtgaaaaggaataattaattaattaattgtatctgttgcttaatgctgcttggttctggtagaaaaccttttgaactcacttctgtgtttacttgtcagttaaatggattttgttttctatgtcctttttgtaacatagaacctgggagctggcaatacaagtcttcaggagaaaatgtagttatttcagtgagcactagatggcagagccaacacccaggtggaataacagaggggagtgtgtgtgtgtgtgtgtgtgtgtgtgtgtgtgcgtctgtgtgtgtgtgtgtgtgtgtcagtgggggatgtgtgtgtctctgtgtgccatgagctgacataatagaaccattttgtcattctgttaaactcagtaattcctgaacaccacctagactatttactttatttactgaaaacaaatgagaaattttagctccttcaaaaatagctcgactatcattgacctgtatttatttttcattgtttgaaggagtcaggatcttgataacatcgtcaaagtggccacttcacttcagagaagtgacaaagggtgagatctcagagcttttgagcttgggttttatcttccctggtgtttcaaaaatgcttaaccacacctttaaaagttccaaatatgaacaaaatcctagtgctgtatatcgtatataatttaaaataagaaagcatcagtttctccagataagtattcctgaatagtggatggtgccaacatttatggacactcttccaactctgctgctttttctggcaattttactcacccagtgacctcagctgtcaagcctcattccaaatatccagtcctgtatttatgttgctggtccagatctccactcatctcctagcaccacccctcaggatgtccaaggtcatatccaaattccttcccaaatgtgctgttcctcacttctctgttcttgaattcctgcagactcacctttctggaataattcttgattcttccttctccttccccttaagtagtatcatgcatgcacgaattaaacatctaaaatgtccctcatgtgtacacggatttcccctagtttaaaacctcattgactccttcacagattattagagtagttattcagctttacttacactcttcaggctttccttccactaaactattatcacccatcaatgccataatttttccaaagattctgctcaatcactgaaccagatccacattgcccattcaatggcatataacctcattcaaagcccttgcgaacctggctccagcctcacattccagttatttctgttttcactcctatatttatcctacgttcatatcaagggaaaccattttctctctgtagtttccaaatactctggctttgtttataccacatggtagccttttccagcctcaagccaccatgccaatccatccaagccctgcccattgttcaagatctggatcaagtggcaccttctctgttgtcttccctgagtgatccagtgagatgtgacttctgcctctattagcacttagagttgcactattcatattttataagagcgaatcatactcagttttgtttcctgttatttgcataagtgtgttaccttctctatcatctctatagtctctcagggcagatattttgtcttatttgccatttacagtgtgtgacatgatgctttgtacacagtgtttaatagattatggtaaaatcataatattccattgtttaagtccaaagctctcaaaaatattccttgtttaatagattttagtaatgctaagagtgttgttagagattgcagtctctgtcaaaagaattgaagagaagaaaatgtgacacttggcttttctgtgcaaattcataaacaaaataggagctctgaatccagacagagtctatagaaattgtcctgaatgtttcatttccatgtcttccctcattgaagtgtctagatctctaattttattgatttatttctgttgcaggtaatattttgtttccagtagggattagacagtggtttggtgggtgatcgggatatctgagaaacagataagtgagtgactctgaagggaaattatggtttggtgtaaatcaaataaaaactgtcagagaggcagttagtttaactttcctgtccctgctccctagccataatgctcaaattccacagccaggtacatttatcacagagagaagttgctgcttgacagggatcaggaaaaatgttcatggtagtcatcatagagtattgtttctttggaccatccacagggagtagaaatggctttagttatccgagctgctctttgtgaaatggaatgttactgctatctgattaagagcatttaatttgttacaaatgcaatggtgaaacttaatatccaaagctttcatcaatttaaagtcattttgaaagcttaagttttttatttggaatacagtatccattttatttaatttgccacagagtgtcttctcatgatttatgctaattttcttgggataaagcaactccaaatcctgataatctcatcattgtgactcatgccagtcaggaaagcctggggctaaaatttataggactcgtgggtttgctctttcccttggggacatgaacagattgttagtctcagagttagtgggtagaatatcaagcaagaaacagtaatgggttactgtgtcaagggactgggtagtgtttgtcacacacaaggatagagcattaatttttttgttgttgttagaggcagcaacttttgtatttcagtatttattctcaggcaacaattctaccattgatacctaaaactacttgacaggattcacctatgtactggctgttaatttagggtctctaagaggactaccctcagcagctattcttgctatagtgtcatcgtgccaggcatcttcaagcacataagtgacttagcaattgcatctctttctaaaggctaagtcgaagtcttggtgtttctaagtgcaattaaaaaataagtatagcaagcatttactaggttgggcgtggtggctcacacctgtaatcccagcactttgggaggctgaggtgggcagatcacctgaggtaaggagttcaagaccagcttggcaaacatggtgaaaccccatctctactaaaactacaaaaattagctgggcatggtggtgcacacctttagtcccagctacttgggaggctgaggcaggagaattgcttgaacctgggaggcggaggttgcagtgagccaagatcatgccattgaactccagtttgggcaacaagagtgaaactctgtcttaaaaaaaaagaaagtatagcaagcatttattaaacaaaaaatttagtaatgacagggcattatttattataatggcccaaattaatcaggaatttatgacttgttaggcattgtgctaaatactttatattcatgagcttatgaatcttttctgaggtgggtatgattagtattctcattttacaaatgggaaaattaagtccacagaaggttaggtaactcacccagattcaccaatgaataagtgatgagtcctggatcgtactccatgtgtccttaacaaggaaacttgaatgcgtaactactgatttgtgaacagaaaaacttgctgaggaaggcaagagaggtggggcaaggtgtgtgtgtgtgtgtgtgtgtgtgtgtgtgtgtgtggtcgggggtaggtcatgaatagaaaagttggagaaaggacatgctgtgacagggaactagaggaagaaaccaatagcactgtggtgaaacccccaccccacctcacctaggctgcctgcttaggggagaaagttgaacccatgtggtttaaatagaattcctgaacctaagtatttaaataggttgctcctgaagcagcagccagaaaaggctttgcagttgtcaaatgtggaaacaggctagcaaatttagctgacctggaaatgaagtagcagagctcaagaaggaagccagacttactgatgaacaaatgttttctagaagctacgtgtgcaagtacattgcacaatgctgtaattaatcagtgtacctatgtgtggactcagttaaaagtgggtattaagtatctactgtatgaacactgtattaaaacacagaagtgtgtctgatgtaaaatacagttctaaattttaagtggtgtgcatatgtgtgcctgtgctgaggtaggagcattaacatgagaccagtgtgcaatggctataactcaaagtatagtcacagaactgtcataaagcaggtgcagaaaaaacaaatgctgcaagggctccaaaaatgtagaggactctattcagttagaggactaggaaaggctttctggagaaagtggtgttggatgcgagctttgaggatcatcaggattttcgcagatgataaaagtgggatgtgttgtatttcagagaactgtcattttaaggcaaatttaccctttgaccctgggcaagctttttactaatgttaaacatttttttctcttcccaaagtgaagaattggataatctcatcaaaatgaacaaaagcttgaataggtaagatttttaaatgtttatcttttattactgagttgcatattgtgactttttatgcctttccagtctttgagcgtgaggacccacataccagggtagtcaaaaatatcctacaaatcttgaataaaagcttgcagcaatcatcatcatttcattgttatgatgaatggttattaaagtctgaagatactaatatgaaagtgttcttgattttcatacgccatttgtttattaaggcagttatataaataaccacttttctcttcctgaaatattaattaactaaaatgtaaacagaatttggtttgatcatggaataattttagtttaaccattacaaaaaacattttattatcatagttaatgttatattgtttattattattttttgagacagagtcttactctcttacccaggctggagtgcagtggtgcaatcataactcactgcagccttgacctcctggccgctagccatcctcttgcctcagcctcccaagtagctgggactacaggcctgtgccaccacgtgtggctaatttttaattttttgtagagatggggtctcactatgttgcccaggctgtatcttcttgttttgaatcatttataattgtataacttgaaatatgccaagagagaaaaatgaataatcaaggcttgtgtttgtggtaagtataatgtaagcaagctctctattactttgcatactaacccactaaacagtgatcaaagagaaggagaaaacagggaaatgccaaatgaattcattgatcagaggatcccgagatgtgtttttcctatcctgttctggcaataatgatcacttaatctgctgctcttcagtttcctcatttacaaggagaggaggttttagatcaggagtcacagactccacggcccgctgagaccaggcaggtgtgagtgggtgaggagactgactgtgataactgcggccaaaaggagagcaaatgccctgtctgagcacacagctgcttctcagctcagctccagctgagggtctccactgagtctagtgttgcaggacagcagggcattctcaggagatcctgaaaatccagttttgttgtttgtttgttcattcgttttagagacagggtctcgctctgtcgcccaggctggagtgcagtgatacaatcatagctcactgcagcctccatttcctggactcaagcaatcttcccacctcaacctcccaagtagctgggactacaggcaccaccaccatgcctggctaagttttaatttttttgtagagatggggtcagaccatgttgcccaggttggtctcgggctcctgggatcaggtgatccttccaccttggcctcccaaagtactgggattacaggcataagccactacacctagcctgaaaattcaggtttctgtgtgtcctgaccatcattgtaacatgggctcactttaaagcccacgcttgaaagctaaaagggtagaaatgctccatgaatccaagtaacacctctatagacctattgtggttgacagatccccagtttatatcttttattttgttttctctaaggcccactgcaatttaaaatttgagtctatgaatatacctatttcaagaattgtagctcatcttccccaacaagcttctgtttcctgtcttagatgtaaactggtctatgttcttatagagttaagcattggtcattatcactgatgaggcttttttaaatcaatacatttaaaggaatcaaggtcttgatagtctcttcagagcaaatccaaaggtagaagaaagagagaaaaggtaagtgcatctgtctcaaatatgaaaatcttaccttgcagattgctcgtcttattccctcagacattagctgcaagggggttgtatcctctggcatggaaatgtactggcagatggggtagtgctctcagcattgtacatttagttcagacataattacccagaaggatttctgctcttccattcaataagagtaaatgagcaattcatggagaatgtttattgcatttgacctttcaagataccacacaatttcatttcagtatgcagccttttatgtgaatttctttgtgttttcagagccaaaagccttgaaagtctcatctatatgagtacccggacagataaagatggcaaagggtaagattttattaagacagaccattttgattgagtcccagatggtgtactattttctggaggagacctcctgcttagtacaagggtcaggcaggctggtggaataagccttagactggggtccagggatagtgtgtatcttggtgctggttttgccaccaacatcaatctgggtgaccctgggcaagttgtgtaatttctggagagctctgtttcctcattccataaaatgaaggatatgacctagatgatctcccagttccccttcatatctaaaatggaaagaaacacaactagctgttacaagtagtggagaataggttggtttatgaactaaatacatttatattaaggcatttaggtgctgggagcatagcccctcaccactgaagtctctttctctctttttcttttctttaagacagagtcttgctctgaggccctaccttggctcactgcagccaccgcctcccgggttcaagtgattcttttgccccagccttccgagtagctgggatttcaagtgcccgccaccacgcccagctaatttttgtatttttagtagagatggtgttttaccatgttggccaggctggtcttgaactcctgacctcacgtgatctgcccacctaggccttccaaagtgttaggattacatgcatgagccaccacgcccggccaccactgaagtctttagagtgtataaaggcacttctcagttggaatcttagttgggtcatttcatatgtatatctcttcatacgtatttgtaaatacctttaaatgaaaagctatgcttttatttattttaaatcataaaatgggttaattgatgattagtaactgaactgatagcatttaagaggttgccttatagttctagcctgactgatatactagataattgacttacatgactgatattatttttcttgttgaaagaaaccaaagccgtgaccatttcactagagaaaatcccagaatagtcaagaatgacaaagggcaaggatttatgagatctctactatttttgccttccagattggctgtttactttgtatttggttagtcatgaaatttgcctttctaacatgagaattatttctattgtcacagttatttttaaaaaccatttatctgtgccaatctatgcccagaatggcattctagctttccaaaccaatcttggcgatgcattcttaaccctttatgatgtagaacacttaacaaagtctacatgatgaaaagcattggcagtaaccatcacacaggcttgttaataacatatgattataatgtaaacatgccaacatattatagacaattttttaaaaatgtggaatagatgaagttgaaaaacagtctctttttttttttttttgtacatggctatatgagctttctaggaatagatgaggttccagatatttttcaaaaacagtttggagagttctgcaaaagtggtagacaaaaggacaagtaggatgtgcatcttaagtagatcattttgtgggctgggaaaaagatttataatctgggataatttgataacaactgagttttggtgcaggaataactgatcttgtctgcatggtagggaaaaagtcctagttcttttttcttcttcccttccttctttctcacattgaaataacttaaaatgtcaacagtcttatcacagagaaatcagagagatgaaaatggcaaagcataatacttggaagcttgggggaatttaaagagattagctttcatattcgctaataatttttaatcattagcatgtgaaagttttatttcatttatataaagtgctgggaccataacagttattttgactttaccaaggtgacttcagaccctttaaacacatctgctaactttttaagagaaatgacttgtctgaattctcaaagtatttagacttaaaatattgatcaattgatttctacccctgatgtaaatgattttcatgcttaaataagacagtatctcaatatacgtattaaaattagcctcccaccaacccacctccaagaaagcaaaagccttggttaaaacttttaagttgactccatcataactgagtaatggttggtatcttagtctcaggctgctgcttatgcattttgcatgatggatagagccacctgaattcagtatttccaaggacttctgatcctttaggcactgattgtatcttatgagattctcttgtgggaaatctgctgttgtcattacgagagtctgaatatatcactgagttgctcttgcctcactctctctttctctttcttttcccccaatgttgtaaagaatccaaagccttggaagtccgattaaagttaatcaaaggactgacaaaaatgagaaagggtaagtcaatctcctaccttgatggagctctttttattcaggttagcttttttacctcattaggaatgggagtgttatgctttcctttgtggcagtgaactcttgtactgctttgacccatcagacctagtaggcaaaaggaatatgttgagtgctgtttcataggacctctgatttgagttacattgaagtaggtgcaggaaaacctgctacataatctcttattccgtattttcttaaataattaagagatgagtcaaattttaatttaaattaagaaatataaaggacaaaattgcacagcgagagccacattgagaagcctttctaaactgatttagacacatttaaatgaaatgctattgtggaaattactaaaggtaagttaaggataattacatcaaagctctttttggtcatttggtcctgaaaacacctgacaccacattcagggacattcttgattatacagatttcagagaaaattgtactgtaacctaactgacaagttttggtgttttttccaaagaagacaaaatctcgaatctgttgctaaagtgaatgccaggatgaataaaacgagcagaaggtgagaactgaacagatgtctctaaatattggttattttctctcatattaattatgtgatattgagggcaccacatctttgtttggcttctctcttctgtgtctaatccctggtgccctgatcttcacttcaaagaatctacagtatattcgatctaaatttacatttacatatagcccaataaaatcctaaggattaattaaactatgttattgattggcaatttttatactaaaagccaatttaatgtcagtataataattttctccaaaagcttgaattaatcattgggaatacagaagatgtatgtgtctaatattatgggaatgttttgaaactgatataaacttttttttttaaagaagtgaagaccttgataatgctactgaagtaaatcccaaaggacatgaaaataccactgggtaaaaataattaatgtctttaattatggtttctgttaagtgtcaatcagaagataaaataatttggctttttagcttcataatcgtgttttattagcatggaattagacaataaagataggccacacgaccatccctccttatccccaataaaaccactaacttttggagcattgtcttaatgtttgatagtaaattgcctttttgcccagattttgggctttgatttgtcttcagagtaagtgactgaattgaatttctttgtgcctaaagaatgcacagtcttgacaaaattttcaaagtgtatttccaaaatgacagaggtggccaagagtgagccatcattggagctctggtaattcagctcctctaagggtggtggtctcaggagacagcccaggtgaggctgggctggcacacacagggggagtgaggacctcccaccactttttctcctattcagagctgtgttgacatggcagtggcacccaatcgcagtgcttctgtcttcccctcctgtcccttttagattctgctgctgccttttatgatatcaaagtattttaatggggtggcctgtgtccccctggggagtgaatcattaatttttctactacgtgagctgttttttcttgcccttttttgctcaccatgatccatgatctactctgaaggaaatgatatttaaaagggtttgggctaggtagatagctgagtttatatgaaagcatacgttcttattcttttagttaatattgttaaattcttgttattatgaaattatgattctcaacattattcttactacttaaaacagaataggcaattgtatccagtttattgagtagaaatttatactgtctgggtccagtgtagaactcaatctaacttaatgttatttcagtgctgcctgcttggagtgttctaacaagatgtatctgaaggcaaagttgattttgttaaataacaagtttcatatatacttaggtattctgagaacaaaacaaaaaatcagatttattactaacaaataagcaacattaaatggtcttcagctcaagttgtaagagaatattttcattttcttttagagctttaaaaatttacattgatatagaaaacttgtatatttaccacttcttaatttttccagccattattcatctgattagtgctatattttaacatcattcattaaaattaatttcctttttcaaagaaaaaaagaccttgatgggcttattaaagtggatcctgaaacaaataaaaatattacgaggtaagacatttaaagctcccccctcccctttgtttggcatttagaaggacgttagaattctgagtgttggtattcaggacagtaaattggaattcaggccaaaacaaactgagctcttttttctctaaacacttcatagtaagtaattctgtgcaagtgatacacctaaatctcctgcattttattcttgggcaaagtttgttatcaaataattttgagaaattaaatgggaatttgggctgaccttctctactgaactaaatgatttatttctttgtatgctagtgtgagtacatgtattagtgtatgtgtgtgaatatataagtagtgtgtttatatataagtgcatgtatgtatgtgtaagtgcatatgtatgtagatgtaagtagtgtatgtgagtgtatgtgcatgtgtatcagtagtatgtggatttaagtgcatgtgtgtataaatgcgtgtgtgtataagtgtgtgtgcgtatgtataaatgcatgtgtggatgtgtatatgtatgatctacatgcgtgtgtgtgggatatttgtgtgtagtgtgtgtatgtgcatgtagtgtggtgtgtatttaaagatgaagagcttaacaaagtgtgctttgttcttacccatgagttgtcaagtaagtctggagagcttatgtcttcttgctttttatttcttataaggcagatggaatatttttgaaactgaatttgttggcatgttgctggaaacagtaacaaacaattgcatgtagtttcccttgaattcctttccattcagttagctcagttcataatattatttgttgattctaacatgtgtcatggatgcctgcaggcccagttgggagggcaaaggctcagttagttgaaaagctggtgtgcacactatcatgcctgccctgtttgtgtaggtgtggcatggtcagaggcaccgcgacccaatgaattcaaggcttgcacaagcttgcaacccatagaaggagaagaaaacattgatttccttcagtacctgggtggttcagggaggtaacctgaggtagtcagtgcgagcagggaatccaaaaatcctatattcgaattctggctctatcacttgctgactatctccctgtgcctcaatttactcatttacaaaagagggatcataagattctcatgccgggcacatagtagatacaagtaattgttgcaacaataaagattcaggtgaattatattttcatcataatttagtgttcaaatatttaatttccacttgccaagaaaaatccatgttccttttctaatttttattaaaaataatatttccaggccgagcacagtggctcaagcctgtaatccaagcactttgggaggccgaggcgggtggatcacgaggtcaggggatcgagaccatcctggctaacacagcgaaaccctgtctctattaaaaatacaaaaagttagctgggcgtcccaactactcgggaggctgaggcaggagaattgcttgaacctgggaggcagaggttgcagtgagccgagatggtgccaccaccactccagcctgggcgacagagtgagactctgtctgaaaaaataataatatttccaatcaggacttatttttcttcatatgttggtgtgtgtatatgtgggcatgcctatgcttatgtgtgtatgcatgcatacaaatgtttttgtgcatgtgtgcattcatgtgcatgtctacatgtatgtgtctatatgcatatgtaatttcccatgtacatgagtgtgtgcattgcatgtgtgtacgttgtgcatgtgtgattgcatatgtatgcacaatgcttgtgttttcatgagcatatgtgtaaatatacacatgtgcttttttgtgtatatgggtgcatatgtacatggatgtgtatgtacctgtgtgtgtgagcgtatgcgtagtccttatggactctatgaactatgagatttaaataaccttattttattatgtgctttatttaaaatttaaagagatcaagtcctaaaaatatagttaaagcaaaccccacaaccaacacaaagggagggttgtaatgcttaccgttttgttatttttttgaatacacaagtctggaaatagcatcctgggaattttatttttctcagtcactggccttcaaatcccacatacttcatttaggcagaaatcaacaaggagtaatctggagtagagtgattgcttctgtggggctaattgttttattatttgcataacaaaggttcaaagtaattattgctactttgagtctgtatatcacattctcagacatctggatacaaataaaagacttgaatcagcatctagttgcttccaaatatctgtatctttgatgttgtatagacaaaaccttggggcttttggacatggccttaatagggtcacagagtatggagacgcagtgcaaaagggccttcctgtggatgttcttttccctatgtggcatcctctgtagatcagagcagcatttactgctgctactggtatgcagaaaacacatgtagatgcagggagaaaagcaaaattccactaagatcagaaaccgaggtatactaaagagtaacaagaaactactaaaatgttttcgatgactgtgtggaactttattttattttatttatttctgagacagggtcttgctgtgtcccaggctggagtgcagtggtgcaatcacagctcactgcagcctcaaaagcctgggctcatggggatcttctcacctcagccacatgagccacatgagtagctggagccacaggtgtgcaccaccattccaggctaattaaaaaaaaaagattatggagacaggatcttgctatgttgcccagtctggcctggatctcctgggctcaagcgatcctcccaccttggccttccaaaatgctgggattacaggaatgagccaccatgcccagccagagtgttgcgctttatattacacttgatattactgtaagatattacagttgatatatcttacatttcagaatgtttcagaactctgtagattttaatattcctattgtttgttgccaaaaacaactagtcaaaattcataattctaacacacagttataagtaccagaagcaattactgggttgcatatcatagatttttaacaaattggtgtattaatcttaatacagttttgtgatagaaaaatctgctaatgaatgccaattttacaaaatatggattctccaaagctggttttaaagttctacatgttggaggttgataaagagtatgccttctggaatgcttcatgaaacaagtatatagactaagttacaaaaatgttttgtgcacctggtaaaagctaaaattatagcatttagtgcataaaagtagagagaatcctagtgcaatacttgctagcggccaaatggctctgagactaaaataatgtctccctgagtctcaatgaatttcagagatgtacaaatccctacatatttctgcatagtcacctttcacaatcttcagtcttcaactccttggcatgatctcaatgagtgtttacactgcttctgagttttaatgaaatagctttatcttcttgttgtcagtctaccattgttacgtgttgtcaatcttaaccatttcttcaatgttttaaaggggccagagccttgataatctcatcaaagtgacccctgaagtaaagagaagtaaccaagggtgaggactatgtcttacctctcttccttccccttccccatccatttgtggcactcaggaaagaagatgtgttgaaaaacctttggattgggatcagaaaggctgaaccccattacttaccagcttggtgtctttgaacaagtcccttgaatgctgagcttcagcctccttagttataaactgaggatcataatgtttgtttggccgggtacggtggctcacgcctgtaatcccagcactttgggaggccaaggtgggcggattacttgaggtcaggagttcaagtccagcctgtccaacatagtgaaaccgtgtctctataaaaaatacaaaaattagccaggcatggtggagtgcacctatagtcccagctacttgggaggctgcgacaggagaatcgtttgaacccaggaggtggaagttacaatgagccaagatccagccactgcactccagcctggacgacagagccaaacaccatgccaaaataataataatatttgttttttgtcacttgatagttgttaggaatgaatgaaataatgggtataaaatccattttttaaaaaaggatattacaaatggaaattattaacaaaacagtttagttatagctatagcattagatggaatgcttaggggaaccaggtgagaatttttagcagattattatgtcactcattaactgattttttttaatggcgtcttgctctaattatatggttttattttgggggtaaatgagaaactacgtcagtgtaccagtgattggtaagaaggtcacaaattttagtcttttaaattaagagcatagactggtatcaatttatctcaaacctcagtagtaaaatttatcttgagtacatgtatcctttaaatcaaaacagtcaattgatttaattccatttttatttatcatgttttttgtttttttgtttgaagttccaaagaccttaataacttcatcaaagtgtatccaggaacagaaaaaagtactgaagggtaagatttaataagctcccttttttgtttcatagtaaccaatgcctaaaagtataattaaagcatcatttcagctgactgatgctgaacccaatgatccttcaagaaaagccatgtaaccctgctacctcacatctgaaatgttaaaaattttggtcaaccaatttctgatacaatgagacaattactctttgactaatcaggaataaagttgttttcccaggatggactggacatttttattcattgatttattatttttcttaagcagaagggatggatgacacagtagaggggaaagagaactagaccggaccccatagttgtgggtctaggcctgtctctgctcctcttacctgtgtgtgctcaaactagtcacttctgtttgggcttcagtttctcatcctcaaagtgaggaaattgcacgaggagctctcccaacactcccaaatctaattcagttactaagttccaatagatatttggtgtcatggtaaggcacaggcattctgcagccagattacctagctttaaatcccacctctgttaccactagccatgtgggaaaattacttaaggtttctgtgtctcagttattccctctatgaaactggaataataatacttcctatgtcataggattgatgtgagtattaaattagacaaatcatgtaaatcactaagaagagtgcctggcctgggacatcaaacattttctagaagttcttattcattatttctctccagttttagttaggtccctatatgtatattcacagtcaacactgaaaacccccagccctctgagatgatctctaattttattattttaataaatattttataataaaagtatttctctgttttaacaaacacttgaaaccattcgatttaaatctaccactgatctgattttctatgtttttaaggggccaaagtctcgacagcctcattaaagtgactcctgaaagaaacagaactaaccaagggtaaggtttatggaactctctatttctcccccctttttttttcctaatgagcttaaaaacatgacaaattgtgcggtggcttacgcctgtaatcccaacagtttaggaggccgaggcgggaggatcacaaggtcaggagatggagaccatcctggctaacatggtgaaaccctgtctctactaaaaatacaaaaatttagctgggcgtggtggtgggtgcctgtagtctcagctactcgggaggctgaggcaggagaatgacatgaacccaggaggtggaggttgcagtgagccgagatggcaccactgcactccagcctgggcaacagagcaagactccgtcaaaaaaaaaaaaaaaaaagataaattgcattgtcccgccatagagacaaccaatgatgggacccaaatcaacagatcctgtgtcagaaatctagtgttcaagcacttaccgaaggctctctggccacaggagagagaattccttgaaagacaggaatgatctcttaccagtatgagattgtgttccatgctgaggatttccttaaaaattaatggggattccccatgagacaaaacatcaccccaaacaatttccctgatctaagtagcctaaagaaaggtcttcatatgataaaaaattcttcctccttcttcttccatcatgtattacctctcttcttattgtctaccacccaaacaactcttaaagttgggaagtcatttaaaaaattattctcagttcattgaaaaaagaatgacatttgtcttttatatagaaagaatcttctctaagacatatcatgttaagtaaataaacaggcataacaaaaccaccagcttgtaaatgtatattgttatatgaatttgaacatgagttagatgtaaaagataccaagatatatatcttctctcagcagaattcctatcttattttgcatattggaatacagtctattttacagtatgtggctatcaaacagagcttatttagactagatcagaggtcagcaactttttcttaatgggctaatagtaaatagttctggtttcagggacaaaattgtctctgtttttaactagtcatctctgccaatagtgtgaaagcagccataagtaccttgtgaacaaatgggcatggctgcgtttcaataaaactttatttacaaaagcaggctgcaagttggatttagcttgagggccatagtttgctgacccctagactacacagtattttatttgagtgtgtgaagagaatcaaatctgactgtagttgaagtggattctgaaatacagcctaccacccccctgatttggcatatattaatacaactttatttttactgttgagggtcagacactaaatccagagaccatataattacattacacattaagattcagtgaaagacagttgccttttccctctcccgagatgacttagtttctaaaggtgaagatggcctgattattcatggcctttcctttataatgtttgaggctgtattttggtagccacatgctgccatgtattgcatttggttgtgtgtttatttcttttacttggtagtgagattttttacttcagagaaccttttgctagctgtgtagtcttggacaaattgcttaacctcctttaagcctcagcttttttatatgtaaaatcaggattgtaagagttaatttcttcctgagtttctagaaaaattaaatatgatcatgctcgtgaaacacttagtgttcaagtgcttattagacattatctgttagtattattattactcttacaattttttcttcattgttaaatccccatagcactactcaatgtgaagaagatagcaaataaattttcctgggatgttgaatcttatgaaattactgacattcaattatttttgaccaacaaaatggcaattttaaacagttcaatgtaatagaatatagtaatttacatggaaggatacacacatgataaaatgaacctatagattagtcctaaagattagttaaaagtctttccaattattttctctccaggatatataacatatcatccaataataaagtgtaacaaattaggtttcctattcaggtcttttggtgttagggttggtatcattactgtgataacagcagcatctctgtagagctatgaatgcctatgtgagtgtttacaataaaaacataaattctataaactgaggccttgcttgtgctaattcagctttgcacgaagtgtgattctgaactgatttaatatcttggggtagtgtgaatattacatatttatattgtatatattacctgcataacttagaataagaaaataactgcttttttcttttctttttttttttttttttttttttttacaaattatctcagtttttgtttgttttggaagaaggggagcaaggaacatatggaaataatgaataattttatattttctctcgctcattgtaacctccagaaaatattataaatggtttaattctgccacacagataaagtatgtaaaataaagagtttaggaataattctgctttgaggttaacgtgaaagaaacaaaaataaaactaaattaaattatcatatatacaaatgtatgcaggaaatgaattgatagtagccacctgtttttacataaggctaaaagtttaagtatagatgaagttttaaattagcaggtcatttgattaatattaaggttgaaaaaatatacaaattattggattttagttgacttagctattgaaacttaacatttttttaggaaccaagacttggaaaatcttatcaaagtgatcccttcagcaaacaaaaggtaaacttattaagataattgaagacttcttagcaagtcaccaatttatgccccaaaataagattaattatttaactaaagacattttgaaaggggacatgaaaaaaaatgagaacaagttgatgtgtaataatgctggatagatttttctgtctattattgctttcattaatttcattatattattgtagaaaattataatattgaagctaattctgtgtaattactactttagaaattcctttgacacagtaacagcataactagattataaccataagttcatagttaataaattacaagttcataaaactgaacaaatcagtaaatattggctttctgttctctcacaaacacagggattaatatttaaatgacttgtgaaaaaactgacaacataatattcttatacttgattagaatattttttgcatgacattgaatttacttctgttcttgagaaattaagatccattatacactggacaaaagttaataaaagcatggcagagaaaccccaagctatcactcattgaattattgtgaagataatgttggtgaaaagcattgtgtggatgtaagggattgttatgaacatgagacagagggagggtgttggggaaaggagtgtggagtttggggtccagttgctgtggttggaattttggttcaccctcagtcacttaggtatctggccccagggagtgccttaatccctctgaaatgcaatatctttgtttataaaggctgtgggggtgggggcggtggtgttaatattgatgtcattgagttgttgtgaggattaaaaaaatggtaactaatatatataaattggaaactcagtaaacttatgagttcttacactaggattctattgaatgacttgcacctgtcaaaacaaaaaagaaatgccagtatgaaatttgccgatttcctctaattttgttttagcagtgaacaaggtcttgatgaacatattaatgtcagccccaaagctgtcaaaaacactgatgggtaagagatggatgtgatttttgttgtgtttctcgttaagtaaacccaaaattaatagaaatgatttagaattattctatgggcaaattgaatataaatctcaaaatatcatcacaggtggaaacctagatgtctcagtatttgttaattgcaagaaagagagacagctggaaacaatgtatggcggtgctttctcttctctaagcctccagtaaaggaattgagcagagcgattggacaaatgggcaggaaggagcataggtagtctaggagctgctgctgttttgttttgtgtggtattgaaattaatacttttgtctttgaaattgatgataatttattaatggtagttaatttttaaaaaaagacctagacacttccattagactaatcattagcagtatcattcacctcattttagaagagttttctggtagtcagtggaaattttatgaggttcattattctttagagatttactgtgctcagcaaggttatggacctaaagtttaataattcttgaagtaatgtcagtgagataatgaaactcactttttgtctatggttaaatgaagacaatatcattacacattactgttttatatataaatatatcttaagaatggttttacgatttccccttttaagttttgttggtacgtatacaaattgtaaaattttagagatggagggaatgaaccttaagatatcttggcccagtagtttgaataattttgaaaaccaatgttccagatgaatctatttattttgcagaagaggaaattaagactcagaaaggttaagtgatttgaccagggccacagaaaaaattagtggaagactgatagtagttctatgatctcttaggcagtgaataattactgagcacctactgggttcacagcttacaactaggtatcattacttgtacattaggtataattataggttgtggaagccaaaaagagaattcagtagacatagtcaatcttattaacagcaggcaattaacatagattaaagctaattatgtaccaggggcacagagatgttacaccaagacaataataggttgtcagtttaatatattacattttggagcactcatgtactgcttgctgaatatagaatatattgtccatgagttgcattcttaaaaaggagacatattgaagagctaattaataaacacagaggcagtaaaattcatattcatggagtcctaggaggagatgtttggagatggacagagccttggagattatccaattcaatctcctcatttacagatgagaatactgagaccaggggcaaaaatctcacagtcatctgtgagatcttctaactcccagcccaactcctagtctttacatcacagcacacagactttgatcttaaaatatataaaaattaattaagcgccttggaaaatagcaaaggctgtaaagataggagtgttgctcttgctgtgggatggccaggacgtgttttttactgttctcacagggttacttgaaagaatacttcatagattacaatggcacaaatgtgcaaatgattgcaaaacactttacagcttttaaactgcatgaaagtaataataacctaaatatcctaatgtatcctttactacattcttaaagctaaataaataaaaacagtaacttgagagaaaaaatgttacattttcctggataaaatttagacatgcatgttttgcaggatctagggcctgaaaaaaatctacatatttgttgttttcaaaaattgcatgatgctatcaatcaaggcaattcaggactgttcctgagatttttgttttattaacacatggtgttgcctttataggagtggtggtagaatatagcatatatttatgttttctaagctaatgtttctcaaatgtgggttgcaactcattaaagggtcttgtcattaatttagtgaatggcaatcagcattttttcttaaattaatagaatgaactgaatagaaaatatgagagttcttaggtagtaagaatattatttcataaaatttatgtctctctgtgtgtgtgtgtgtgtgtgtgtgtgtgtgtgtgtgtgtgtggctgtctgtaaaagacagtattaggctgtgatgtaaaatgtatttcttattgggctttatgtaacagtggttagaatatcattgttctagattattaggtaaattaaatttttgtgctcagtaggacagtgaaaatggaagttctagtggattttttttatgttacttactcttaattatgctgacacataaatattatctgtggttacactaaccaatattgtgattaattttatatttttttaaaagtgtggcttttgagcatactgtccactctacaaagttttattctttgtattttataataatatgtgaaattaacctcattttaaagactgttgtctttctgacacagtttagttttatgacagattttgccatcaatttacataaggagattatgttgtggatagttttaatatatcaatcattcttttaatagtatttatagatatcaatttattatgttcaattgaaaatattatcatagaagaaagctcaaaacagtgaaaattcagttagagcctttccatagactatggagaggtgagaaccatgaagaataaatcaaactaaatgaagccctgaacattctattgaaaggttgaaggctggggaagaaaatgcagaccttttctcagaccttctgatgattcatctctaaatgacgctcttttggtccctaaacttgcatcctttttttttttttttttgaggaataaaatgtattttatttttatataaggaaaaagcattgttgtggtgagaggtacatctagattgtttcccagatggtactggaagcaggttttgtcagttctgcagtctcttgccatggcaactgccatgtatttctctgaataagtatgaaaatcagttcagaagaacactttgaaaaatcactactttcccacccttaaaacaaggggttatgctgaggcagtgaattatagcaaactatataagaggaaacactgttctgtggctgagaagagaaacaggaagagtttcaaatgggagcggacagttttcagagtatgtaactcattttactatgaacagctgagtttaattcagtttttcagccatcaaagagggaagaaaagtcacaattttgatggattgctggacctgtctttgctaagctttatattaagaataatcctcaatttagagtttatcttttaaaaaagtgatgtccttagttggtgaacctgattttaaaaataaggatattaaaatcagctggtatcttcataatgttaatacattcaagaatgaacaattgtcagttatcagatgtttgctatggtgacttaaccagcctgcccttgtagataggctctgacaagaaaatgtatgaaattagagtaagttttcttctgataaagcataattcttcatcccctaaattggttagaaaacgtatttcatagttagtcaatactaaaataatatgtctcatactattatcctttctatccatttccaattaccttaaacctgtgattatctctaacccaagttgctttaatattttttccacttaaagaaaacaagatcttgataaactcatcaaggtgaatcctgaaattttcacaaacaaccaaaggtaataaaactatgttgttttaatgtactttggtcagaaagaatattaagttttattattacttcaagcagatttataaccttaatgatattaccaaaagaacttcaaaattaacctgctctcattttattttttgatttaaagaaaccaagatcttgctaacctcatcaaagtaaatcctgcagtaatcagaaacaatcagaggtatatatagaagcagtcaattcatgtttttatttgtctgttgccctggatgaagtggatttataatgttgctttattgacctagcacaaccccaaaatctattaccaatctgaacttttttctctctctcttttaaacagccaagacttggacaatcttattaaagtgaaaccttcagctcttagaaacactaatcggtaaatgacctcgactatcttgacatgtttacaagtttctagggtaggaacttctccctccctccttgcctccctgcctccctcccttcctcccttactcctttcctcccttcctcccttttttctttctttccttccttccttccatttcattctatcacccaggctggggcacagtagcacaatcatagctcactgcagactcaaaatcctgggttcaggtggtcctcctgcctcagcctcctgagtaactgggactacaggtgtgcaccatcatgcccagcaaattttttaaaattttttttagagatggggtcttactagttgcccagggtggtctcaaatttctgggctcaggcagtcctcctgcctcagcctcctaaattgctgggattacaggcatgaaccactccttcctatcctttttttcttttcttcttttctcctttcttccttcctgcctttcttttgaaggcttttagttttctttggtgtgttaaatgaggctacatttatgacccatcccatgtgactcctgtcaacaaggaaacaaggaaacatactgcactcttctgaaatcaatcgcactattttgaaattagttctgggcttcttatttgcactaaaacaacttagtgtttgttgtctacagaaaatagagttttaggactgaaatgaaagaaatgaatacaattaaataaggaaaaaagatattttgaagaagttgaaccaaactaatggtttatgtggatgtctgtaaaacattagaatgcatgtctgtagaacattggaaagaatattcatgatcttcaaaatcctagatccacagctagtgtgggcccacaaaatattaccaattttaaccataagcttccattttacactcttaagatatcttataatttgctatttgatatctttcacataaactgctttattaatggataataagtaatagataatgcaaaagagtgcactgtatcagaagtccaaattgctctgctgacctgaaattgtgtcataataaatacattgctggaaatagtagtccagtattctgaaaggacaaaaagaaattaacatatgacaaagtactttgaacccattaggagaaagaggaaagtataatccatgattggcctaactcttacatctcctagcttgttttctatctgagtatcatattttcttcttgctgttttgttacttcttcagcacccaggatgtgactggcaattcatgtacatttaatcttcacaacaatcccatgagaaatctattcatgcaccctattttgtagaagaagaaactatagttcaaaggtactaaataaccttttcaagaaagaaagtacaccctggacttaaactcagggacttctgatgtcattacctagaggaaaaacaaaggatctgtggttaaatcagctcagactctcttcttctttccattcttcatattccctatgctcctcttctgctcatacacagttaaaggagtatgatcagatgtatttattctggaggattattgttaaaatgacagtgaggaaagaaaacacttgctgcatgcggattttctaaaagctgaaataacagtggaccctcctgctgagaatcgtacggaaatatctttgttaagtagagccctttctttatagtggcatttgttgggtggatttttctttttatcagtaacagttttaggaagtttccaatcatgttgaaagtggttaggttcaataaccatgttatgtaataactgacagtgaaaaatgtagtctctcactttctctcccacatccccttcccaacccctttcctccctcagtccctctgacaattgtgctttgttgacaatggtaactttctcagaagagttttttgccttttgttttattagaagaggccaatttggtagaaagttagtttgtatttcagcaactcctaatgaaatatccgtagaaagacgacattttccgtatacagatatgattactataaaaaaatttaaaaatattggctatcgtgtggttttaagatggcggcttgattcacaaatctaacctaacctatgtctaattattctttagtagtatgccagatttgatgagaatccactgggatgttcaagaattatcacaaagcagacaaacaggaaagactgaaccatctatttgaaaaaagtgacttcattcaattggttcagccacccgtatctgtaatctctccattctgccctcttgattttaatgcagctataaaggagagtattttaaaagtgcctcccagtaggaagaacagtcacaaggcactgttatatcaattcagtgtgacacaagccctgattatttaatagtataacagcagtgaatcagagttctttcatctgactttgctgacatttccagcagctgtatatttaattcacagttaggggctgaacaaactacagccattgatcagaatgtaagcaggcatccttgagcttcttctaggaacaaatacagatgtgcacaaaattttcatttattcagtaagaatttgcatgacttgtagcagtaacagtttcacattttcatcaaccagtgtcaaagagagatattcagttattggtagcctataaactgtgttagactgattattaaaatgctacatttctgctcctgaatgaatattgaaaagcatctagtgacaccaaggcctttatagttagaaaaggcatctttcatctaaagtagaaaaaaaaaatactcttaactgtttgtggcattatacttccatcttcttaaggatttcctatttgttaagacatccccaagtttttagtattccaaaaagagaagagttccttcctaactatctattgcatatttttcatatttctgttaacataaacttggggacaaccttgacgctttctggtgtttcattccccataatcaatcaatcagtcactttggatgcatcacctaataatctcagggagtggtccaagacagttcatcatacccactggtactgtagtccagattattgttcagcctcctaacttgcccctctgctgccaatctccccttctgcccttcaatccattcgccaccctgtagagtgattttcccaagacacaaatctgatcatgtcattctgattaaactccttctgtggctccccattgccattgcataatggccatgctcctccttaacctggtctctaagcccaccacgatctggcatctatgggctttcccactcccgtctattatcgttctccacccaaaagcaaaccccacccacacaccctctaacttgcatactcctcactcctccttcatcgctattgcttggctaacttctacttatcctttaggtatcagcttaggtgtctctcactcaggctctgggaagcccccctgacccaccatgtgtgcatcagatgcttcttctagatgttctcgagctgtcttttctggcccataacattggtctcttcgagggagttattatttaatcatccctttttgactataaggtctttaagggtaactacggggtctgccttgtttatttatttacctgtaatgcataatgcaatgcctggtacatgttaggtatttagcacatattaaggataaatctcaaactcatcaatgccttatgatagtccacttagagaaagtctagccttccagctgtgacattctgagcccctatgagtgaaacaagatgaaaagaatcagatttcttatgactggtctccttgcttgagccaatgactatcttttgctcatgacataatctcaataaactatagtgaatgggagccactgaaattcttggtcgcatcttatttttaaaatacccaaattgcctaactgctctgtggacctgttaatttctttaatactaaatctttaagactccctcactgaaaagaattataaaaatatgtaaaactctaaagagttgggcccattttgctatgttaataagttgaggaattataccacttctttcactgtattctctattcctttcagaaagacagatattccttttgaactaacgcctaatgcctaagatttagttcctggcgtaaaaggaataccatagtaaattttttatatgaagactcttaattttgtaaatgtgtttgatactctataaaaacaatttaaatgaactgtatggtgagaaacatattgctgcctattaataaatacctcccacacccacatgagaaaggaagaacagttaggagtgagctaataagtttctcatatgcagagcttctcctaggaaaagttatatagtaagagacataattcctgggtccccagaatctctatttttttccttcacctgctttgtaagacagtgttatagtttttgatgtggtagtagaaaataaatgacattattataacatggataaattcttatactcaaaaattgtcctgtggctttagctcatagataactcacatttctccccaaatattctgcagtctacattttaaaaacattattaggccaggtacctgtaattctggtactttgggaggctgaggtgagaggatggcttgaggccaggagtttgagaccagcctggttagcatggtgagtccctgtctctacaaaaattaaaaaatttagctgggtgcgatggcatgcaccggtagtcccagttacttgggaagctaagacgggaagattgcttgagtccaggagttcgagactgcagtgagctatgacagcaccattacactcgagcctgggagacagagctagaccccagtctctaaaaaacaaacaaaaaacattattagttgcaatagtcagtaacaatttgctcttcaataattttctgtaactacagaaagttggtgattttcttagaattaattccacctgcccataaatgtataaaattgtaaggtctgcctgccttctacaccaccgccatgaaaggggtttggaatcaagcctctgcttaaccctgcagcatttggctgcatttctataaaaatctatttttcacagttgactcacagttcttcatcttacaccacagtgtaaaagtcattatgcaattgatgtggtcttaattaaagaacaaaaatttatttttatctcctttaacttggaaagcttatgagcagtctgtgcttcttttactggatcttcaaatgtagctgatggcatcaatcagagtgaatagccaaagtaaatacacactttgtacttttcttcttctagaactttctattttgcattaaatattagtgtagattattcagattaaaatcttggctgctctgagtgcggtggtgtttactactaactactcacaccagttatagatttctttgttccttttccacttccattgcttcacttgactagccttaaataaataaataaataaatattactctaccaaacctgatatgtggtactgtttaataaaataagaaaaatgttatgaaacaaataataatatagtttatttggtgatttgcaactgtaccactttggaaatgtgtttctttgaaggcacgcataggttgcaattttgagttatctatctgtagttgttggatttttaagattctggcttcttctcctttctcagatccaaaccattctttctccccctcatgaaaactaaggtacaaagaggttgagcgacaggtgggcagtgtctacagcagccaggattatgcagtatctatagcagccaggagttgaaagccaggaggagttaaagatgtccaccataaggctgagaaaatatatgtaatcacgttgtgagggtagaagcagacctgtatttatttgttagggctgcataacaaactaccacagactgggtggcttaaagacaaatatttgttgtttcacagttctggagggcagaagtccaagatcaagctgtcagcagggttggttccttccacggagttggttccttctgaggccaaaagagaagtatctgtgccaggcctctctccttggcttgtggaaaacttgtcttcacttttttttttttttttttttttgagatggagtctcaccctcttgcccaggctggagtgcaatggtgggatctcgactgactgcagcctcctcctcccccagttcacacaattctcctgcctcagcctcctgagtagctgggattacaggcacctgccaccacgctcagctaatttttgtatttttagtagagacggggtttcaccatgttggtcaggctggtctggaactcctggcctcgtgatccacccacctcagcctcccagagtgctgggattacagacgtgaaccaccgcgcccagccagaaaactgtcttcactttatgtcctcactttgtcttccctctgtgtgtgtctgagtccaaatttcctcctacagagacactgtttgtaacttgattacctctgaggacgcttatctctaaataagttcacattctgagctattgggggttaggacttcaacatatgaatttgggggagtacatagttcaacccagaacaagctccaaaggtaattaaacaaagccaggactgagagctgtgcaaaaaggaaagaaatataatatatgcattcaggggtgaagtaaggcaggtcctgggtgatggacagacatggaggtgaaatgtccataactggctttactggtcttttttccacatggatatggtggacactatgtccctagatatagacagaccagacaatcttaaaggttaatggtctaggctaatactttccccctggggttcctttaatatcttttctcagagctggataaggttgtaagaggtttccccaaaaaagaaaagataatttaaattaattccacaaatatttatggagcagctactatgtgcaaggccatgttaggccatagtaatgtgaccctactctcaagttgtaatgaaagccaccagtttccctataaaactggcactcagttcctctagcattagcactggaaggggaatcactttgagaaacaaagttctaattgcccaagagtcacacctcctgatgatcttccactatttaccactgcccaccatcccagtttgacattcctaagaaattggatcatggaataccatgatattccctttaattttattccactatccccaaatattgagtaaagtattacttaaaacattaaggggaagatctcttaatggccaaggttgttaagatagtttagtgaccccttatgccaagaagatggctctagtaattagtggagaccttcaaggattaggcaaatcccaagactctagtcactatttctaaatttgcaggatttatgctgggagattatcgtactcagttcttgcagttatgtagaagaattcagttttgaattttacatcatttggactgcagagccaataatttgatacttccgagctacttctgaaacctagtactttttacctgcattaattggcatagttccactgtaactcatttaaaaagtaatttaccctaatttctacagtttcaaaagtatgcagttagtgttttaaatgtgaggcttaagtatggctagggaatgctgccgaatttgcatattttaccaattattgttggcttggatgttatgtaaaaagagtattaaatctcaccccacataaacatgagaacattttatcatattttgcatctttatcaatatttgtgagtgagagtctgtatactgattccatgtataataaccttatttgaacccactatttaggaccacgagaggggagatttttaaaaaacagttaattccaaagatgtgacaatttaggacagaaataaaaatgtgaaagtggcctctcaaaatgtggaatcaatagtgtcaactgcaggatcacagcactactatttttttatgcttattcaattcacccacaactgtagtcattgtgtgtattagtctgttctcatgctgccaataaagacatatccaagactgggtaatttataaataaaaagaggtttaatggactcacagttttacgtggctggggagtctcacaatcatggtggaaggtgaaggaggagcaaaagtatgtcttatgtggtggcaggcaagagagcttgtttaggagaattcccatttataaaaccatcagatctcttaggacttgttcactaccacaggaatagtgaggggacaaccactcccatgattcaattatctacacctggctccacccttgacacatagggattattacaattcaaggtgacatttgggtggggacacaaaccatatcattgtgccatgaattttatttacattaacttactcattctcaccacaattgtatgagtttggacattagtgtccttctttacaaaatgatatggtttggctctgtgtccccacccaaatactatctcaaattataatctccacatctccacatgtcaagggagggacctagtgggaggtgattggatcatggggacagtttcctccatgctgttctcatgagagccagtgagtttccatgagatctgatagtttaaaagtgtttggtggttccccctggcagccttatgaagtcttatgaagaacgtacttgtttctccttcaccttctgccatgattgtaagtttcctggagcctccctagccatatggaactgtaagtcaattaagcctcttttcttcataaattacctagtctcaggcagttctctatagcagtgtggaaacagactaataagcaaaataaagtttagaatggttgactaacttggtcacagaagtaaggaaaaaactgggtctcattgttttgacttctaaacagtgctcctaccctattaacaaagacgtttcctaactcatgacaaaagaaaaaaaaaagaactatcaatgttatacctaatatataaataacataccagaggatcttgtatctcatgaaagggtgtcaaatcattaatgcagcccaagatataagaatcaaattactccatttcttcccccacataatgaattatttattcaaattttgtgttgatttcccttgtttctgtgatccccaaagcctaaataaggtctctgggtaaacatctaagaattgatttcaggtgggcagatggcatcatctcaaatcttgactcttccaaaaattaattaattggccttggaaaatttactttgcctgtctgagctccagatgctgttctgcaggacttttgtgagatctgaatgagataatccttgtgaaaacacagtacttcatgacacaaagatagtactcattaaatgttagctgaaaagaagtcgattaatgggtacaaatatacagtttgataaaagaaataagacctagtattagatcagtagggtgactatagtttacaattattgattgtacatttccaaataactagatgagaagacattgaataagtctagcataaagaaaagataaacatttaaggtgatagatagcccaagtacactaatttgatctttacaaattatatgaatgtattaaatcacacataccctgaaactttgtacatctattatacatcaataaaaaaagaaaaatgagctgaatgttaataaaaattagtgatttcttttcagatcagatttcccaaaccttccaaaaagttagttctttatttctctttcacaatgtaatccatacttccatgtttgatccatgagttgtatggatcaaatagctcaatgtcagatattcaatctcccatagcctgatagaccacaaatgactgtgtctaagattatgtactgattttaaaatgttttagcattttcttatttcctatcattatgttgtaattattcatatatatatatttttttccttagagaccagaacctggaaaatttaattgaagtaaattctcatgtgtctgaaaacaagaatggaaggtaaagcttattataattcactttttttcttatgagttctatatgcatctgcatatattgtatagccttagaagattatatatataaaatataatattatatattatgtaatatataatttggatagtgtgtatgtatatgtgtgtatatatatgtgtgtgtatatatatatatatatatatcatccaaatacaaaaatttacaaggtgcttaatagctaatagggaaaaattaatataattcttattctgttagaatttctgactcagggcctgctgttctattgcttagtgtaaatggcatcatggaaattcaaagctctttggggctgtgaagatttatttttacttactgttgcttggtaagctctcagcagtgcagaaagcactctgggaatctcttccttggatgcctagtgctaaaagaatgcatgaatttatcacagccacaaaacaggacctaattttgaaatttctttacaccatagggtataatagctttaaaactgtgataccttattggccattacaagaaaggttaggacaggagctatacttcatttttgtcacagactgtatacttcaggaaaaattaacttttccatgtttagcaattcttacccctacatatgagggaatactaaacacaataggttaccattttcaccttcataggtgcagttaccttttctattattttttctatgaaaagaaatgatattgcgatttcatctgcagagaatggaaaagctaggaaaagagctggctcatttttctttttcatactgtctctaaaaggttcctgaatccgacaggtagatagtttctttccattcctttagttccccaaaacatcttcttccttctgtttgtgaccttgagaaagtctttgagagaatgagggaggataaattttcagtagaatctgcttatcctggaaacacatgtactattttgggaataggactgggcttacatttaactaatctcattcaagtattatttggaagtgattggggtaaaaaaaattacaagtaaattattacgtaaaattaaggaatttcccatttgatttgagaagcattccagttccattggacttgttcatgaaatgggattaatgaggaaatggaatttcatggaagttcaagagcaggaatggtggcattgccgggcctcagagagatttcacttgggagattgtccattcttgacctgaagaagtttggaacccttggacattaactagagttctttgttactaatggaactcagctagtcactgagtattggcttttgtccatctttttcctgcccttccctgtacctgttggcttccttattctctgctcttctgtttgataaccaaatttttttttgcctctcagttttggcttctttgtaacttcagcttactctacctcttcaggtactttaatgaatcaaattaaaaatctaaataagagtcccgggaaaatctgctaaactgaaaggtgattcattttatgaatgtattcactttacatcgtaattggatgcccaagcaaatacatgttttctaattcgtttcattaagaaggtaggagccaaggggaaagttccactttgccctctgaagctttgctgaaaaatcaactcccaaaaggcagagtaattagagaaaaggcatacaaatttatttaacctgtgatcggagacttcagaatgaagacccaaagatacaggggaaattgtccatttaatacttaggttcaataaagtacagagagccatgtagaaatatgattggacaaaaataatatgacctaatggcaagagactgagtggggaaagccagcaaggcctgtgtccctagattattcttaacctcttgagcatgcattccttccttctgggcatggggcagaattcttctggattgggggtcttatgacctacagtcaagcaagggatgtcagagaatttctttatggccagtttttacatagaaagaaaggtgaagggataggtagagtaataattttaggttttatggctggctttggggaaaacaggttttggtttccttggggaaggaaggattcttgccttggggaagagggattctagtttctttggctatccttgggggagaatgagactgagacaggagggcaggagaaggtcagagaaaaacttttgcttctgaggctgcttctgaggctttcattttggggtactttttctgagactcaacaggaataagtttaaatatttttatttcaattctaaatgatagagtctttccctaaactaaatggtttgtgactatgagtgaaattaatttcatagggccatttcacagattttaagaactgtaatacttttcaaatcatataattataaggtggccagacaattttgtttatctattcatcacctgatgacatttggattgtttcactattgggttttaattcactattttgattaatgttgctatgaacattcatatatgagtttttgtgtgaaaatgtgtttttatttctcttaggtgtataccaggagtgaaattgctggattgtagagtaattctatgtttaaccatttgaggaactgctagactgttttcaaagcagccatatcattttatattctcacacgcagtgtatgagggttttaggtaaattttcaaggtgaatttacactgtagggaacattttctcaagtgtaaatccatttggaattctataagattcaatacaatgtttgggtttgtatttgtagagtcattgcttaattaagaaacaaaactgtgaccattgattggaaattacaattcagcaatttgtttcaatggaggataacttcctaacaattaagccatcaagtgacatatgctatgagtcatgagttctcctttacaaggattattcaaggcatttgagaggaataatttggcagaggttcttctgttgcgctgtttcccaaacttttgggtacatcagaatcacctgctattctagggactacactttgagaatcaatgctcttttgagtaagaggttggacttcccaacctctaaggcagtgattctctaccttgactgtataaggagctcactggagagctttaaaggttcctagtgaccaagctgtaccccaaaccagttaaattagaatatctggatagggggcccagtagcattttaaaaggcactatgggctgttttgttggttgccaaagtgttgtctctccaactctattcctatggttctaaataacaaaaaattagtcttacaacttattgtcaatgaagatacattttttgttgtaaaatctatcactatcccatgaaaaacaaagacttccagactatcacagaccctaggagaccaaagagacatgatggatatgtagatatgatatcctggattggattctgaagcagaaaaaagtcaccaatgtaaaaaccagtgagacatgaatctgtagtttagttcatagtatggtacaaatattaattctgtaggtttgacagctctgttataattacatattaaccttaagggaatctgggtgaaggtgtacagggactctctgtgtcatctttggaatttttctgtacatttaaaattactccaaaataatggtttattttttaaaattatcatcctcaaagtctacatgaggagcaaaatccatcaaagaatttgttgtcccacattccaaacctagcatttggtttttgttcacagttataaaaattaaatcttccatgaaggcattgtcattaatcacattataaacacaactgggaaaagataccagtattagtcagcatgggctgccataacaaaataccacagactgggtggcttagacaatggacatttattttctcacagctctggaggctggaaggccaagagcaaggtcctatcagggttggttttggtgaggcctctcttactggcttgcagatggccaccttctcactgtgtactcacatggcctttcctctgtacacagaaggtaagatatctctggtagctcttcctcttcttatgaggattccagttctgtggcattaaggccccacccccataacctcagatgacctttattacctccttattaaccctgtctcctaatatagtcacattgaaggttatggcttaaacatgtaaattttgggggaatacatctcagtccataacagtactgttggcaaatcacttatctctcctgtttgtggattttgcaaactggtgatttttgatattctattgctgaggacagtgcaaatgcatttcaaactcactgataatctttgtcctttgacgctgtctacttcttaaagttgggttttgtattgtatattatatgatctgaacattttcaagtgattcttagctaggtttgttattcttgggatgacatattctaataatcgtgttagaaaacctaataatattaattccaccttctcatcacttaataaaattttagctcacctggatgttttgtgaaacatctgccttaaaaccagacggttttctgtatgccagagataatatgtgaacaaatgctttcctcttctttaagagctttatcagcctgtttgagaatgataaggcttgattaagacctaaaccctcatttaggttttcatgtctcttctatgtcagagtttactaacatggaggaggaaaaggagcttaaattttctctatttttgcattaagaatctcctctcttccataggaaaaagcaaatatgccaacattttgttaagcatcatgatatttttagattagcagaaatctaggtcagagttcttctgccatcttcaaaatattgccttccattaaaaccaaaatgaagactggaatttctcaaagcaacctctggatcattttcattcaattgataaattcttagatatattgtacatgggaagctttctataatggcattgctggtgtgaaaatgttacaggaaccaatttcagatgatttctgtccttgataaaaagggcaatgttagctaatgtggcacatacctatagattattcttaaaggtaaggcagaggtttccgtagagggagtaaaatagcacatgcattctatttgtgttatctgtgtagaagccaggcaaacacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgcctcaaaaaaaaaaaaaaaaaaaaaaaagaagccaggcaaacacaaagagagtcacattgtaaaataatgttaattgagaagaactttaataacacaaaaaacttctagtgaccttgatttgaagtgcaaaatacttgtgtttgctttctgaggctagatgcccaagtcaatgggttcaccaatgctctacacaaccagtccacaagaattgcttcccattcttatgaagccaggaacaatctcaggtaccgcagtcaactgcagaataaatgacaggactattctccctttgtttataaaaataccccacatccaacttgaccctttctttgaaatgcagaaatttctaattttatgtggggttacctgcataaacagctttacacaaaagtattgagttagtgaatgtgtcattgtgtgacatctggataggaaactatcaaacgtgattttcccttaaaaagtctacaatttaaaaaagcatgatggtgacattagtgtgacattctttaggtagatctaaaggcttcattaaatcagatattgtcatgatagctaattaaggtctacttttggtttgaggtttatgaagaaagttatggtttggaaatatgaatgagacatcagagaaagagacactagaacatattatacaaatattcaaaaataatcctcatattctacaaaagaattactgagtgatcaagttttgtaacaatgcttaggaagtaaaccaagacagtggaagttaaaaacaaaatggaagacaaaaaaatttttgcagtgctgtgttaataccactctaacattcatgtttcaaagttatagttcagaaggaacatatattcattacattttgcattgaattagaaaatagccttgtttttattatccttgcaaataaactttaatcatgaagtaaaatgatttgttttgcagctctaacactggagccaagcaggcaggaccacaggatactgttgtgtacacaaggacatatgtggagaataggtattcaaaatttatttcaaatatattgcttcattttataattttgaaaggatctatgtttaataagagatgctattgttttagagtgtgcttctttcaaatagaagaccgtttataagtacattgagttctatatatatataattctctataatgtttctgatattatgtacttgggctataaataattatagtcattagatgaactcagtaatattttagtataacacatgtatacataatagggttgccatttgaaagttctcacataaatgtatataactgtatggttaaaataagctttataaaatgcacaactattcctatactaatttggagttccacttgaattaaataattctatctacttttgtttactgccaatctaaaataaggggtataaatttgagtagtgctatcttggcccaagttatgggatattgatgtttcaattgaaatctgctgcttggagtgatggatattgaggaaaatgtaaaccaaggtcagggctcaataattcatttggttttcaaggaatataaaacaagaattgtcccaattgtgaagtacaataatggtggggcacacaaatgctggtatacatgacccatatgttaagctaagcccatttcaaagaggtctaagagaagagtattcagggaagcttctgtgtggatggcagtcgtgatggggatccaggaaattcaatacatgtcaggaggtaagcgatcttccaaaaaaggtttctcaaacccatgcataatttaccttgtaaaatgcaacatcaatattgattttttccttaatccaattctcactctctggcgtgttcaagtcagtgatttctgctgtctttcaattaaactaaaagttaaaacacttcagagtaaattttaaaacactaaggagttactaaatctgaaataaattgataaaaagatgagtaatatcaaatagtatcatagtgaaggcaaggcgtgaaatattggcgaacaataacataggctttttttctatatttacataataatctctcacatttttatccttatgggatgtcacatcaatacattttgatttttaaagaaatttcttatgggaactaatgccaaacaaccacaatattgatttttgaataatgaatgatttatttaagaataggaatattctgctaaacatcgtactcgagattttttaattaataggatagatggataaaataatattaacttgattcatggaagtaccaagactaaagcatacttattttattatgatgactatggtttatttttttaaaagtatatactgaataccctgtacatatgtgtatcatgttcacatatagaacagtaattctcaaagcatagtctctgggccagcatcatcagcatgacctgggaactttctagaaataaaaattctttggcctcactcctgcctgctagatcagaaactctgcagctcaggcccagcaacctgtgttttaacaaactcttcagatgttcctgatgtgcatcagagtttgagcaccatcattataaaaagataatattaatattgtggcatatcaggctaatagtctgttgaccggaagcctctgaaaggattcgttgcctcctgtaccttaacctagcaaggatggtgatgtacctcagacatccttaagtttcctaaaatctacattgacaggcagcgtggtacagtatggagtcccaagagtcacatttgaggttgaatccttctttgtcgtttcctaaccgtgtagccctagtgatgttactcttccagtctcaagtttcctcatcaataaaatgggaatcatgacatgcatcctccataaatatgtgcaaatttttttgtagcattgtgggattatgtgtttcataaagtagattttagttctgacagcagtctgcctccaggaaatttggagagaaagataggtttctcatttaaaaatcccaagtgagagccatgtggttatcaatcattgtatgaaataaagaaacatattgctcctattcttaatatatgcccagatagcataagtacttggaaagcaattatgggagccagctggttaggacattacagattttatttgtctccaggaaatagtggtgtttaaaagctgggataatctacataatagaaaacagaagacttttaaaaatcatacttctttgctttcattctaaattattctttcttggatatattcaagtaaaaataaaaattttgcatgctttttctaaaagttcaagaatctcagtttctctctgtgaatggtgtatgtgtctgtgtgcttgccctgtttgtgctttgtgtattttctttatctactttacattctgtgtagctttctttagtaaacagatgaggtgcaagtataaatttcatgaaagatgaggacttcttttcctgctcacacttgttcctgtattccttaccctactctctatttattttggtatatatgtcaaattgggggtgacttgtgtatcaatatttctacagattaaaaaaatgtgtcagtacatcatcctggcttgtaacatacacaaagataaaatattatgaggcttcatgaggtggtgtgagtgtgttttcttatctacataaggaaaatcacctgattctcacatgtccatatattttgttcctagtaaatcacccaaggatggatatcaggagaatatctctggaaaatacatacaaactgtttattcaacttctgataggtgagtatgtctttatttccatacataaaaagtacacacatacagacacacacacacatatatatatatacacacacacacaggcacacacacatatatataaatatatatacatatatataaatatatatacatatataaacatatatacatatataaacatatacatatataaacatatatacatatataaacatatatacatatataaatatatatacatatataaataaatatatatatatatatttcttgctgttctttgtacttggagatggttctgctgatgtttcttgtcatgtatgtgcatgggcagaccaaagtgcaactcagtaacaacttctgcatccaggaatttgtttcttggcttcctggctgttgctgctgtctgattttgatgcatattatcaaaagacctttctgtgccttacagctgcctcccaggccagcccctctgctgctggtgatccccaggaggccccaggactgccacattattagcgtttaggcttcattgcatccatagactgtgccatcaatccccccttcttgtgcttttctgcagccttcttggcttacaaacagccatgcagatgtgctgctgtgacccactctgggcccaagctcagttcccaggagtggagtcatgatgagtattgattgagtgctggtgagctggccctgttccaggtttttgctgttagtgatcctcttttaccattcaatgttcagtggagcacctaggtgacacttatgagagtatggcatgcagatttccagtgaagtaaatgaaaataaataattagtatttcaacccaagccctggaaacaagccatcatgcaaatgtctgatgttccactgatgttgtttctttatagcaggggctggagatatgactcactcaaggtagagatattttattttcatatgtagtctcagcttctaacacagtgcttggtacctaatgtgtactcagtaaattttttttaaaaaaacatgaacctatgttccattttctaagggaaacatgggtgaaccaggtatcaaaattatatccctttcttgtcacttttccaatattttgcccattagcaatgctttgctgagtgtcttgcctgtaagtcacacctctttgagtagtaaagtcattgacaccagcattagaactacagatatcatctggatagccaattaaaaaaaacagatctaggttttcacaatgcttcaaaaagatctttgactaactgtatgatcttaataaagatagtaccaacatcagtgcatttcctgagcttgtatttctattattaagggaggaaaacattctccataaaagtattgctgttaatagaaagactttaaaccctattcctaaaatggctttgaaatttttcctagtcatcagcgcagaagtcagttctccatgagaccagtcagttatacaaccttttgctgttgatagtgtgtgaaattggcgatgttcttacagttcttatttaagcacgtcaatcctgtttaaagtggtttcccatgtaaccagataaagtccaacatcttttgcacattctccatggcccttcagaacctgctccagcagaatattcactgatgctgaatccctccaaacaccctcccagagtagcaagtttgtatgttctgttcactctgcttggaattcctccaccaacccctcatccccaccccaccaagcccaccttgagagctctttcctcttcaaacaatgcagatagcacttttttctgacaaggctttcctgacttcaccccaggggttagtggttctcttggctctgttctcctcagtctgtccacgtacctgtattccactgtgcatttcaacccaagccctggaaacaatcatgcatgttatatcatgcatctagtttccccagtggaaagagcatcttgtcagaggagactggctcaccactctttgtatttgcagctcctagatcagtgcctgtggaatggatgaaggacatagagcacctattttctactcttgaagtgcttacagtcttaaatgggaaatttaagtgtatgcatacatatgtgtgtgtgtttatggataatccataggaaaatatttgctaggtagctataagcaagtgggtacagaacaaataaaagcagaaaatatttatttatatacatgagacttagaaagacattactagaatgattaaaagtataaagctagataaagtttatctactataatgcctttcttctcctacttacttttcctttccattctctctcctctctgctcctacttctgggcttgataatagattagtggttcctgggtacgactaactcatttcaacacaatgagcgcatcagatctttggactcattgtgttggtaccacgctgcctccattcacatcttcactcttccactcactggtttcatgatagtagcaggtttcttatccttctgtacctgtttcttttttaataaaatgatgataaaaataataatagtggcttgtcaggaatgttgtgaagaataagtgagtatataagtgcagagaaaagtgcacttcatatatcatataaagggctatataaatatagcttaatttcactaccccattacatatcctactctggaaatgtcaggcctgcatgctaatatcctgaaactagtatactctgcagggtgctatttaagagtgtcctaagaccttaaaaaaggaaaaagatcctttcttaaggttctggtgtgactcaagatattttggattctgctgatcacatctacagatcatttatcattgaacattattttaacaaatatttagtatttgttatttaataaataacaaaactctcttttcttccccatcaaatttgtggtggggttatgtcttgctggagggtataaattttgtcacgataggtatccttatatcctgagtcttacagtggcaccaagaggagtgttttggtgactctggcccctacagtcccaggcactacagactcatcattttgtgagtttatctatgtgctcttgaatggatttctattttgggcctgttgaatattctgagagttaaaaatgtatattaatctgcagcataatttttccgtgtaatctgtaacatgatatatgtaaattcataattaaaagccctctagtacttctgaggagtacttgagatatttcctaattcaattaggaaactgaacatctttgtcccacccagatttactcttgatttctgatgaattaataatttgggactttctctcatgttaattatttgatatcattttgagaaaactagaagtcaattatattactagaataaataaactccaaactttccttgtttttttgtgaaattttctaaagtaaagtatcatcaaaattaatataccgttgccatgtgagtttatagggaatacatctgtcttctgtattatggcaaatttatttttaattgcttacatttctataggtctgtcattgaaagagatatgtgcacttactgccgaaaacccttgggtgtagaaactaaaatgattttagatgaattacaaatttgctgccattctacttgctttaaggtaaggatgtgtttatttcacttaattaaataaaaaattgcataataactggaataaaataataatttaatgtaatacatgagatgaagcaaaaactttcagaagcactgtcagccacattaatagtacactacttaaatatttctgagttctgcagcctaaacctcaaatgtttgtaattactatcttggctttaggcttacagttgattactgacacatttattcactcttaccctagagatttaaatctgtgggaaaaaaaacccacttgttctttttataaaagtttttgcaacagtttactaaattatgcattacagaaaatatgtgatgaaatcaaaacaagaaaataaattgttgagaagaaagctagcagtttcttacctcatgaaattaggaccaatgggtttaacaataggtgaacgtcagtctgcttttgagagcataattagtggtaattaattgtggctcaataaatactaataaagcttttattagtagactaaagcttcatagtttgtgctttcataggacgtttctttgcattctaaccataacattgggtggatcaacatcatcgtttttggtgtaactgcataagcagtaaatgggaatctaaagacctgagttctagttttgcctctgcctgtaactatgtccgtgtgactttggacaaccacctgaattaccttggcctcagtttccctaactgtaaaatgaggtgttgactagaccagtggatctcaaccctggctgcatattataatcatctggggagatgaggaaaaatagaatgatcgggaccagccccagttaaatcatgaatcttagaggtgattattgggcattggtatttttaaaaagctccttgattaatctaatgtacagtcagttggagaaactatgggccaaatatatggtttctttctagtgcaacattctacggttgatacaaatgatcaaatccagtcaaagaatgcaatactttgtcaattgattgcttctattcctattactttcaaaaagtgacacatagcaatcagaaatatagtaactcattttgagcaaaacattccaattttagggcataatgtacagaattctatataaaaatataatctccaggttgtataattagttatgagaacaaagttttttatttatgaaatatattcaattaaacaaaacttagtctatagatttttattgaaaattactatgcagaaaaatttaaacaagaatattctcctgatcattgcttttggtaaatagaaatattttcatttattacattttagatcacttatttctattttcaatgtaatttcaataaaatattaccgagaataaaaacaaacatgttcacactcttagaaaaatactgattgttctatagccatagcaatacagagccacatgaactggtttagacacaaccaattaatcaatgacagtttacttcagtaaatttgcttctgaaagccaaccaatcagtgacagcctcatgctttaaggtcagccaatcagcagtggacaggtctgaagcagcggtcagccctttcctacttctaaccagcacaactcaaaataaactttttctcaaacccagtcagataagcagtttatttctctccatgaggttgtgcctggacagcataactagctctcccttaagttagcaaacaataaatgcacctttgtgtttttttgtttgtttgtttgagatattgagtggtcatcttgtccttggcataaacaatttctggacattcatatctactccactgtgagtgaagtagaaaacttcagtgataaacatcccttaaaagtgcctcgatggtagagagatgatgtctgttcctctaataatctagatttcatttacaatggaaactttatatatgtatttttttctttagtgtgaaatatgcaagcagcctttggaaaatctgcaagcgggtgatagtatttggatttatagacagacaatacactgtgaaccttgctactctaaaattatgggtaagtgttacactctaagcatttaacactttggttaaccttaatgagcatttggtatcatttaaaatgatgtattttaataaagtaaaacattttactagttatatttagttaataattcagctgcagatatttatactatggtagtattttgtttaatggtgtaaaatcaatcaacttttgtattgtcttctggtatcagattagatatagatacaactaaaccaaagggtcatttattttagaaaattttccgtttttttccaaacaagaaagttattgtctactcacataattgtttaaattgaagtccatattcgtaaatgacattttatgcttgcacttgaatattgtataatttttaactaaatttggttattgcattaaatgcttttgaatattacttttaaattgaaaatttagttaattctatgtagttttacaaaaatatagcatttaagttttctatccatctaacatcaatgttaccataatttgcactcttaattagcatatgtaatgtgagaaaaggatattgaggacctgtgtttttaactaacattttttataaactacatatgaaagttttaaaagctaatttaagagatgtgcacattgtatggtaaattaacaagattaagtcctgtgaaacttgactggtttttaaaagctactatccgcattttccttttagattcaatagtaagtagataaaataaccaaaataatattgagaagacggtcaacggtactatgtgaaaggcactttttcctgctgtcttgttggtataatgaatgaaagaggaacacttgggacccctacctgggatccaaagtatggaatttaatgacaaatgtgtgatattaatgagctactgggagactacatccagaaaatgctctgaaaaaaatatcagaaacccacgttccatcaggctgcagaatcaattacaagaacatacctaattatattcatactttgccttctatattctgcttcccccagagagttctcatattcacttttcttcctgagttagtaatcttatgatgatctaatgttatataatgggtcttgatgtgcatggtggtagctctaaaatttttattctcccagagttcatgatgtggcttagtgggtgtgattaccaaaagactcagaagtttttatgtcttcctccctatatgtactccctaggcattgcatgttttataatacatataagttgtcaagagatgactctcagacatctcataaatatgcataccaggcatctggtacgtcatgtacacagtatgaccaaaagccacagcgattatttcagaagtggaaggaaaagtggaatccttaatctaccactacccgttgggtgaataatagtctgtaaattttaatgatgagcttgtttctgtactgaatttgcacgtcttttttcttttaatttgcagcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacatagaatctttatgtgaagtgtttgtaaatataattcactaacatcaattttgtcaattatagtgatcacaatctattatattctctgcagcactaatttatttttaactgctcaagctatagattttatttttaagaaacttttctgaagaaattgaacatgtaataatcatgtgaggaactagtataattaacattgggaaattgaacttctaaaccatttaattgcatatagcaactgtttctagaaaaaagatgtatggaacatggaagtgggggcagaattctagagaagttttaaggcagttgtggaaaactgctataaactagggagattaaaagattatcatgtattttccaaatgttaatacattcaaagaattattcttctgtgtaataatttcatgcctctgttcctcttaaagcctggttcacaaagtgttaaacataaaatgcttatcaaaatacagcaatgtataattgttgtccaatgaaaagggagccaggaaaaacaattaataataattttatattcattaattcatgcttgatgagaagcagtggtaattgagccacatgttttattgttcttttattatacgctatcagagtgatcaaaagaaataattttctcagagttgaaattcactgcagaaaaggatggatgaaatagtatccctctctttcatataaagtatattaacatctgaatgcttttgtagtaattaaaatcatctgaatatcatttaaaaagtataaaaacctaaaaggaacacatttctcatttttctatagctgtttaattggccctctctcctacaataatgtattaaatcaaaccaaaagctgttgtaaaaatggaatagacatgaaatggagagagaagtgtttctgattcatcaagatcacttcattatgtctgggtttattttcactatagaagtgacagattcccaaaacaacttacaagatctcacattttttgcaggctattaattatgttatgactgacactgttcctggacacaattgcctaaatctagggatactagatcctgaattctatcaccaataaaaagatgtctctaaaagagaatgaatagcttcatcatgacaatatccttctaaataaaagtcaaagacatataataatctcagaaatagtatagtataaaatgatattctctcctttaataaggccaagaaataagaatttattcaagaagtaatatgtatatcttaatggtttgat

SEQ ID NO: 15631 - DNA, 13785 bp, Human
  misc_feature (1)...(13785): n = A,T,C or G
tgtatttttagtagagacggggttttgccatgttggtcaggctggtcttgaactcctgacctcgtgatccacctgcctcagcctcccaaagtcctggaattacaggggtgaaccacgcacccagccttgagtgtgcctttctatgagtcctaagaaacacacacatttgtgcatccaaccccaaaaccaagatacagtatggtcccatcacctctcacaagtccctgtgccccctactgtggacccctctccctcctccccaaccccagacctggtttttgttcacacagttccacccgctccagaaagccatataagttgattcctacagcactccgccctctgactgtggctttgtttccatcccatccttcaatatccaggatgatctttccaaaatgtaaatgtgccctctcctctgtgcttctacttaagtctaaatacaacttgcagggtctggtctttgaccgctactcctgcccatctggacaaacaggatggatggctctcaaacctggtttgcagaacagccacctgagggcttgtcaataccacaccttcctgggtcttagccccagagactgagattcagttgctggagaggagcccaagaatctattttccacacaaggttagggaggtctagaggccacatttgcagaagcacagcttcctctctccacaccttccacacctgtccaggttcacccacgtggcctctgcttcctcccttctcctccaaccccactctctgtctccgcatgctgcatctcctcctgcccagagctctggcattgatttcctcactggggaaagtggcctccttccccaattcccatccaccgattccaacccccttcccatgtcagccagcttctcctctgctcagctgtcacctccactgagaagtctttcctgactccctatgtgagtcattttcccagcatagttgtctcctgtcatttcttatttgtgtgattctttggttaacatcaatcttcctgattggctgtgtgaggatgggcggggtctgtttttgttgtttacgcctgtatccccagcacaaaacatggggctggcatatggtaggtactaaacagatagttgaataaatgaatgagtgaattgtctactctgcctttgcacaagctgctccatcaccaaagagaccttgcctcctcccccacttctttgctgggcccactcataccggttttcctaggaaaactctggagaaaattgaggcaggagccactcattcgtgccccttccagggtggacctcttatcaccctaaggattgtttgttttcctgtcacccacatcaagctgggtggtggccgcagcctttgatctccacctcctaacccctctcccaagtaccctgtgtttgcccagcactgaatgagacagctaaagtgatccctgagagaactaaagtgttccctcaggccgggcgtggtggcttatgcctgtaatcctaacactttgggaggccgaggtgggcagatcacctgaggtcaggagttcaagaccaacttggttaacatggagaaaccccatctttactaaaaatacaaaaattagctgggtgtggtggcaggcgcctgtaatcccagctactccggaggctgaggtaggagaattgcttgaacctgggaggcagagtttgcagtgcgccaagatggcatcactacactccagcctgggtgacagagcgggactctggctcaaaaaaaaataaaataaagtgatccctctaagaggaatccccaggggcccaggccagagctttctccaggtcaccatggctcctcccactgtgccaccctgcctaaccccctcgattttaaaggagaagccaagactctggactttgctcagaaggtggggggcgggggagggagggcttaccctgggtacctctgaggggccagggcgcagccaccacggtaagggtgactgcagatcgaggggcaggccatgttgctggacaccaccctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctcccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggtaaggggaccgagatcggtctcagacgacagcctgccaggcaacccccagccgcaccagggccccaggctgtgccagtctccggctgaactggccggcggcccaggtgggaggattggagccacctggctctccccctcccccgctcggtgatgtcaggccaggggcgggggctggagggggacaggtagttaagggcctggcgtctccctccctgaagacgtggtcccagccgggtgtcctgacgctcggggttcaggtaagaacccaagcgggcatttatcctttgggggcaggcacggccggtctggaggccggtagggaaaggctgggtctcctgatgggttgcttggcctcccacttttctcttttctgtccatttcccaccctgccccctcctccccacccgccctcttttcgtccccatcctggtttccagcgctccttgttccctccctgtacacctccctgcaggcagcagctgagaatgggaaggaagacctgattctctcctccgacttggctttcccgctgaaactagcccctccccgcacacccggggagagccgccctcactctctggctcgcccagtttaccccagtttgggtttccccaagtctctaagacagacgtctctgcgggctgcggggagatgtggggagggccccctccactttggagggcagtgaaggagagggatcctctaaattgtcgaggcttcatctctccagattgtatgcccttctcagcaacaccgcctccggccctccgatgggaaagtggaggccgggtgagacggggtccctcctggcttcagcatgaaatgggcaggaaggctggaggggtgtatgaggggctctgcagtgcggtggggcctggggagagtggggtgggggatagcagatggtttcttctgcttgatgaggctagggagagacccaggttcccggtctgggtctccctggcagattgaggacagagaatgaatgcatctgccggcaaggtggaacgccccccaccccgccccccaactagccgcaccgccccccaggaatgccctcttttggtccgccggtcttggactctgctctcccctctcctgatatcctactgtatgcttggtggggggacctcatggaggcgggcagcctgtaatgattaactgcagagacactccagcattcttcccgaattaaactttaaaagagctgccccgccttctcccattgggtatttttcctgagtgagagtgggcggggcctcagagtcctgggtcctcccttatactaggagtcatccaggggtttctcaccttctcacctgggccctgcaccctaaaaaattataagcctctcccgtgggggcggggcgtggagtactgggcggacgggggctctcccgccacatccaggcccctggcccaggcctcagtcccgcaagcccttccccctgctctgggaagcagagttgttttctgttggccctgaacaccgggccccgccacctgcccttagggccagccaggtggggcgtgattcaggaagtaaacaaggaggttgggaggacgggaacgcgggtggggctggaaccactgggggaggaggcagctgggaagccacggacggagttacctcgttgaggggacaaactgattttgggggtcggtgtttccaaccgaagctttaccggggcctcagtttgaaaactccagatctctaagctgccaggcccacagccaggaccccttcctcctccctgctcaccccattggtcttgacgattccacccgcctccagccttagaagcttaagggcacggctggggggctctgaaggcaaaccccagccttggactggccctctctgatctctgaggccaggctctaatgtgatttgaatctacttctaaccccttccaagcactgccctcccgaattctctgctcctctccccaccccactgttggtctgtgatttcgaggcaggcgtggccccctgcagcctggaatgaagtcactggggctgtttggagaccggggctgtttggaggttagactggggtgggagtgggggattgtgttctggtattgaggtgctggtgtctcttgctagcgggtgatgggtgtgtcgtgcccctcctggcaggaccctgagccccctccctggcctttcatcctgtctgtcttcttgagtgttttccctttccactcctgctcctgtggtacccctctggccgggacacccaggagaatgtgtcaggaggaacttcatccacacagggcaggggctctgagcgatgctttgggtggggaggggcaccgccgggatgctggcttctctccaaatgggcctctgaatccaggccgggcattgcctctctccttcccaggcgagggactccctggcgaggaggtggtttgggactgggggtgagagcagatcgtaggtcccacctggcctggagctaggccgagggtgggggannnnnnnnnnnnnnnnnnnnnnnnnnnnnnnnnnnnnnnnnnnnnnnnnnnnnnnnnnnnnnnnnnnnnnnnnnnnnnnncccccatcctgttcccagccccgtgcctcccccattccgctctggctagcagtgggttggggagttgggggaagggtggaggcagggctgtttttgtttctcctaagccaggaagttgtgtggatgagtcaaggttgaatggagagccctaggcagtgttgtcccgcccgccctgactcacctgtcccccaaatcccctgatgccctcactgaagggtcaggtgcctgctccctcctgaggggtcaatcccaggtgccccaggtggcctcatagtactggcccagtgtttggagaacaggctgggggctgggattgcaggttctcccaggtctcagcccggccaaaggggtctgctgggttcctgcggagaaggtgccagccccacctccacctctagtgctcgtctttgcctgctgtcctgtctttacttgtcttgagtgtctgtgcagcccctataagtgataagacatgggtgagattggccttgcctgggggtaccaggtgccctcagacaaatgggtggataggacaggtgcacagtaatggatgatgcggcccccgcacagtgctgagagagagtcattcagtctgaatgtggaaggccaggaaggcttctcagaggaggtggctctagcactggggcttcaggaaagagttgggcaggaggatggcctggggagggtacgcaaggtttgggggctgctggggccaggacccctaccccaggccctgctctcccccttgcactgcagcggagcccgctctcctgcctttctgactcccatccttccccacctccttctcccctctgcatcactcatcacttgggcaggccaaacctcgccaagtatgaacaggctctggcaactgggtctggcaacaaagtgctggaaaaacccggggcacagcccagcgcagtgagtgccccacacgtggaggcaaaggagtgggcctttgccctgaccctgagggctgagcctgagagtctgtgggttgtgaaatctgttgtgaccaccaggcttgtggtgggtggaccctcagctcttcctgtgagcaactttgtgctaaagaaagagcactggagccgggcgtggtggcttacgcctgtaatcccagcactttgggaggccaaggcgggcggatcaggagttcaagaccagcctggccaacatggtgaaaccctgtctctactaaaaatacaaaaattagacgggcgtggtggtgggcacctgtaatcccagttactcgggaggttaaggcacgagaattacttgaacccaggaggtggaggttgcagtgagtggagatgacgccgctgcaaaaaaaaaaaaaaaaaaaggagaaaaaaaacagaaagagcactggacttggagtctaaacacaggttctactcccgactcacctgtgactgagggcaagaatgctttcttctcagagactcggtgtccccttttgtaaaatgaggctcattctgtccttccccaagggcttcagggaaactccagttagagcagtgaggtgctaggtaaactctgaggggcaccctaaccgccgtgtgaggtcaggaggtctgaattctctcatcccctctccccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggtacgatggggcgtggggcttgggggaggtcagtgctggataatacacagaggcttgcaggccactgctcccttccccacacctctctccctttttcttcttgccacaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtgagttgtccctcagaagggaagggagggatgcacgggttctgggtctgtgggagatacacagccgcttccatggaggcaggggatcttggttaggagtccctgagggtctagcaggtgcggaaagggaatgaatcaccctttgcctcccctcaagtcgtgtgcaattcctggggcgcaggtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactgggtaagtcaggtgcatggaactatccgggctgggagatgatgccttgcatcttgggctaggcatgtggctcatccaggagatctggttgatctccaataacccctgctttttgcccttgtccccagagcggggtttggaggaccacgagtccgtggtggaagtgcaggctgcctggcccgtgggcggagatagccgcttcgtcttccggaaaaacttcgccaagtacgaactgttcaagagctccccagtgagtgcatgagggctgtctgggcgctgggatgccctgatcctcaacctggatgctggagccctgatccctgacacttgtctacccacagcactccctgttcccagaaaaaatggtctccagctgtctcgatgcacacactggtatatcccatgaagacctcatccaggtggggggaccccccatttcactgcagattcacgactccccagcattggccagtgcttctccacccttaagtcctgtgcctcccctctatgttgtagaaagagccaaatcacagtcctgtgtgactggggacagtcactttccctgcctgagcatcagtttcttctattaaatgggggcgagaaatgcatgtggagcatttccttgtaaaaacctgagggtgggctgggcacggtggctcatgcctataatcccagcactttgggaggctgaggcgggaggattacttaagcctagaagtttgagagtttgagaccagcctgggcaacataatgagacctcgtctctccaaaaaaaaaaaaaaaaaaaaaaaaaggccaggaatggtggcatgagcctgtagtcccaggtgcttgggaggctgaggtgggaggatcacttgagctcgggaggtcgaggttgcagtgagctgtgatcgtgccaccgcactagcatgagaccctgtctcaaaaagaaaaagaaaaagagaaacatcctggtggtagaggggaagggaggaggtcagacctgtcactctcctctgctctcctctggctcagaacttcctgaatgctggcagctttcctgagatccagggctttctgcagctgcggggttcaggacggaagctttggaaacgctttttctgcttcttgcgccgatctggcctctattactccaccaagggcacctctaaggtaaggtcttgagggtaccagccccagcccctccagtccctggtccttttagaagttgccccttctctgctggaacctctgagcccttctccccctgggccccccaggccagccacctccagtttaccatctctccctacatccttgcctagctcacctgcccagggaggtagcaggagaaaagatgatcttagtttaagtcctggctctacttctatttgctgtgtgaccctgggtattcccctgcccctctctggtcctgaaatctccccacctggcttgtggggggaggtaatagtgggcgggatctacctgtaccaagtcctgctcactcatgctgcttaggatccgaggcacctgcagtacgtggcagatgtgaacgagtccaacgtgtacgtggtgacgcagggccgcaagctctacgggatgcccactgacttcggtttctgtgtcaaggtgaagacctggccaggcctggcccctggcctggggaagcaggaactgctcaggcccctggatcctgcccggggcttctgagccccaattcagacacctagactcctctccctgcaccctggcctgctggaaactcctggattcagctctgctatgtggagcaggggcagacatgtggtcctaaaggcagatatgggaccagtcaatttcctctctctgcagcccaacaagcttcgaaatggccacaaggggcttcggatcttctgcagtgaagatgagcagagccgcacctgctggctggctgccttccgcctcttcaaggtgagaccctgggagtggcatggggggctggcctggccagagggatccccagctctgccctcaggaagtctcaggaatgaggagggcatcacagccttgctctctgataacccccagtccaagcctgaagttataggaagtgcccatcgaaggcagaaacacagccctggtctgggcaagtcctggtctgaggggggcgtcacagccacgcccccaggacctctcgacctcaagctctctttctctccccacccccagtacggggtgcagctgtacaagaattaccagcaggcacagtctcgccatctgcatccatcttgtttgggctccccacccttggtgagtgtgcccaaggggatgggagggtgggtatgcaggccctgtcttacgggtacctgggccctgttctgacctctctcctctccttccatctccagagaagtgcctcagataataccctggtggccatggacttctctggccatgctgggcgtgtcattgagaacccccgggaggctctgagtgtggccctggaggaggcccaggcctggagggtgaggcctgctgtgtgtgtgtgtgtttgtgctggggacccactctctgggtgggatccctgaaataggagggaggaagagagggcggggggaggcccctggctgggaagaagtgctctaccttcctgaggtgctgggtaatgcccccaagcacgccccgactctcccgtatctcccactgctccacagaagaagacaaaccaccgcctcagcctgcccatgccagcctccggcacgagcctcagtgcaggtgggtgacggccccgagtcctggggcgggggctgcctcaacttctctttgtattcccagtggggagtagatggtataggggtcccctccccaaagtgaccgcccatgtccttccccaccacagccatccaccgcacccaactctggttccacgggcgcatttcccgtgaggagagccagcggcttattggacagcagggcttggtagacgggtaaggggcagggccgggcaacagacccagggataagagagactggggtccaggtggcagccatggtccttgggtagtaatgctgccccatctcctgtcttctggcagcctgttcctggtccgggagagtcagcggaacccccagggctttgtcctctctttgtgccacctgcagaaagtgaagcattatctcatcctgccggtgagcttccctgcgtccccggagtcctgcaatgagacacaggactcccagcaacctgtcctcctcaccaggcccctccagaggctccctggcccccagtgcgtctcccttttccctgcacaagaagtgggaggctgagtgcggtggctcacacctgtaatcccagcacttaggacggccaaggtgggagaatggcttgagcccaggagttcgagaccagcctgggcaacacagggagaccccatctctacaaataatttaaaaatgagccaggcatggtggtgcacacctgtagtccagctactcaggaggctgaggtgggagcattgcttgagcccagagggtcaaggctgcagtgagccatggtggcaccaccacactccagcctggatgacacagtgagaaaactgtctcaaaaaaaaaaaaagaaagaaaaagaaaaagaaaaaagaaaagaataaaaggaaatggtggggccctggcccaggagggagcttcccaagcctcgggcccctccctgaacttccaccccctttactgtaccccagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacctatgagttctgtctggcaaggcctggctggctgaatcaagaagggaaccagagctggacgtggtggctcatgcctgtaatcccagcactttgggaggccaaggtaggagaattgcttgagtccaggagtttgagaccagcctgggcaacatggcaagaccctgtccctacaaaaaataaaaaaatgagccgggcatggtggtgtgcacctgtagtcccagcttctcaggaggctgaggtgggaggatcccttgttccttgagcctgggatgtcaaggttgcagtgaactgagattgtgccgctgcactcagcctgagtgacagagtgagaccctgtctggaaaaaaaaagaggggagacctggagaggtgggcacctgtggaggccttggtggaagtgtcaaatggatcgaggccatgtctcagcctgcctggatgttcctcaagggcaggagtggttatctgagagtctccagtgcccaccatgcagcttgacacatagtaggcgcccagtcattgctaattaagtaagtgaatagacaagagaccatcatcccagagagattttctgacagtctaagtctagagaggtaattaacagggcctgggagttggagatgagtccgacagcatgcttgtcctccgctagtcctggactagctgacggatagttggccccagcatgcacacagttatgcatccagccccaccaccaagacacagaatggcctcatcacccccaacaagtccctgtgccccctactatcagccatgctccctcctacccaaactgaaacctcctttctgtcctagttctgccccttccagaaagccatataaatggagcctgctagcattcagccctctgcatctggcttccatctccaacacatccttcagcacccagagtgatcttttctcaaatataaattcaccactcccggcagggcactgtggctcacacctgtaatcccagcactttgggaggccgaggcgggcggatcacgaggtcaggagtttgagaccagcctggccaacatggcaaaaccccatctctactaaaaatacaaaaattagctgggcatggtggcgggcacctgtaatcccagctactagggaggctgaggcaggagaatagcttgaaccggggaggcagaggttgcagtgagccaagatcatgccattgcactccagcctgggcaacaagagcaagactcagtcttaaaaaaaaagacagatgtctggcctctgcccactgctcatgccagtctatctttttgtcttagaggttttnnnnnnnnnnnnnnnnnnnngtttttttgttttgttttttaagatggagtctcactctgttgcgcaagctggaatgcagtggcacgatctcagctcactacaacctccttctcctgggttcaagggagtgtcttgcctcatcctcccaagtaactgggattacaggcgcttgccaccacgcctggctaattttttgtatttgtggtagagacggggtttcaccatgttggccagcctggccttgaactcctgacctcaagtgatccactcaccttggcctcccaaagtgctgggattacacacccaagccactgcgcctggccttgtctaagagttttttagtttgagctcttacctgatgggagctctttaataaatatgtcagatcgactgcatctgaacttgctgcttaactcaggagacagaccctcctgcagacctgtgaaccccaactagtcattgtttttgtcaaaacaccaaacctgaatctgattccttggattcaacaactagtttacgggaaatacaagggaaacaatgacaaaaatccagattgggaaattctacagaacagataacccagtttcttcttcaacagcaacaaaattaccagaaaagatgggcaatctctagatttcaagaaatttagacatatatcaaccaaatgatgtgttgacctttgattcaaatgcaaactaactgtaaaa

SEQ ID NO: 15632 - DNA, 4335 bp, Human
aaaatgaagcaactggagcacaagccagttgggcaggactcacactcagttgcacattagtttcattttcaacaaaatgcctatatttcatttttaaaaaagaatactttcattgcattaaatttcatttcaaaaaaaaaacccagcaattatgaatgatccaagaaaccattcttggtttaattcatttaaaaaaaaaaaatcacttggccgggtgcggtggctcatgcctgtaatcccagcactgtgggaggctgaggccggtggatcacgaagtcaggagttcgaggccagcctggccaacatggtaaaaccccgtctctactaaaaatacaaaaattagccagttgtggtggggggcgcctgtagtcccagctactagggaggctgaagcaggagaattcttgaacccaggaggcagaggttgcagaacccaggaggcagaggttgcagtgagccccaatcgtgccactgcactccagcctgggcgacagagtgagactctgtttcccaaaaaaaaaaaaaatcactcattaataaacatacatccctagaacattatgtctttatatcaatggtacattttaagttcattttggttattgagtctctaataataaaataatggccaacttttttgaagtaagtaaatattagaaagtagattaaacagcagatactattttatgatgtgtcctcacacacataatttatggagcagtaaatcggtctataattattttatttctatctctgcttagtatggttattgagcatcattctcaaatttatctttataaaattttctccaatgttttcatgtatttgtttttccaaagctgaataccaaccagacaacagacacacactaaatacttactgtgagctaagtaccacattagaatattttggtcactatcaaattaacccaacaggttacagaagttacttttctccatttgtggatatgtttcaatatttgaagtggcacctggtgatcctaccccatttggccaaacttaataacaacacaaaagaatctacatataagtattaccgcactctgtcctccatcactgatgcagtaaactcgtaaacgatagaaacagcctggattcagtcgatcacaaagatgttccctggtagcaccactgtatatcatttcccatttgtttcctgtaaggtgaggaattgtgttcaatcagatactaggtaatgtttaacgttctggtatcatggacacatcaggtatcctagcttcacaaagtaagtatttgtgtaatttgtcagaaacaatttaggtttgtttcggtttcctggaaatgatctaattttctttatgtgtgcagcttcctagacaagtctgcatggctttgtggaagtgaaatatctctgtaactctgtacagactttggcctagattgataatttacttttaattaagcattttaaatgtgtttactggtccagtaataacgttatagcatacaaagagtacaaaaaaccagtatcagaggaagtctagtcctaattaaaagacatcttttttttctttttggcaggaaataggtcatttcatagaaataaacactgctaaatgtgtgattcaagaataaagttcactagtcataaaacttactactaaaactagtatgatgtgagttaaattttagaagttaatccttctctgatatatctgtatataaatctaactgaataaactaaccttcagaagattcatagtatctaatgacttggtctaggtgtatagaggctgagcaatgtaaataaatgagaacaaaaagaacatgtaaatgcaacgatacagttgttcagcactcttacatttgattcactgtatttctggaaatcacaatttaaagtggatcataacaggcaaaatcctaactgctacaaacaaagaaaaaaaaaatccaggaaaaaaaaaaggtcttggtgaggtgccgccatttcatccgtcctcggtttctgtgcctttcgcagagcttccagcagcgctacgttgggccagagcatccggaggttcacaacctctgtggtccgtaggagccactgtgaggagggccctgggaagaatttgccattttcagtggaaaacaagtggtcgttactagctaagatgtgtttgtactttggatctgcatttgctacaccctttcttgtagtaagacaacaactacttaaaacataaggatgtttcagttcatccattaacagatatgaagagcattttaagaggtacagcctctggaagtggatcaaacttgaactcatatggcatactagatatgtttgtcaataaacttatgacattaaaaaaaaaaaatccaggacaacccaaagtgaagtgaacatctttttatggtgtaccttatgaaaagcaagaagaaagaaaagatatgacataaaatgtaaagccataaagaatagaaagagactggctggaataaatctatcagtgtttaatatccattcataccgttagaaccttctgccatctccactacatatttattgatggttgctccgccattgtcttttggtggatctatccaaagaagcaaagtagtattaggcaaggtacaaaacaacataaaaatgataaaaaaaacctaataaacagaataccaaactaggtttaaaaaaaaaaaatcacctgcaatgacttaataccagtacccaattactccatgctgttgtcatctgcttttcacttaatttaccatatttaaaatatggctctctataacaatttttaatggctgcatgatattccatttacttatttttatttattttttttagatggagtctcactctgttgcccaggctggaatgcaatggtacaatctcgactcactgcaacctctgcctcctgggttcaagcgattctcctgcttcagcctcctgagtagctgggactacaggcatgtgccaccatgcccagctaatttttgtagttttagtagagacggggtttcaccatgttggccaggctggtctcgaactcctgacctcatgtgatctgcccgcctgggcctcccaaagtgttgggattacaggcgtaagccaccatgcccagcctccatttactttagatgttaaggttgtttgaaatttttgaatattataaatatcattgaagcatttttattggtctgaatttttcaggcaagggtcaagtttatgggatctttgtttttccattaggtatgtaggtaggtgctcgataaatgtttgttttaaatgaatggttttcatttcttacgagagccagatgacccaggtgactttagctgcaagttcagtaatccttcatttcacagtgctacccctgctcattatcttacagtggatcgcaagttcctttttatcatatcttaacctagcatgtatgagtataaggttttccacaaaaaacatacccaatgaatgactctcacatttctttttggactggcttgagataacaaatttactcaaatatcttaaaaattatcttcatattcaaattattttaatcaaacgcaaaagtaataatgtataaacatgcataatatcttaccccaggttattttaaaactgtgtgaatgtatctttcctttcactgaaggctttacaggtatgcctggtttatcagggcaagtagtaaattctactacttcacttggattacttttaccttctgagttgtaagcaataacctgtgatgagaacagaaagacattaaataatacacttgatacctaatgatactggcttaataaacaaagtgataggagacaaacagcttcaaccaaatgataaaatacattttttttagcttggaatggcttgttctttgagaattgcttgtctccaatagatacttggcatatatgaagagtatgcaactgtacttccccttttagagtccgtcctgggaatacaagtgtaaaacctaatattttgatactaaataagaatcagaggaacaagctataatctggtgattcttcatgggctttaggcttgctttgtttcttcttttaacattctttgtgagtttagaaagaggtccacacattctctgaatctcctttcttcaaaaggtgaagtctaatcccccttcccttgtgtgtgtgttatacttaatgactcactctaacaaacagaatacagcagaaatgacggtgtgtgtaacttccctatggaaaaactcatgtggtgaggaactgagggttcctggagacaaccatgtgagtgaacctgaaagtgagtgaagtcccaggagagccttgagatgactgcaaccccagttgacatcttgattac

SEQ ID NO: 15633 - DNA, 18838 bp, Human
ctttcactcacaaacagtgttaggccatggagtggagagggtgctccggggaatgaggatctgcattccggccctcaggagcccgagcccacaacggccccaggccacaactgccaggtgggggtcacttcagcagctcattcctgggaatgcctgtgcccagatggcttcaggcctggagcaatttccacctgcctctgtgcatcggtgtcaggcagatgggggcagccacctgcttctcaggaaggaccacccttaccctgggagggcatctcttctactttgacagaggatagaaaacattctgtcttcatgaaatcacggggatattcagtggtagttttctttttcaggttcttattgaaaaaataaaatcttggcagtgtaaattcagcccttgaaaattgttctggaaatttccctggcccatgaatcacctgggtctggcacctgttggctgtgttctccctcagttttcccatctccacgatgggtagcagttgttgctgtctcatttgagatgacacgtgtgaagcctttagcacgctgcctgactcccaggaggccctcagaggtgactggggcactgccttcctcctggtcagtggtgatgttggctcttatagtttgggttgggatgctgttgctcatgtcctctttcacagggctgcacgcagagctcggtggaggagcctcctcccccaacgcctccgcttcttcctccctggacttctgccccgtcagagggcagcctgcaggcacctctctctgtcctggaagcctggccagcaagtcggggccaagggctggtgggggcctgcagagagggccagcctgagccagaggaagagtcttggggttggctcaggtatgtccaggccatgagggcagaggaacaagtctaccacagtccccactggagcggtggcggggaggctggggagggcagtgaacctggaggcagcccctcactcctgaatgtagagtcaactgtgactttgatttgcaccacagttttcttcagagtgcactaaacatagagtcatactcattttacgagaccagcattaccctgataccaaagccagataacattacaagaaagaaaattatagaccgatatccttgatgaacatagatgcaacaatcctctcaaaatattagcaaaccagctgggcgcggtggctcacacctgtaatcctaacgctttgggaggacgaggtggggggatcacttaaggtcaggagttcgaaaccagcttggccattcatggtcaaaccccgtctctactaaaaatacaaaaaattagctgggcacggtggtgcgtgcctgtaatcccagctacttgggaggctgagggaggagaatcgcttgaaccgggaaggcggaggttgcagtgagccgagatcgtgccaccgcactccagcatgggcgacagagcaagactccgtctaaaaaaaaaaaaaattagcaaaccaaattcaacagcacattaaaaagatcatgcaccgtgatcaagtagattttatccctggtggggtgacttctttgaggtggcagcccctctgttggtgtgatctagagcaggactgaaggaaatttactcagggaaatttacaaggcttctgtgaaactgacatggcagggcttccagcctcctgttccaagatgggaaaactaagtctcagcaaagggagaggtgataagaccagcccgagatcgtacaggaccctgtcttggcctccttgtccggagcctggcctctccagagctgtgactactagtccctggggggagacagcctttccacctctcccagaccggagctgggtgctaacaggccctgccggatgaaaatcctacgatactaacagacagctaacaggccgggaccggcccccagccaccaccccttgtccaaagtgcaggttcattgtgctgccctcttggcttgtaacagttttgcaacagttgcaacttgtctttgagtgcagggacaggagaagtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccaggtaagcctcaaactggcggggccagctttccactgggcagccaggggcctaagccagtgggccctttgcctttgaggcagggactgagaatggtgtcagcacgtggtcaggcccagagcccaggccccctcctctaagaggtcctcctggattccctgctggaaggaagccagccttgtggtgtcgtgtctctccctggatctgtctgcttcgtggaccctgagcccctcgagggcaggggctgggtcttagatgtcactataggtttcccagcagtgctttgtacacattgggcattcagtaaatgtagaggatagacaagctggcaacaagacagtcggacatcctcggtgtgaataagaacacaatgatttgattggtattaattacagcagtttactatacgatcgcttccggtattggcagctggcatcattacaatattaacagactgccattgaaatgccccgtctttgatccagcgcgaggaggagatgtgactttccatcagcacctgttctgattctttgggcatccagaggtgtattctttctgggtttcctccacacccctcctctgggtgtctacttctgtctgggaaggggtaacttgccccagcccagagtcaggctgcagcatccggtctgcctcctccaccagcttgctgtgtggccccctccctgggcactgctgtccccaacagtcaatggaggctggaatccctgccctgggggctacgtgctgtgcagtagccagtggcttgggggcatctccccaaacaccagaggggtctgggagctcgggaaagcaggacgcagacagaccaggagaccctgtccctgggaagctgacccaggccttctcactcgcctctgaaggcagtgagcatcctgtccctgggggtgagcaaactggggcatgtgctgagatgacctcaccaaaggagcctccctgcagtggacgggcccctggcccaagctgctgctgaccccacctttcctgcccaccctgcctgtgcatagctccttctgggcgcggggagctcgggcggctccagcaggcaggtggtgcctgggtctactgcagcaaccctgaggcgcctgtttcagagacgaggaaatgagggttggagcggaagggtgactgccaggtcgcctacgggtaatggggcatggggttcacaaccctgctctgccgccctcagagggagctgcccacagggctggcctagaagccccaactaagctggcctagaagccgcagtggtgggcggtacgctccgcccagatcctgggcggagacatggggctggcagcgagggtggggggcgggggaggcctggagttccggccaggccactgcttgggaagcaagaaggtgaaggcacctctgctgggccaagcactcttagggccgaggggcactgcagctgacaagaggtacttggaggtacacccccagggagggacgaggctggggcctcccctatgtgggcggggctgggcctggtcagatctggctgggatctccctctgcctctggctgcagggaccatccagctgcatgagcaggaccagggttcaccatatgggcagctgcctccccgccccctgccgctcctccccacaagtctgcctaccctcaccaggcgaaggtgccaggcgctctcctcgcttgacccccaccaccccctgagcctgggaggaggagggcgttcctgggtcctctgctttgcagtgaggttaagttgttgctcgaggccccagtcctgtgacaaaacccccacccatctgtctgatcccaagcccagggctgtcctcagccctcactcctgggaagctgactcaggtacgagacagagttggagggggcaagagagtgggttaatgtggaggcagctgtttccagggaggtggcaggcaggaggggctctgggctgtccccgctggggccgctgccagcccccagtctgacagtcagaagagccctgactgaccaggcaggtggtgaaggggcacgtggcagcctccggcgccagcagctgtcgctttttgggcacagtcggaaggaggagggaggcttttgcccacagctgaccaggtgtgctgtgccatgcggcaccgtggtgggtggtgggtggtggggtgggggtgttcagccttggagggccttcctcggtgccactcaagctggctttcccctggtggggcaccacttttgggggctcctggaagactgtggaccttcaaggactgaaggtatgtacagacacatgcaggaggcatgcctccttgtccggggccacctctgcaggcaggagccaggcgggctgacacactgagggctgagaggctgaggacaagctccaacacctcctcactcccctacgccgctgcaatcagactccctgctccctcccttgggatggggcactggggcaggagatggggggcagccctgaccagcctgagagctgggatccccctcacatcccccactgtgcctaggacagggttctgggcttcgtcagggcttgggcagtgcccacagttcaggtgggacagagtgtggcagtgggtcctgagtccccctgggatggtcagaagagggggcaggagagagtccctggcactgccacatggaggccctatgaccctggtcacctcagggagcctctccgtgtgtcagactcccccgctgtgaagtagagacattatcatgtgtctataggtgttcaatgagagtgaacgaacgtgcatagctatggtccactcttgaaaaaggatgctgactttcttagataattatatcagtcattcatactgacgtaggtggcacagcacttcacatcttggatcacagccacatccctttcacttttcctgcagatcccagaaaagggcagtggaggtccacactgggcaggacaccaccccacccttccattgagggctgttgtgagacctccgttcttaacttcttagtttaaagaatttaggctgggcacagtggctcatgcctgtaatcccagcactttgggaggccgaggcaggcggatcacctgaggtcaggagttcgagaccagcctggccaacatggtgaaaccctgtctctactaaagatacaaaaattagccaggcatggtggcatgcacctataatcccagctactcgagaggctgaggtgggagaatcgcttgaacccaggaggcagaggttgcagtgagccaagatcatgccactgcactccagcctggaagacagagtgggactctttctcaaaacaaacaaacaaacaaacaacaacaacaacaacaaaacagaatttaaacatgagacacacagcaaaagagctgcaacatagagcaatttattgcaaaagaaaaagaacattttgaaagttaggtgcggatgcaccctgggagagagaggattccaggcggggggctgctcctgagtgtgaggcagcattgatgattgttggagaaaccccctttcagggagtcttccacaattattcataagtgggtggaaagagaggaagaggttactaggcagcatgtgatggctggtcctctgggtgcacatgcggtagctgtacatgtttgttcatacgtcacatgtctcattcgcatctttttttttttttttttgagacggagtttcactcttgttgcccaggctggagtgcaatggcacaatctcggcttactgcagcctccacctcccgggtttaagcaagtctcctgtctcagcctccagagtagctgggattacaggcatgcaccaccacccccggctaatgttgtatttttagtagagatggggtttctccatgttggtcaggctggtctcaaactcctgacctcaggtgatccgcctgcctcggcctccccaagtgctgggattacaggcatgagccacagagcccggcctcattagcatcttaaaatctccaccgaggggtgtgtttttttactattagaatgagcaaagggtcagtttgaggacaggtaaaatcaatgtgcacatgccctctccaggggaaaggccctactgcagacagctttgcttgaacgagctcagttaacacgagctcagttacagtgcaaacgtggaggctgattgtgtggattgcagtcaccacggttgctgcgtccccaggacatggtgactcctttgactgcctgtcctgcctcgcctgcacccaaggagacatccgtcttcatcagcgccttctctcctgagaaggagggctccctcttgcattctcattgttattggatttttctggctgggcagatctgggagggtttcctgaaggaggagggagtcggggtgggtcagctgggaaggagcagaggggaggaaggcctgttaacccggcttctgagcccctactctgcaatcccaggtggccccaagggagcagagccgggacaccacatccttcatcagcttccgccttagtcccaccgagctttggggctgatgagggggcaacccctcttgtctgggtttgggaggggcctgcccaggaggaggtgctggctccaggcttgggggttgggtgccccgtctcgaggctgcctgccgataccctgcggccactgctgtagcatccacgatgcctctccctcctcctggctctctgtctgggagcgcaagtgtctccatccctcaacacaaccccctccctgccctgctgtgccactaccaccgccttctctgggcactcctgcctcccaggtcccatccccaccccgcaggacctggggtctgccccagcacagacctgtggggcagcagggctgcttggcccctcaggagcatcttgagctccgaaagggctctcaaggctggcgggacggcccccgcccagccccagcctctcgctgtctgtgatctgggggtgagtgtccctgagaccggagcccctcctttccagctgttggtcctctgtcctcagtcccctccccatcctccctgcccggcctcacggggcagcccactttcctcaggtctcactttggatctctgccagccacgtcaccccctcttctctacctccccttgtggccccgacccccacttctacccagagcttggcgctccctgtcttttctgtgggctggcagagacctatcctcaccaaggttgcccccgggcactgacagagcctgctgcataccaggcccttaatacatacacacagaatgaatgaatgaatgaatgagtgaatgaatgaatgaatgagtgaatgaatgaatgagtgaatgaatgagtgaatgaatgaatgagtgaatgaatgaatgagtgaatgaatgaatgagtgaatgaatgaatgaatgagtgaatgaatgaatgccatggggaagtggcaagaggaaggccctgggaggtaacaccatagggcccttatttccctgggtactcagcacagcccccagcgtgtcccctctgcaccccacccagctctgattctctccccagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggtagggaccgggggccaggtaggggcagggaaggataggacatagcgaggggccacagcccattgctagctgggacagttcttggttcacaacaaccagcctggggaagagaccctggggaagggtgcatggccagtttgcaggtgggcggagctgggggcactgcttgccctcccagtcgctgaagagctgtggtgggaggagggagcagatgctgcttgtgtggcctggagagtgaagctggggccagagctggaaactccaggcagctgtccagagggcagaagcccctttcctggacagagccaccaggactgagggcattccagggagtggagaaggacggacggggaccattgagggtgaagcagacctgtgtcctccatgagcaccagaggcttctacagttctcattctcctaactaaccagggggcatatattaagcacctatggtgtgcatgtcccaggacagccaaccttctgccttcaccatttcagccatggatgtcctggcaaactggatctcctgacctgcagtgttggccagttcctgtggtgtgaacactcccaccctggccaatagcaaaagccaccagtgtgaggtcactgactgtggagttgggaagaggtttatccctgggctcctgagagctgatgcgagccggctcccacaagccactgctccaactcttgctcttgccttctcactggccccctagctgggctgtcatagcctcttccctgacgtttcgccagccacacccctggcctgccacctctcacattcagctgctggagggcatcctttgttggggagagtgcagatttaagcttcattcagtagtgggttggtgtctcggcgccccctccactcacctgctctgtgatcttggccacagaactgttggtgccacttgaacttgatctataagagaatcacgccctcctcatagggcatgacaggcttagcacggggcttggcacacagtaggtgctccaaaaatgggggcctttgctatgtcactctctgagctgcccaagggcgggacctccctcacattcatcttggtccagttatttcctgctcaacaacctctccaggccccccaggtcctgcagagaaagaccttgcagagaaagacacccatggttgaatatcagggtatcccctgatattcgtctgggggaaggaggtgcagtccactccctggggagtgatggcacccaccctcccgggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcggtgtgtgctcccctgcggggggcaaggaggggggcttgggtgggtgggtgcactccctggggggtcatattggtgggtgcaccccctgtgggggggtagggtgggctccctgtgagggtggaggtacgctgggggttcatgtccgtgtgcgcatcccctgcggggggctggggtggggggctcgtgtggatgagtctgcttcctgtggggtcgggagtggggctcatgtcggtgggcacccttctgccgcgagagaaggggacacgccacagggaaggagccccggcaggtgacagatctgggttccagcccttgcgctgccccttgctggctgtgccacctggagaaagcgactttgccaggcttcattcagaattcccagacagagaatctgattggcccagcttctccctgtcccagtggtccacgcctgaggacactgattggctgttcttgggccaatcaaatgtgggggcgtggtctatctgacagtctgaaacaggatcttggcctctcttgacagctggtctgactgggaaacctctcaggcccaaagtattagacctgtggggttatttatcttatataatagacactttgtgccaggcactggtctaagttctttgtcaatgacatacactattctcacccccacttcacctgagtgagcctgaagcgactttgccccaggttggtcacacagctggcgagggtcggattggcacaggcggcctggccccggagcctgcctcagtgccctgctccttaactcttatgctgaagcggattcaaggaacaggctccgggggcgtggggaccggctaaggcttctgggagaaagtgaggctggggtttgcggtggatgcccagttggggaggggagtggcccaggggtctgctccccacggactcagttaacctcccctgggtccccctagctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtactgatggccgcctggctctgggtcccttgttcccagcccactcctcctgccttagaaccctgagagcagaagggaagagaacaagagccattctctgactgctgtgtgactttgggccagtgaggacctctctgagccttctggtccactcctgccaaggggaggctatgccttcgttctgttcacagacatcaggtcgtgccgtgggtgcacccattcctctgctgcacaagcaaatcgtatcaaaagcccttcttataatttgtatctgtgtttgtctcaactccgcacatcattgtagaacaatttttttgtttgtttgtttgagacagtatctcgctctgtcgcccaggctgtagtgcagtggcatgatctctgctcactgcaagctctgcctcccgggttcatgccattctcctgcctcagcctcctgagtagctgggactacaggcacccgccaccactcccgtctaattttttgtatttttagtagagacagggtttcactgtgttagccaggatggtcttgatctcctgacctcgtgatccaccggcctcggcctcccaaagtcctgggattacaggcgtaaaccaccacccccggcctgtagaacaattttaagaagacaaataagcaaaaaagaagtcaagatcacccagcagtaatagtattgacattttagtatgttttactccaaatatttttctatgaaaatatatatgtatgcaaaatagaaccaagctgttgttattttgtgattttttttttttaccaagcagtagactgcaaacatctttctgttaatcaaatatcttgcttttttttaaaaaaaaaaaagtcagctactttttcacgttatgaaaagagggttccccccacaagtcaagtgaaagaacttgcccaactttcaagttctccaagtcaaggcatgggtgggtctagttttctggcgctgtggtcatccggtttccctgacagtgtcgcaggggacctgctgctggcagaaatagtgtccccagctcccctctgggaggaggggttggttggagtggggtgggaagcacccccggggagtcccgtgggattttagaagcagttcctctcaattccaggtcattgagaactgcccagtgaccggcattcgtgtgtggacggatgattttggggtgcggcgggtcgcgggtgtggagactcagcatggttccatccagacaccctgcgtggtcaactgtgcaggtgcgagtggcatttctcctgactcctgtgtggccatgctggctgctccctaaacctgctcccacctctgcagggcttctttctggggtggggagcccctgctagggcagacaggtctgcagaggcagcctgtgcacacctgagaggcagctcccaccaggtgtcagcagagctgagctgtctgtgctctgcccgcaggagtgtgggcaagtgctgtgggccggatggctggagtcaaggtcccgctggtggccatgcaccatgcctatgtcgtcaccgagcgcatcgaggggattcaggtaggtggacagccccgggttccgtgtcagtctgtggggggcacagagacctggctctgaatcccagcttgaacccaggtggtgtgacccttgtgggtcccctcactgccccaagcctcagtcacctcatctgtgaaatggggattgtaacatggggtatttccgggtggtatgaggattaaactaggtagcacaggcgtatccctgttggggctgacccccttgttcctcaggacctggcctctctttgatgcccagaacacagtccagcctgtcctgcgtggtgcaggcagcctagctttttgccatgttctgtgcccaggagtttcggggaagacccgaatgtttgcatgctctcagtgtgcctggggtgcctgtctcagagggtgctggttcctggcatgaataacctccctgagagccttctgccaagggaggttgggggcctgggttcacctcctggcacctggggctgggtgcctcctgccctctcttctctcctgtcctcaactcctccctccagggatggtggctgggagcttcctgccactttgttactgacccccctctttccatccattcatcatgcaaccctcccttactcattcctctctctgtccagccctccatctctccatccgtctctccatccatctactcccgtatctatccatgccttctcccatttattccttcatccctccacccatcccccttcccttcatccattcctccctccactctttccctccctctattcatcttgccatctcgccatccattcttccgtcctccatctctccatctatctattcatctatttatccacatgttcatctgtccatcccttctttcatatatccttccatccacccacccacctaaacttctacccatcaatccctccctccctccctctagccactcatctctccctctgcccttccttcagcatccacccacatattaatccaaccattcacattccattgaaccctctctgcatcagacattgatgggtgagcttggtgtttcaggccctattctagaagctgtggccataacacagacagacacctagttcttgctgggtagagctggggggaggtacagacaagtacatgtgcaattccagaacatgctgataagggctctgatggggtctcaggggctataggaattcccagccctagtggaccaggggaggctccctggaggaggcagctgcatctaggtgaggctcttgagggtggcatggtggacaaggagcgtgcacagagcatggccgttcagagagccagggccagaggctgtggggcagggtcagtgtgagaacagactgcccttgtttagggtcagggccagtgagagggaagcctgggcccctgagctgggagcctcgtccctgggggctgcccattgccaccctgtgccagcctggcttccctatggtcaccggggaggtaccaggcttggctgcttcgtagaccagggtagtgaagcgggtggcgaaatggggccggaacctgggtcccagtgcgctgctgcctctgactcctgtgcgctgggcaagccacgccccactggacacaagacctcttgttcatagaatgagcctctcactgcaggtggctggtgccatgtgccgggttagggactaagagtagtcacacggtgggtgtcggagctgagtgctgaggcctcctccctggctccgggtccctggggagagcctcctcccctaggtggccgccaggggtcacgctcaggtctcagtgggttctgggagggcgggcagagctgtgtcctggggcgtcagggagggtggccacagaatgtccaccgagcccaggactgtggctccatcctccatccctaattcctcccaaggcctgcctttgaggtgcctttccagggaagaagcaaggcagagttggcctaggtccctgcagctgccccctcctgtgtatgtcaagattcaagcgaagctagggggtgttacttacaaagccagtccagatcccagcgtgcctctggtaccggaggcacaggaaaagggccatcagccccagcagctctgagacctggtaggagaaaagtggagatctggggcttcgcacaaagcccctcatgttcctctgacacctggccatgtgcaggtgtctggaagttgtcccttccagaggctgcagctaggcagttggtgtgaatctgaggaaggagccaggccgctggccctgacctgcccacctgctgtggtctgacccttggatgggccacagaacaagccagggggccctctcctgggcgcatggcacctgtgcagcccatttctgtctgctcaggaagctccctgggcgtggcagcctcgtgcagcaggacgctgtccaccctgatcagacacagccacacacattggggcctgggggctccagctggcaggtgagggctcaggtctcacgtgtggttcatctttcttcttgggtggctggagggctgtgtggccccaaggacctcccttttctgaggatctgtcccaggcctgggtcctagagagctctgcccacagcttcctttgtggctagggctcatctcttccctctctgagctatcattaaagcaggtggctcgggcgctgttagggggtttcacagtcgtgctctggcgtacttttgcagtggcaaggagcggctgctccatccgtgggcagagctgtgggtaagagcctgggtgctgggtttaaacactgactcctccattacccaggctggccaagtctgtcaccgctctggttccctttcctgcaaaatgggtcataaccatccctactgcctcaggctgtgctgcaggaaggacagagtgatgcagctgggcgtggtgcccggcatacagcaggtgctcatgaggtggtagctgtgtgatgacaaggacaaggacagagggttgtgaagtcgtcaccagctggcgcttcggaggaagagaacacggagggcaggagcaatcaggcagggatcagatggaagaaagaggcagatggaaggcatgggctgaggtcaggaggcagggagtcagtggcaccagggccagactggggacagccagagcaggaggctgctgcctggagagaaaggccagggctccactggacgctgatgctgaactgggcactccgctgggtgctcagaggcagcaggatctgtgcaaggggcaggtaagtccagacatggatcctgctgggacaaacatcaggggcttccctggccaccaggtgtccccactgtcctgctctatggaactctggggctggctttgtttttagagtagtagtgctagcagaggtaaggatataactactactactactactactactattattattattattattattattattattattattattattattattatttgagacagggtctcactctgtttcccaggctggagtgcagtggcatgatcatagctcactgcagccttgacctcctgggctcaagcgatcctcccacctccacctcccgagtagctgggactacaggcatgtgccaccactcctggctaatttttgtatttttatagagatggggttttgctatgctgcccaggctggtctcaaactgctcaagcgatcctcctgcctcagactcctaaagtcctgggattacaggtgtgagccaccttgcccggctgtgattatttttaaacagtgctcagttactaggaacttctatgtgccacctgacaacgatcccctggtgcagatattctcattccaatgaacaggactcctgggatcctggcggagagggagggagcatctgccagaatgtcccttctggtctctgcacatcccctttcctgctcccagagacaggacaggggtcgtatctccctgtgctcatctccagttctggggcaggtgacagagggattgagagaaggctgttcctcgggtacagaggagtccacacgccatgcctgcttgctttctaaacggtcttgtttggtttggcttgtttattggttaaatcagtggttcctctctgcaatattatgatgatgtaaacactgcttttttgtttgtttgtttgtttgttttgttttttttgagacagagtttcactttgttgcccacactggagtacagtggcacagtgtcagctcactgcaacctccgcctcccgggttcaagcaattctcgtgcctcagcctcccatgtagctgggattaaatgtgcccgtcaccacacccggctgatttttttttgtattttagtagagacggagtttcaccatgttgccaaggctggtctcgaactcctgagctcaggcaatccacccatctcggacttccaaagtgctaggattacaggcgtgagccaccatgcttagctgattatgtaaacattgttaatacctgagcaagtagtgtccaactttttgtgtttcttggagttattaacagtttttgtcccagctgctcagtttcttttgtaactgttatgtgtgtgtgtgtaacattatcttcgtgccccaagacccatacccgttatcaatcactccccatttcccaccctgtccccagacttaggcaatcccaaatctgatttctgcctcgatggagtttcctattctggacgtttagtataaatggaatcacatgatgtctggcttctttttacggttttgtccgtgtagtacatgtatcagtatttcattcttttttgcagctgaataatactccattgtatggatacaatgcactttatccgttcacccactggtggacatttggtgtttctcatttctggttattttgaatagtgctgctgtgaacatccatatgcatgtttttgtggggacctatgttgttatttctcttgagtttaaacaagttgagcaccccaaatccgaaaatccaaaatgctccaaaatccaacactttttgagcactaacatgatgctcaaatgaaatgctcactggagtattctggattttgatttttggtttggggatgctcaacaggtaagtataatgcaaacatccaaaatcaaaaaaaaaattaaaaatgtgaaacactgctggtcccaagcatttcagataaggaatactcagtctatacactggagtggaattactgagtcatatggtaactctatttaacatttcaacgaactgtcggactattttccaaagaagctgcaccattttacattcccaccagtgaggtatacggaggggttccagctcccctccatcctcaccaagtcttgttattttttgtctttttttatgccggtcatcctagaaggtgtgaggtggtgtctcaccgtgggtttgatttgcatctccctgatgacatgatgtggggcatctcttcatgtgcttactgactatttgtgtatcttctttggagaaatggttactcagacactttgcccatttaaaaatagggttgcttatctttttattgagttgtaggagttccttaaatattctggatacaggtcctttgttacatatatgatttatgaacattttcttccattcagtgattgaaacttctattcagtggttgtcttttccctttctttttttcccccagaatccagaagtctttacatagccttttcgcttttttatggtatggtttgtagcacaagttttaaattttaataacgtccaattcatctctttttttcctcttttgtcatttgtgctcttggtgtcatatttaagaagacatttcccaacccaagactataaagatttacttctaatattttcttctgaggcttttatagttttagctcttatacttatgcctgtaatccatctcaagttaaattttgtgcatggtgtgaggtaggggtccaactgcattcttttgcatgtggctatccagttggcccagcaacattttttacaaagtctgcttcccccaaggaattgtcttagcacccttgctgaaaatcaattgactctgaagaagaaggtttatttattttattttatttttttgagacagcgtctcgctcttttgcccaggctggagtgcagtggtgtgatctctgctcactgcaagctctgcctcctgggttcatgccattctcctgcctcagcctcccgagtagctgggactacaggttcctgctaccacgcctggctaattttttgtattttttagtagagacagggtttcaccacgttagcaaggatggtctcgatctcctgaccttgtgatccacccgccttggcctcccaaagtgctgggattacaggcgtgagccaccatgcctggcagaagaaggtttatttctcgactctcaattctaatccattgatctgtaggtctatccttacttagtacctcactgtcttgattatgtagctttgcagtaagtttggaatcaagaagtgtgaatcctccaactttgtttttccttttcaaaattgttttgggtattcttggtcccttgcatctctgtatgaactttagggtcagctatttaatttcttcaaagaaactagctgagattctgacaggcattgtgttgaagctatggatcaatttggggtgtgttgtcagcttaacaaaaataagtctttcatttcatgaacgtgagatgtccttctatttatttaggtcttctttaatttcttt

SEQ ID NO: 15634 - DNA, 39113 bp, Human
agcctgtaggttgaggaactgcaccgggggtttggggacacaaccaggatggtagttctaagggaactgcctgcagatcctcacctctcatattccccctccccgaccttcctgcgcctgaggactgcactttgtccattttgccaactagaaaggcaaggctggaaccttgtcctagagccttgccctggagtgtgagaaggtcctgggctcccagcagaaacagagggacaggattgggaaaggtgttggcttcccctgcaaactcttcctaagaccccggggctttgggtctcagccgtcctgcaaattggctctgtgaccttgggcaggaccctttgcctcactgagcctgtttccttacctgtcagcctggaacagaacacctgccttctgggtgagcatggggatgaattgtctctgtgctggcactcactttgtgaatattgcatagatgtgtgcatttcaggcagtggagctgctgctcaacttggaacacacctggggaccccaggggcttggggtgggtgcagcccacacaaggaaactcgaccttgcagttggcaggttcagcaggcaccaaggaacctcgttttgtttttgacgtttttattggggtctaatgtacacaacgtgtaaccaccttaagttacagctggattaaaattgatttatgtggccgggtgcgttggctcacgcttgtaatcccagcactttgggagtccgcggtgggcggatcatctcacgtcaggagtttgagaacagcccagtcaacacggtgaaaccccatctctactaaaaaatacaaaaattagccgggcgtggtggcgggtgcctgtaatctcagctactcgggaagctgagccaggagaatggcttgaacccgggaggcggacgttgcagtgagccgagatcgagccactcactacactacagcactccagcctgggtgacaagagcgaaactaacgtctcaaaaaaaaaaaaaaaccaaaaccaaaaaaacaacaaaaccccccccccacaacttgatttatgtgtaaacccgagtcgtcatcacccaaaacaagatgcaaaacgtgtccacgggctgaacctttcaagatacagaaaaagggccaggggtggccctctcccggaatctcaggctgggaacctggtatctagttcccgcccctcactgggcagatggggaaaccggggcttggggcgagaaggtccccaggcagagctgggagcacccctaactcttcgccagctctggggacttggcgccctctccagcaacagcgaacttgggcgcccgcgccccagcaagtcaggggtgggggagatggtgacacggagggcgcggcagagcgcggctcctccccgggcggggccgacctgcccgcgcgcaccgacgccccgccccccgccccgcgcgcgcgctcccgccaggctaattaggcgcgcggtttgtttacaaacacgggctcccggcaggtgcgcgccgccccgcccgtgcgcggccggggttcgagggtggctcccgcgggcctcggggtgcccggacgggggctgcggtgctggctgcgtgcccgcttcttccatgccgtcctggggcaccggaaaatccgccgccaggcgctgtccccgacacggggtgaggagagccgtgcgggcccgggcggggaacggcccacggggtcccagcgttgttgccctgccgggcgggcgccgagccccgcccccgcgcgccccccgggccaggcccgctctcggccgggtcggcggggcgggcgggggcgcgcggggcggggcgcggcgccggcggggccgggacatgtagtccgcgcgcccgcggcctcccctgggcggccccggcgcgggcccggccgcggactacgactcccgccaggcgccgcggcgcagcgcatgagccctgctcggctccggcgcgtctattatgctgccggggccggcgagccaaagaggagccggccgcgcgggccgggaggggacggccgccggagccgcgaggccaagtacgcctttctcttgcttccttgcgcgcgcggggcggcgggcggcgcgggcggcggcgggccgggctgggccggggagcgcggccccgagcgccccgcgcagtccgccggcgcgtccgggtgaaccgggcgcccggggccgccgccgccgccgccgcctttgtgcgcggccacgatgcaacaaagcgcggcggccgcccggggtcgcggcggcggtggcggcggcggtggcgcgggctccgctcccctcctcccgctcccgcttggccgcctccgtcccggactcggggcgtcgctgcggccggggcgcgcagcccggagttggcgcggcccgcgcgccccgcgccagcccggcctccgcgcgccctccctcacggaagggatttttttccccctttcctccgcccgccatctttcgaagggggaacgcagggaggacgcggagggggaaggtgcgcgcggcggccccggcctgcggccgtgcgctccgcggggccactttccccgcgcctgttccgccggcctcgctcccgagccgttgctggggcccgcgcctggggaccgtcgccgcgcgccgcggccggggcggggggcaaggccgggctcggccctgggctctgcgcggcctcctcccagagttacgggcccagagctgactttgagcccccctgagttgccggattattgcacccaaaccagggggagacccagttcccgttttgaaatcagcctgaaaatcgcttaatccgggcgagggcgagttggagcgggagggacgggggtgcttcccctccttcccacttttggggggcgccggagtgacaacgtgatacaagcccatccggggagaaatgcgcaccccgaaccgtgtacacccacatggccctggtgggctctctgtgaataaagctggggcgtgcgggaagtcttattccaccggttgctcgttcgggggcagggccgggatgggggcttcgcgcggcctcctttccctggagggcgagaactcggcccgccgagacccaccgggggcagggacccggcgtccatcgtgtgggttcctccgttcgacccaatccttgagtggttgcgatctttaattttggttgaaagctttctgctcagaaatagatactgggatttctcccccttacattaaacttggtcattgtctgcaaaagttaaccaggaggggagactgtagtgcattggtgggcagagtaattgggctggaactgcaagaggcagcttcgtgtgtcccgtcctcccccgccctaccctgtgagaaggaacagaagaggaaaagagttttctttttaccctgctcttttgtaggcttttccccttactcttttctttaaaatggagggtttttttttttcctgggtccatgtagtatgcctggggagatcctggaatctatgcaaagttgtatggcatttttctggggaaagtagtttgttactggcttccaacggggtctaaggaaggtctgaacccctgcaaggggctggcctcgggggttagggagccctccctccgggttcttccctggcagccctgatgcagcctctcatttgcaaataaaggtctgtgtttgccgttttctctgttgaggccttgatgggtgctggtggttactgatcatgaaagataaggcacacgctgtaacaggacgggctgcaggcgagcgaggggcatttctttctgaccttccgggtagcctcagaggcccggtgcctcagcagggcaccgggtgcctggaaagactgtgggagcagctccagcctgagccctgccgttgggacatccggggaggagggatttcaaaagctttctccgagtgggcagtcactccatttttatttttgttttgtttttagaaagtagagtaattactttcctttgacaacagctcgcgcctgcttcggaagtgagtgagctttgaatgaaggacgggacttgcaaacagtgcctgccctacactccgaagtagtcatacccagaaagtgaaagtgggggtgtgcagagcgaagcagccaggcctgctgcagccggtgctaccttcctctaccctcttcctccaggctctggagatgccagccgcgggagccctgtgcaccaggcggcagtgatggccttgtgcgattcctggtgccaccaggaagtgccaccactttccctgaggcatggtggctcagggtttcccaagtggggtgattggcacaaaaccaacagctatgcccagttgtcgatgggaagagccatgttttgctgtggatacacacggtaccggggcggggtatggggaaccggggcctactcttcccagcgttgctgcctgggaggtgggggcatgcctgaagtcgtgctgcgggtctcttggttttcaaagcagttaacgcagttggtcagaggatcctcctcttgcttccttgaccggtcatcaaagtataactgacctgacggggttcctgtcctaggcaggttcctttttttttttttttctcttctcctcttgagatggagtctcgcattgttgcccaggctggagtgcagtggcacgatctcagcccactgtaacctctacctcccgggttctagcaattctcctgcttcagcctcccaagtagctgggattacaggcgtccgccaccacgcccagctaattttttgtatttttagtagagacagggtttcactgtgttggacaggctggtctcgaactcctcacctcgtgatccacctgccttggcctcccaaagtgctgggattacaggcatgagccaccgtgcctagccagcaggtcccttatatcacgaagccagtatctggttgaagctagaaggtaactggatgaatcatggtagaatgcaaggcttcttgccgtaaaaggttttggaacttgcgggtctgccttgggccttcccgacccctgtggctccgcccccttgttggagcagaagagatgcacaggtagcaaagcatgatggggtgccaggtgcatttgggtcagcgtttgccaagaatggccttgctcctgtgtttttgttggtactgccaccttgtagaggtgcccagctggtggcggagcatagggttttctttgcctattctccttcctgtgaaatcatgggcacagacatcatgggcccctgtgcccgggcctccctgctctggttcctgggctcctgccatctgagaggcttgagggcttgcttatttgtttgtttgtttgtatttttagtagagatggcgtttcaccatgttggccaggctggtctcaaactcttggccgtgagtgacccacccgtctctgcctcctgaagtgctgggattacaagcgtgagccaccatgctcggccaagatgcttgagagctcatttatttatttacttattttgagacagagtatcactctgttgcccaggctggtgtgtaatggcatgatttcccttcactgcaacctccacctcctgggttcaagcaattctccctggctcagcctgccaagtagctgagattacaggtgcccgccaccacgcctggctattttttttaatttttttttattttttagtaaagatggggtttcgccatgttggccgggctggtcttgaactcctgacctcaggtgatccacccatctcagcctcccaaagtgctgagattacaggtgtgagccaccatgcctgaccgagagctcttttaaagagaaagtgtcactttgggccattcacctgttggtggtttaaattgtaagtcttctggccactcctgattgagctcgcagtggagccaggacctgtgcgtgtggctggaggctcggaccctgttgtgtccgtgctgttggctgtctgcgtctcgcaccagtctgtggctgttccctgagagtcagttcgcaggctgcctcctcacagggccttcggagcctggtgttgggaagatggggcgtggaacatgcccccgcccccctccttgccgcaggcccccaaggtactgagttcgtcagaagttaatccggtattgtgggagacaacttttccagccacttggaaaagtgtcccgctgagggtgcagtgatgttcaggagtcgccggctggatctttctgagtgtggcttgataaccagctgcagcattttgcaaagcacccagtggactcgggtgtgatctgcagaggcggctgctggccaggcctggagtctggggcagagggagtgccctcagtgcacctgtgaggacctgggactaagagtcggtacctgggagctgtgggactctggggcgggacggccttagcctccgtgtgagcactgaccgagatgaggcacagatgcatctgtgtgaggtgcccggcccctgcaggagtgctgagtattgtagctataacctgtcatgtggcagaaggaagaatctactgtaagcggctgagaggatgccctccctgtgccatgcgtcactggagccttggcctgacaatcccacaaggagcaaaatgtgcaaaggggcagctgtgtgagcctgcgggtccagggtgccacccgcccccatctgcccacaccacaggacagagccctgggtatgctgaccaggccctcgctggtaccaggggctgggtaggaggcaagggtcaagcacggtggctccgtgggctgtggactcacagacagatgtgctgcatgcccgcgctttgctcttagctctgcctccggtctgtcccggcaacaggcctgggggcgtcctgcagtcctcggcatttgtggttgggggtgagcagagaacatagacgaaataaccaaggggatggtctgagagctgcggccctgctggccccttgtcctggctcggcatggctgagtgggacagcagtgaggccaggcctgtctcctggggccggggtgttttgtgagtttggttcttgtcaggccggctgagaggagatggagcagacagatggatgctaggtgggcctgccgcagctttgttttaggaagtgcggagcaccagggcctgaccctgaggctgtgtccctctaagagcacggtgtctccttccctctaaagggccaggtgctgtcctcactcactgcccctctgaagagagtcccctgcctgagtcgtggctctcctgcccttcccagacccgtgggagaccctgactacgtggcggtggcctggggttgggagggcctgaccagtgtctgtggggccaacttcctcgttcccagcatgtgtggagggtcgggcctcctcacgcgcctcatgagggtcccacgggggtagagcgtcctttgagtcctctctattcgaggagtgggtagagaggcgggtagggacggagcttggaagaggtgacgggttgtggccagaaggctgtgggggcgtcatggcaggaagggaaaccttcagagaggccgctcacccagggccgtggggccatggagaagcacaggccctgggttcagaaagcaggaggcatatgaggtcttaggtctagaaggcactggtgggtgcagagtggggagaactgtggggtgcaggggacagtcacgggagaggcagcgctggcagctgcacctgcccagcgtgtctggggccatgccccaggatagccccaccagtctgctgaagcgccccgggacagggctgggcctgtagagccgggccctccaggcggccaggcagctgcaggagagcaggtgcgctgtgcatggggggctcacagcactgggcagatccccctggggagtaggcgccagggctggccgtgccttcttgggtggggcccacgatgcccagctgccctccccagggctcctccagggctacagggggcccccaacccccgacttctcccctggctccatagaaggaagcagttggctccgtctgtcactgaaggcagccctgccctgacagatccagtttcccgagtcctggagggtggccgctggtcaccacgtgggccggggaggcacctctggccgcctggggacaggtgctaggttggccgggttagatggggctgtgggggcagcaggctgggatcccttctcacagactcagctccctcctgccacagccgatcacagcactgctcccagcattatcccgagaattctggggctgtggggtgttggcggtgagtctggcatggatgtccagctttgttcaagctggctctggccttctctgcctgggcgacgttgtgccccttcacctctgagcgtcccctccacttatggaagatggggctcatctgacccccactgacgcaggacagagtccaggagacgggctggagtgccccagtgggggccatccagtcagggacacaggtacagaggcccagagctatggaaattccagggctggagacccatggggaatggggagcccctgggaaaggcctcccctagcttcctccagcacccccacccttggttccagtgctcctgtctcccaccctttagctggcaggtctggttgagcccctgcagagctatgtagccctgcccctccctgccactgctcctccagactcatgctatagctggaatggccttggtaagctgtcctcccaaccctgcctgtttgctgaaagctgggactccccatccctggaccccaaataaggactttttgctctgggcccaggccaggctggagatgcccccatggtccagccgctgccccttggctggtttgccccagggtgtggcattggaggcagcacccctctgtcctccctctgtggagtgcctgaaggctaggctgctgtgctgcccaggcgacatgcctgctcctgcccctctgggtctctgctccccaagagggccatggaatggcaggaggggtcagggagactgctactggcatttctgggtgttttctttggtggcaactggacagattcccattccctccctgtttgtccacagccctgaaacagccctggactcagcatcttttctgatgaattctgggctgggccagcctaaagggggctgaatttctgcttttcattcaggtcctcctgtgccctatggagaggaaggcagagtccagggaccttgggaagggttcagggggccacccacagcttcagggccagaggtgggcctgcctggggccacacagcaagggtgaggataggtaggattcgggccacctcaccaacattccttccatgtccagcacagagcctctcttggatggggcatgagtgggacccaggaagggggctagtcagtgttaggggagcctggccactgccctctccccgctggctactttggaaatctccatggcattccagatcgtgtgtgtgtgtgtgtgtgtgtgtgtgtgtgtgtcagggtcttgctctgacatccaggctggagtgcagcagtgcgatcacagctgactgtatcctcaaactcccaggctcaagtgatcctcccacctcagcctcctgaatagctgggattctaggtgcaccaccaggcctggctaatttttttaaattttcgtagaatcagggccttactatgttgcccaggctggtctcgaactcctggtttcaggggattctcctgcccctcccaaggtgctggggtcacaggcctgagccactgcgcatggcctgggtctttcttgaggatttcaccagacccactcactgctgggttttcgcttggcgttcgaggacttttgtggtttgtctgagtttcctctctgggcagtttcggatcctcttgtgtctaaggcaggctgcctgctcactccgacttttacccgactggcaagggtggcctctgcctctgtctctgctgggcccggcaggcagtgcctgtgggctctctagcatgggctttgtgggcagctgagtgggagacccggggaggtggaccccagggagggtctctgagcctccgccccctcctctgggagacagagctccatccctgtcctgcagtgcccaggggagagcagcagtggcacatctggctccccaggcctgtcccccaaggacccaccgcttccctgccatggtcccagggatggagtgcgtttgctgaggacaaggctgctgctgctgctgcgacaggctgctgatggccaggctgccttcctgagggggccttgcccgcacagcaaagagccccctggagcgaggtggctgccagcaggctgtgtgggagccccttcaccactggagggctgagtggtgaaatgagttcttcctgcactgtacatgctcacagacccttctcggttcacattttagcagacaggcttccagcccctccagtgtccagggtccctgtggtgtggggcccccctgttccccaagaaaaggagcaagggtttacccccaggagaccacacccccttctgctgcacattcccgcagggcagctgcgaggggtgaaggagggattgcggcacgaaggttttgtgtgtctcgtgtctagactttaaggcactggggtctctggcaccactgccttcctccagcccgagtcactccacctgagtccatctgccccacccctgccccacttcctcacaggagtcccctcggcttattccccatcgcatgaaggtggagagtgggtgcaaggcagaaccctggaccccacagttgctgtgaggacgcaggatgcagagtgtgtgttgaggaacggggtgctgggggcccggggagaagggaggtgcaccctcttccctctgagcagcttccgcgggcgggggcagctctgggctggcccgtttcttccagaccccactcattttcaccccccacattatcatgaagcagattccagacacatttcattcatagaactttcagtccaaatctctgaaagatgaggacttttgaaagattgtaaccacaacgccaccatacccccaatactaactctggttccggaaatacagtcagtgttgaatcagtgccccttggctcctccagcaggcgctgccagcacaccggcccaaggcacagcctccagtgcccagctttgcttcagatccagtgccactgccccaccagctgtggggcccaggccaccccttcctggactataaaatggagccctcttcggccagccgcccaccctccctcttggtgacacagtgggctgagcgaggggatactgggttttttcttttgcagcaaaatctggcccccctttacagctgatacaaggctgtctgtagtttgaacctttgtgtatctctgcagaataccgggtttgatttgggatgtcatctcagaccctggggtaggggtgtgtgtaggagagacacctctaccccccgggaaaaggcttcccttgctggtttggctttctgaaatccaaaaagttgacagtcactacaggagtagaggcaggtgacacggagtggtcaggctctggcctgggggggacagggatgtaacaggggctggtccctggtgtccagacgtgatccttctgtttactttgtttctgggagctgggagaagcgaaggccatgtttgttttgggcagacatgttctgaatgtccaacactgccagccacactcccaatgttacctctgttcgtccacgtggcaccctggagtgatgcaaggtcctcctccctttgctgcggccccaggggacttgggatctaggggcacctccttttctccccagccaagggggcccatggtcacacccagttctagccactggctaggacgtcccggcccccagaatgtccttgcatgagtgaagctgtggcctgcgggaggcatgactctcatgcctgcgcatgggctgtggtgggaagcactcggtagacgacggccttgctaagctctcagcacaaaccatctcttcacagcgaggtcagctgggggtggagagccgggctgtgaatcctggtgtgccgacaccgcgggcgctccatgcctccctctcgcagggcctctgtgtcgggtgtgcagaccccaggggggccccttaccgcctttctgcatgggcctctgtgtctggtgtgtggaccccgtgggggccctgcaatcagccctttcagagtctccactggaccttgggttctggaggggccttgtggctggcggctggccctgccctgggctgcctttgtgtccttgctggccgttgagggtgggggaagcaggagcgcctcgttctttaacttcccagggtcttcttgctgtgtggccgcctgcaggttgaggagcctgggacaggaagcccagggtcttgatcctgggctgtgcctccactgccgactgctgagtgctttgtgtcccaaagcctttgcgctcaggtggcattccggaggtgaaggaggaaggggcctcagcttagtcgtccgtacacgtgcgcaattattctgaccttgcaggtttgttgtggggattgtggggtctcggcatcggtgagctgaagggctcgtggccctggccgaccacctgtgctgtttgtggtgtttctccactgtctgctcccacctcacctcacctcacctcacctggcagaggagccaccgacgtctgggccagagggctgaggtggggtgaacatggtgtgaaagcaccacactctgcaacagggtggctgtcctgcttgtgcaccctctggggcactcgcaggctggggtagggtgaccccaccaccgtccttctcttgttggaacctccacgttgatttggaccgtagtccatcactgattttcagctggcctggccagtgtctgtttcattgtaatttctttgtggaagcctcagttgtctttcccatctcgggatgtggccccgagctccctgcacagacgtggaaggtgcatgggctctggtcgggaagctgtttgcctcatctcatttccgtcgccctaggggaggtctttcgagttggtctgcaggttgccctggttctttccagtgtctgtgtggggctctcttgcacagacgccttctggtttcttcagcttctctgtctggacagttgagacactgagggtggcagagccaggccctggctgtggctctagcctgtccacccactgtgcttggagggaaggtgtctgcagacgggaccagccctcggccccagaggggatgacatggtgtgaatgtgctgtggacggggacctgaggcactgagcccgtctcagccctccctccccactgggactctgggaactgcacattctcccacagggaggggtcaccccgggctctcacctgactgtcgcctcctggtctcctcctgcccggcgtggtccttgccaggtggtgggtcccagtacctggtagcggagggggcttgagggggatgccacccctttgccctctggctgccctccctccctgcccctcccactggctggtgccaggctgcctgggggctccgcttctatgccaagggcttctgggggaggcagggccacttatcatggcatcgtgttgtcctcgagtttttgcaaaatctgagtgtgtggggtgtaggtgtctcagagggcagggtttgtgttccaggagaggagaggtgagatcaccatgcctcaccaccgagggtggggcagtcgcctgcccgtgtgtgccaggggctttttacactgcacccctcagccttccaggtcttgttggggttggtgtgtttctgccaggtagcggagctggaggcaaactgcaccctcagggcctgtagtgaccactggcattcagtgagcacatgctggcaccaggtgcagccccagagctttaaccacattggccgggatttccctggcagcagcaagagggcttctgggctgggccttggacggctctgccgtggctcgtgggctggtgccaagcagagcctggggcgcccctccttctgccttgctcaagctcacagtccatggccgggcggggctgccctccccacccaggacgaggcatgcactccggtgtccatggctggagctgggctccttctcagtctccggtttgaaacagtggtcaggtggttggaagtgggtggcttagagggcctgatctggccaggcgtgggatcctgacggcagcataagcaggcccccatgttgagctgtgaccgtccatcctcatgcttggaggaagctggcctgcagcctgggagccttcctttgtgccctgaccacccccacatccccaaaggtcagtttcagccccatttcctggctctgggcctgtgcagcagcagtggatactgggaatgtccccacctgaccgacacctgggagctgacatctgggccctgggaggcagcagcagcacagcctgggccttctgtcagggtgctgcccggcagtctcagcggagctgcgtgtggtgcttggtgcccataactggcgtgagctctctctgtgcctgactcctccaccctcaggagcctcgtggggaagtggaaggaccaggccgtgtggctggccccagtgtctgtgctgcctgggggcccagcaggaagggtgttctgggagctacctggaggccttggaagggcaggagcctgctgctgtccaggccttgagggagggccgcaagtcacaggagacaggacacaggtctcaggactcggtcaccccaggccccaccaaccagggtggggcaggactcgctttcactctgagtcacgtggagcccctgggaggttttgagcagaccggtgacttgatccgacttggttttaacaggatcaccctgcggtgcgggctaggcggtccttgcggggcagagcagggagccctgctgggagggcttcatggaaatccttgcaagtggtggtggcgaggggcagtgctgccacgctttggcctggggctgccctccgcaccagggttgcagcctggggctgtgagcaccgggtcggtgaggtggagaggcacccgctcacctcaggagggcatagaagagggtgggtgtgaggggcttccctggatgaggccctggcacaggtgggcgccccagagacggggcacgttctctcgtgctggcatgcttggtgggtgagctgtgttgcgtgtagtttgaagccctttcctctctggggtggggtgggaggaagtgaggttacacgcagggtgctgacgacattgagcatccagcttggggagggggtcctggtttgcagcatttgcccatggctgtggtgtaactgcccaccgaggcagatttcaggggaccaaccagatgtcacccagctcacaaacttcccctagtcttgactgtctgccccgagcgtctacaagtggccggttctggggccggagccggctcctcccatggcagagctgctgcctgtgctccgaggggagcctccagccgtgacctgtctaactgtcagttacacgactgcaggaaaggcccaagtggcagcaaggtacgaggctgaagttgaagtcccaggcgctgggttagagctcctcgggtctgccccacacctttacaggtagacacggggccacgccgcagggccctggccatggttggaggcctgcatgcgttctccactgtgcagcgttcctatgggcgttctcaactgtccgtgccctcctgggacacgcagggtggcggtggcctcctcctgccagccctgcctgtggctagccagtcggggccagggaagccccagcatctcgtgtgtgcagagctccctgtggtcagctggggtgtggaggtcggcagggtctgagccgccgctcccgcctctctgattggccgagagccaggccgggtcacaaccacgccgccatcacaaacctgggcccgttctcctggttacggtagaacctcactgcttggcctcgctcaagggcaccacctccccgcaccgtgtttgggtctgcaaacgtccgtgttgtgccggccccacttcccctggctgtgttgggcccgcaccgtggctgtccacgcatgggtcactcttcagtacattgttgtggccaagctgtcagagcccagtagcaacgagtcgaccccacgagtgggtggttggtgggcagaaggctgccagtggctgagtcccttggcacacctgcctcccagtgtgttccccaagcccccacctgggagcaagtggcatgtgcctgagctccctccaccgcccaggccttccctcccgtgcctgagagcagtggttggagagtcgttctgagctggtcgcgcttcgcctgagcagctttcccgacagcctctcacctgggtggctgggcaatgggggtgagtgagtggagcaggccctgctgaggcccgacaggtgccctcaggagcccgccgaggctgggagaggtgggggtccccggggtgactggccttcctctctgttgtgcttcctcctctgcagctgtcgcctggttgggcccggaaatgggacgtcgcgctttctcagggagcgtagaagcagccagggcctctccaagccgctgctgtgacagaaagtgagtgagctgccggaggatgtccaccgccacgacagtcgcccccgcggggatcccggcgaccccgggccctgtgaacccaccccccccggaggtctccaaccccagcaagcccggccgcaagaccaaccagctgcagtacatgcagaatgtggtggtgaagacgctctggaaacaccagttcgcctggcccttctaccagcccgtggacgcaatcaaattgaacctgccggtgcgtagctgctgcctccccaagagccacgttctgctgctgccgtcctctgtccccctcctgctgcccccatcctggaaagactgcctctggccttgggaatttgctgctaagctggggacagcctgtgcctcaggaagtccacagcacagaggcgcacaggggccacatgggcgtgggagagtggagggcggctgccccaggtgcaggaaatagggagaagccacgcgtgtccgggaggaaagcgggagggtggtgatggggcttaggagtcgaggctcactggggccttcttctgcctcactggctcctgcaggatggcccatctgccagcttggtgagcccacttggagttagaggccgagtgtatgttgaggcctgctttccaggtgatggtgccctcatctgcatgctcatttttgacctgggcccaaatagacaaaccctgagcattgcagaggaatccctgggctggcacttggtggcctgggctctgggctctgctgggccctggtcacctgcaggtttggtccctggaaggtttggccccatctccagtatgtagacctgtcctggggtctgccctaactccgtgggctcctctctgcacatgcttggggtctggagagaggttgggcaggagtttggagctggccaagtactcacgtcaccatagcccactgccttcagagaccagaaagtgcctctgggccagccccagtcctcagtccacttgggaaggtcgggctgtgtccacttgggaattgtgaaaataattatgtagaatcttctggtaatgcctctgaaaatctctttcctaggattatcataaaataattaaaaacccaatggatatggggactattaagaagagactagaaaataattattattggagtgcaagcgaatgtatgcaggacttcaacaccatgtttacaaattgttacatttataacaaggtaagaagatgcgggcctggcacgccgcttgcagtaaggattggggcgctgtgcaacgcagtgggcctgggcgctttgcagcagctcttgggcaggcccaaagcgcttcacctggctgggtgccgtggctcacacctgtaatcccagcactttgggaggccgaggtcggcggatcacttgagctcaggagttcaagaccagcctgtgcaacatggtgaaaccccgtctctactaaaaatacaaaaaaattagccaggtgtggtggcaggcacctgtaatcccagctactcggaaggctaaggcaggagaatcacttaaacccgggaggtggaggttgcagtgagccgagatcatgccactgcactccagcctgggtgacagagcaagactccatctcaaaaaaaaaaaaaaaaacaaacaaacaacacacacacacacacacacacacacacacatatattcattttgttctctcctgcgctgccaaatctgttaacaaattttaaatatttttttgagctacaactaataatgtcctttgcaagcacacagctcctttcctgacacgtgacctggactctctgtgtcttcagcccacagatgacatagtgctaatggcccaagctttagagaaaatttttctacaaaaagtggcccagatgccccaagaggaagttgaattattaccccctgctccaaagggcaaaggtcggaagccggctgcgggagcccagagcgcaggtaaagggagctggggcaggcgaggggctgggcctctctgcagaggcccacgggtggatgggctgggacgcgatcctttagccatctgagctgtttcccatctgtcgtgacgagctcgtgggtgccgggtcttggatgagtgtggcctgtgggtgatgttggaggggcagctggcccggggatacggaagacattaacgccatagctggctgcctttgagcccacgctggggaggagctcatggtctaggaggatcacctgtccctgctctccacctcccaaatcctgctcccccttccagctccagccctgaggtcacttcttccacgacgcgtggggcctgttcccctcctggggctttgtctctttagcactcatttgattctctgtgacctgagagtcactatcacctgcctggttccctggtcaagtaagaccgcgtcttgctgtcagggagcatggtggtgattagtgtcgtgagccccaggatcccacctggcctgggaacccggcatgcaggcgttgtctgggtggagaggctgactgagcgggatggccagggccacgggccgtcccgtgttgcagatgggagaagctgggggcttaagtacggccacatcgttggtcactcagcttgttacttagggaaccgagttcagtaccagctttccatgactccagggtggcccttgactgccaggccatgggactgccttggcttcctcgttccgcctcctatggtctgtggtggggggcctccacttcatgcagggagccctcagccaagatgagccagaccaaccctgcccccaagatgcaggatggggggcatctcagcatggagggttcttctggccggcggtcttggcagcacagagctggtacccgtgttctggctggaggggtggcactggaagcttctggaaatactagtggagcctggtgtgttgaacatcccttccttgtcttgaaggtacacagcaagtggcggccgtgtcctctgtctccccagcgaccccctttcagagcgtgccccccaccgtctcccagacgcccgtcatcgctgccacccctgtaccaaccatcactgcaaacgtcacgtcggtcccagtccccccagctgccgccccacctcctcctgccacacccatcgtccccgtggtccctcctacgccgcctgtcgtcaaggtgagcaccctgagtccggatgggtggggcacctgagcccggccagggttcctgaggtcagggcaggagcagcaggcggggggcccccacctttccctgagtgctggctcttgggagtgtttctctctgcgccctgggagctcaggccgttgttactgacacagatgaggagacctaggcctggggagctgaaggtcacacagctggtaagggagggcctggctgaacttgaaccccagcttctctggccagaagccctggccaaaggcttggtcaaggtggggaagttgtgggagagaagccagggtgggaggggtcccggtcctcccctgctcacactcaggagagtggtgccagctgtacctacctgggtgcgttgtgaggtgccagcacccaagctggccccgcctgtgggctccacatgggagcatggggacctgcctgtcctgctccccacttggctgggagcttttctcagtgggccctgttggtcttggcagggagtgggtgctccctgcaagatttggggctggcgaggcctggtgagtctcctgctttgggcagggcccgtgccaggcacttatgtgtattatcttcttcgatttgatcctcacagcaaccctctggggcagacagtatttcccccatcttacagatgaggaagcgggcgctcagaggggttaaatggctcgcccaaggtaaaatgccacctccgttgcttcccctccccgtggccttcactgcctgcacttatgggtggcccctggtcaagccgcctcccccagtgggggctgtttctggagcatgtcccatttgccacggccagacgagtctgtccccgctcctatccgccctgtgcggcacgcgcctggcgcttggcagcacgtgggtgcctgccaagtgtttgtggatagccggctccggcccctgccagtctgagggcggcggcttggctgggcagtgactgtgggtggctctctagacggcaggtgccgtgggctgggagccgtggctcccgctggctcctctcccgctgggctaagattagaagctggctgagctggtctcagggtgcacactgagccctggccctggaacgctgaggtgatgcccatgggtgctgggtgctgaggcccttgcaggctgcccagagagacctgcacacccccaggaggcctggacgttaaacatgcgcgtctgcctggtgcctggctccgtccccaggacacacccacagaaggttctgtgggtcatctccctcctctccttgcttgaaatggccttcggtggctcccactgctgctgggatggagtccagacttgcccactcaatccctgaggtcccttgttcccagagctgctgtggctgcttcatgcctcctggttgggctgccccttgccctgtgtctggaatgctctcctgcctccctcttgtcccgcaaaacttgtgtttgtccgcggagcccccgctctcaggcccttgtctggaactttcctggaagcagggagttcctcccaggtctctgcagcaccgaggtccccgggtcctggtctgggtgcttgttaggtgtctggcgaattgcatgcagcacctcacatggcttggggtgtgaggtgcgagcccacccgggacccctgagccctcggggctaagggagagaggtatctcccctcgcccaggtgagggcgggtttcagagttgatcctgagggagagtcccagcctcaccactgccagctgtgtgaccttgggccagtgacatggcccctgagccttggtgtcctctcctgtggggccgtgcatgtggccgcttagcccagcgccaggcaggcagacagtgccccagaaacgcggctgcagcgacatgcgtcttcggggcccctggtttccggggttcactggttatttcactgtcgcagaaaaagggcgtgaagcggaaagcagacacaaccactcccacgacgtcggccatcactgccagccggagtgagtcgcccccgccgttgtcagaccccaagcaggccaaagtggtggcccggcgggagagtggtggccgccccatcaagcctcccaagaaggacctggaggacggcgaggtgccccagcacgcaggcaagaagggcaagctgtcggagcacctacgctactgcgacagcatcctcagggagatgctatccaagaagcacgcggcctacgcctggcccttctacaagccagtggatgccgaggccctggagctgcacgactaccacgacatcatcaagcacccgatggacctcagcaccgtgaaagtacgtggccgcgcggcaggccctgctctgcccatgtcctgcggctctgccgtgggtgctgatgtcttgtgccggctgagtgggggctgtcggggagcagggtctcgcttgccggagaagcgcaccctccaggctggcccccgcagcgccggctgtggctggcaaggctcagcgaggaaggcgtgctctgcctgtgggtcccggagtctgtggctctgttgttgtttattcccatcgaacccgtttagtgatttcattgatttcattcctacctcccattctgtatcatcaggtcagggggtccctagagctgggccactctcacagttggcaaagttttaaagctgcactttgcttccctcaagccccggatacaggcgcctcacagcagacaggagtgaggcggccagtggggatggcctggcttctgtcccctaagtgcctccaagccccaccccctcacaagacggaagcgggacctgggtgggtggcagagctgagaccgagagcctggcctcccccatgccagtcttctcaaggcggcagcctctgcctgggctcttgtgtgcctcacagcaggtcagagtgagtctggtccctatggggggtggtggtgggtgcggcatttgagctgcaccgccccaagccagggtgagctccaccgggtcttccctgagcacctttccagactcctggctggcacctgccctccctctgggagagctccaagccagctcccagggacgtgcaggcagttggcagaggtgtgacctgcctcctccgccaactgccgtgcggccctgggaagagctgctggcagccctgttgggcagttgttttcatcctgggaagccagtcgcagtcattctgcctacctgaggcaggatctgctgatgaaacccttttcttccttgattgactggatctcgggcaggacagacctggctggcccaggccccagagcccggtgcacagtcaggtgaaagtgacgagcggggccgcctggctccactgccgtgggtggggaagctgagggccagagccacgcagcccagaagctgccaggagcctcggctgcagcctccagggctggggtttgtgtgtctctaccatagcacagttaacaggaatttctggaacatcatggggggttccagtgtttgggctggactcaagctcagcttaattccattttggtcaaagggtctgatttgcccttgaaaccataataaagaagctctagaaaaacaattcactttaaagtcatgatctgctttgttcggagcttcccacctctatctgtcctggcatggcatggggagaagccaggtgcagtggcagcacttgctgcccgcgactgtggcccggacgctgcggaaaaggggcagtgaatcagggagagaggcctcaggacctctagattatacagatggagcttttggggatggtttatcccggcacatgctaaaacggaaaactagcttttcccccaacatcagaggcttccaggtcccactgtgcccccgggttctttctgccagcccttccttctggatgggtctcatgtctgagtgcatagggtacgggccctgagttgggggcgccctctgcgggttaggacccggcccctccatctcactggcacctggacaaatgcagcctggaccccacagagcggtcggggtagatttgccttgcccttgcgtgtgtcgtccctcgaggtccccgacaaggtgcctctccttgaagccatcccaggatgggaaactcactccctcgggcacagcgtgacctctctttgccccaactagtgtgttcccagtggccaccttgaagcgtccctcgacgatcctgcctctggccactccctggcagagccacctgcacctcccagctctggggactgactgtgtgcccctccttacccctgccgcctggcactgtctacccaggccttggcctcagttctctgcttgccagagccaggtgggacctgcggtgggttttgctgtagggtctctgtgtggccgagtaaacgtgggtgggtgtcagccgacacgcccccgttgcctccacccctgtggggttcaggagctgccgctggacacagcgtggagtcccttaggtccagctaggcccctgggataccagggtgcttctgtaagacgcaagctggctaacagctactggcttcctcgagggaaaaaattacatttccttgtgtagactgagcaggccccctgttgttggtggagtctgactttgctgcagcctcacgccccctggggctgctgatggcgtggcggcgtgtgaagatttacccgctttgtgtgaagggaagctctggacaaggaaggggccaagggacgcctacgggaacctgggatttcttgttgagtgcatttttcttccaatcaggagatctgtctctggagtcccagaccctccctgccaagccatcaagtcaccctctcatgtcctcactttgggtttcctcgtacgaggtcccagagagctggggtgtcctgccggccaggccagtaggcactgccctggagctggcagtggctcctgaggctccagagttcatctcgtggggtgtggcagagagtcctgatgccacgggccacgctcactggcccctgtcactgtgtgttgcagaggaagatggatggccgagagtacccagacgcacagggctttgctgctgatgtccggctgatgttctcgaattgctacaaatacaatcccccagaccacgaggttgtggccatggcccggaagctccaggtaacccgaggctgggcacgggtggggctgctcagctcagtgctgtgggcatcctggcctcagtgtggggtaagcgcccaggtgaatgtccagccgaggaaggccttagagagcctcattccctcaacacctttttcccgagtgccaaccaggtccctgtcaggctctgagctgggttccaggagctgccactggggcagggcagccagcgagcaggtgggaccactggggctctgtgggggtgtcgcagtagtgagtctttccctccagggactggtgcgtgtaccaggtgggacggcagatgctctttctcttgcggcttccctgactgtagtttccagcaagtcttctgtggcaaggagaggcttggacactagcctgtcagtgcagccggtggatgaattaggtgacagtggcttgtgtagcattttgcttttctgacaacagaagtaaaaggcggattggagaaaatgcaggaagcagtgagatgtcttcagggaaaacaggagtgtcttggtctagctctcagcgcagggactttgtgaacatgcacaaacctcacagagatatttgtgtgtgtgtgtggacgtgtgtgcgtgtgtgtgctcctgcctgcgtgtgcatttttctgccaaagtccaggtcccgcacacatattttggtgtgggtggatgtgccagaatctattcttaccttctctaattgtgatcgcaggtggtttgcttttataaataacagcaccactgttataaatgttaatcaaaggacttgatttttggaggaaaggggagaattatgggtatgtgttctcttccagcatgcttttccttttcacgggacccagaatgtcatgttaagatgttctcagtccttgcatagactgttttgaaatccccgagcagcccatggtattattgtggatgacacaggacccataaaaggggcagagagagaaactcgttccccctgtgggtcctgctgcctttcccaccctctcgcgcacagggcctacccaaggtcctctcccaggcactgctgccattgccaccctctctgtgcactgggtcctgtgggtgatgatggcagggtggtcctggaggtcccactacatccagaggaagccgtcagaaccctggttttatactgagacctcgcttactgtgtcttgaacccaaaagaccttgcaaaggccagtcctctggagcctggtaaatactgggttgagtttaacgagggagctgagcatagaggacggaaacccaggcttgcagaccgagcagggaagctggcagctctgcccctgctcctgaaacaggtgctgttggatagacatggtgctcacgcctgtaattccagcactttgggaggcggaggtgggaggatcacttgaggccaagagtttgagacgagctgtctctacaacagattttaaaaacgagtcaggtgtggtggtgtgtccctgtagtaccagctattcaggaaagtgagatgggaggatcacctgagcccgggcgttggagactgcagtgagctgtggttgcacagcactccagcctgggcaacagaggagaccctgaggctgatggatttccatgactgagcactatttagcaattgtgcaattttatcagttgagctgtggggttagagcccaacagcaaaacgacctgacctgcatggccttcaaggctgtcggccgagcgggggcctggaccgctgctctgtgggttgggttgcctctggggacatctcctgagaggagagcctgggatatgagagcctggggtgggcttctccagagctgggtccagcctgaacagtgaaggcatgtcacgtgagcagacggtgtggattcaggtttctgagcttggcaaaaagaaatctcccctcatttccacatcactgtgcctccctgtcttcagtgagcctgggctgccccagggagggggatgtttgctgagaggggtgacggagggcctaggtcctggtccaaaggctttccaaagtcaattttgataggaagtctgggtgtggtggcttacccctgtaatctcagcactttgggaggccagggtgggaggatcacttgagctcaggggttcaagaccagcctgggcaacagagcaggaccctgtccctacaaaaaataaagtaggccgggcgtggtggctcacatctataatcccagcactttaggaggccaaggcaggcagatcacgaggtcaggagttcaagaacagcctggccaacatggtgaaacttcggctctactaaaaatacaaaaagttagccgggagtagtggcgcatgcctgtgatcccagctactcaggaggctgaggcaggagaatcacttgaaatcaggatgtggaggatgcagtgagctgagatcatgccattgcactccagcctgggcaaaagagcaagactctgtcttgagagaaaaagaaaattagtaaaagtaaaacttaaaaatgtgtgtgtgtgtgtgtgtgtgtgtatatttgtgtatatatatgtgtgtgtgtatatatgtgtatatatgtgtatatatgtgtgtatatatatgtgtatatatgtgtatatatatgtgtgtgtatatgtgtgtgtgtgtatatatatgtgtgtgtgtgtgtgtgtgtgtgtatatatatttgaggcagggtctcactctgtcacccaggctggagtgcagtggcatgatttcggctcactgcagcctcgacctcctgggttcaagcaatccacccatcgcagcctcccgagcagctaggatcacagacatgtgctgccatgactggctaatttttatatttttttgtaaataaagtatggataggactagactttggccttttaagccaacttttggagttcaccgttcatgagatgtgatgctgcagtcagttccggggtgaagagatgggaagaggtcaacactcttggactcctgtggctgtggaggaccctgtccaagctcaagggaagacactgtttcccgtttcacagcagaggcagccccagggagctttgggccaggaggctacaaggatgcatgcatcttctagagagggctcatggagttgctgaagggagctgtgggccagctcctgtgtcccctcttcccaggcctgtccgcaggaattgcctggggagggagggtgggcaagctggaagcaaccacagccccccaggcaggcgggaccctgtctcctcctagccccaccttcgtaacagctgtgggtgctgcctcaggggcacctcagaaaccctgagggcccacaccaaggggcagccccatgggcatccatgtcttcagggcagcctctgttctgccgcaggacgtgtttgagatgaggtttgccaagatgccagatgagcccgtggaggcaccggcgctgcctgcccccgcggcccccatggtgagcaagggcgctgagagcagccgtagcagtgaggagagctcttcggactcaggcagctcggactcggaggaggagcgggccaccaggctggcggagctgcaggagcaggtgggcactggcatgcttgggtggggttcaggggctgaggcgggattgctggcacagcagcccaaggtccgtccctttgcatggttccttcctctgccccgtgtccctcagcagccgcggtagtgcttccccgtaaagacactcggagtgccctccccaggtctggggtggtgcgagcctaacccacagcacacgtgggtggctgcggggacacgtggctgggatgtttctggagacctggcgggcctcaggtgggagctcaggggtcatgtgtggttatgtgtgccttgctctgctccagaaaggcctgtgaggcacttgcagaggccacagtagtgcctgggctccaagcagtcacttgcagtggggtggggtgcaggctccagggtcctgagggccctgccgtgcagctgcccagccccagtcccgctgccaggctgtgcttcctcccccttctctgctttcctcgtttgcagtatgggacaaatgtcacccactctgagctgtcttgaggtcagattgagaaagatgtgaattgtttccccagacctctggcagccagccagatgcatgatttctgggaccccagattgggagaaaatagagcagggctgtcgagtcaggaggggaacagcatgaatcagggctgcaaggacagcgatggccctgcagtccccagagttgggctggacatttgattttgaagtggcaaggacacacagcagggaagacggctgtgaggtggcagctcctccacccgccctctgtcttccttgcacagaccacccagaggcagggacaggccgtggactcacatgggcagtgcctctcaaggggcctctcccatggaggtggctgcagtggggagggcgaggcgcttggcacaatgccagctgcagggcggccctggattaatgctggttgctggcagtggattgttttaaccccggagtcctgcgtgttatcaaatggcttcccagaaatcactgatgaaaatctcctttgtgtgggcatttaaacttctagagagtccttccttatctgaacaatggtaataataaaaatgttagctgcccacctaatgtagatgacgggttgatgggtgcagcaaactaccgtggcacatgtatacctatgtaacaaacctgcacattctgcacatgtatccccgaacttaaagtataatacattttttttaaaaagttagctgccctcaccgagtccctgttgtgccacccgcgcagtgctgagcctgtggccaggcagctcttccccactgcaggcgaagaagccgaggcggagagggctcatgactcactgggggtcacgggagtgaggggcagagcagggcccaggtgctcctggttcacctcctcacccagctgaggcagctccgacatcgccccaagccccctccaatcccagggcgccacgcagccccagtggtgtgggccgtgcccagcacctgctcagccgcccgctcttttccagctgaaggccgtgcacgagcagctggccgccctgtctcaggccccagtaaacaaaccaaagaagaagaaggagaagaaggagaaggagaagaagaagaaggacaaggagaaggagaaggagaagcacaaagtgaaggccgaggaagagaagaaggccaaggtggctccgcctgccaagcaggctcagcagaagaaggctcctgccaagaaggccaacagcacgaccacggccggcaggtgggctccagacctgctcgggctccaagagcccagcgctcagcacgccatgggggctcatgtagcagcagtgctgggattgggggctttgtgccttggccacctggaaaccagggtgatgggggcagggagacagagggcctgatgagacctgtgctgggaagtccgggggcccaggtgatgctgctcagttgtctgcggggctggcctggattctgggcattgaagcgctggcacggcctggtctccacatcatgaagcttttgggatgtttctctggtctgggccaaggatcttgactagggggagttgaacgccccgttttggacttgcccataggcagggggcagggatggtggaatcgtgcacagctgcattcagcctccttcgggagcccctgctgtggctgggcaccaccctgaggagcgtctgctagggacatgcaggagccacaaagcagtgtgagctagtagggaaggagctcaggcccgggatgggagctctcctggccaggtggaagggaggcttcccaagggggaggcaacagctgtgtgggagcaagcttggcagcagagggccagggagggagttccaagaacagggaacaacgggtacaaagccacagaggccagtaggacgtgttccttttgggaatgagggcaaagttggcaccactgaaaaagaacaagttgggaaaaaaggtgagttgaggctgctgagatcagccggctttgtttgaggtgttcatgcttccttttcaagcaaatgaaggagagttaggatttaagctcaacatgatcagatcctcgccactatggagaatagcttagtggaaatcaggaatggaagaaaggatacccctttggaggttatggtggttgtgcaggcaaaagaaattggtgtggctctggagatagactactttgggaggcggcatggccaggccctggtgcttggagggaggaggggaggagcatgggggtcctgggtttggggttagacagctgggtcagccattaatgaagacagcgagtggaatggtcgggataggtctttccttcccttattttctccctccctccctctctcctttttggaggcagatgcagaaatccatttttcttatacaggttgagtatcctttatctaaaataaggatgtttccaaaataaaaggtgcttctgattttggattttttcagattttggaatatttgcattatactccccattgagcatctcaaatctgaagcatctcaaaactgaagcatctcaaatctgaaaatctgaaatgctccagtgagcatttcctttgagcgtcacgttaagactcagacagtttcagattttggagcattttggatttttggatttgggatacccagcttgtactatctttgtctgtttttagtgtcagtataatgctggcctcaaaaatgagttgcagcctggtgtggtggctcccacctgtaaccccagcactttgggagggccaggcaggaggatcacttgagctcaggagttagaatcctactgtgttgcccatagtggtctcaatctctttacaaaaaaaagtgttggttgggatataatatttgagtgattagaggcaagtaaaaagtgatttgaggccaggtgcagtggctcacacctgtaatcccagaaatttgggccaacatggtgaaaccctgtctctactaagaacagaaaaaattggccgggcttggtgacgggcgcctgtaatcccagctactcaggaggctgagacaggagaatctcttgaacccgggaggcagaggttgcagtgagccgagatcacaccactgcactccagcctgggcgacagagcaagacttggcctcagagaaaaaaagaaaaaaaagatttgaaaggtgttgcccctcttctgttttctggagtaaatgtatagaattgatattaatacttaaatgtttggtaggattcactagcagaaccatctgggcctggagttttgattgttggaaggtttttaatcatgaattcaattattttaataggtataggcttattagattatcagtttcttcttgagtgagttttagaggtttatgcctaaggcgttaatccattccactcggattgtcaaacttatggacataagtctattggttagtatttctctattagccttttattgtctgtagggcctgtagtgatgtgtctttttcattcctgatattggtaatttgtgtctttttttcttggtgaatctggatagagacataccaattttattgatctttcaaagaaacataattagatttcattgatgtttttaaaaaaaatttttacttttatttatttctgatctttactgtttcctttgcttagtttagacttggcttctttttactttttaaggtagaagattagattaccgacttgaaacctttttttaattttttattttttaaatttttttgagaaggagtctggctgtgttgcctaggctggagtgcagtggcacgatctcggctcactgcaacctccgcctccagggttcaagtgattctcctgcctcagcatccctagtagctggcattacaggtgcccgccaccgtgcctggctcatttttgtatttttagtagagacagggtttcaccatttggccaggctagtcttgaactcctgacctcaggtgatccacctgccttggcctcccaaagtgctgggattataggcgtgagccaccgcgcccagccctgcgttgtccttttttcctgaacatactcctttttctgaagtttactttgtctgaaattaatatacccacaccagctttcttttgactagtgtttgcatggtatatttttttctcacttttttccttttaacctacttagaacattatatttaaagtggcatttgtgtagacactatgtaagtggggtcttcttgtttttttaatccaacctgagcatctcttccttttagttggtgtgtttagaccatttatatttctttctttttttctttttcttgaggcagagtctcgatctgtcgcccaggctggagtgcagggacaagatcttggctcactgcagcctccgcctccctggttcaagcgattctcctgcctcagcctcccgcatagctgggactacaggtgcccgccaccacgcccggctaattttttgtatttttagtagtagagacgaggtttcaccgtggtagccaggatggtctcgacctactgacctcgtgatccacccgcctcggcctcccaaagtgctgggattacaggcgtgagccaccgcgcccggccctagaccgtttatatttcacataattattgatataattggatttcggtctctcattttattattttctttttcctctgtgttttctgttcctttgttcccccttttttgccttcttttggattacctgaatacagagatcatttcttgacctgtggagtttgagacgcctatggggtgtagagaggaacgaacctctgtaattgtttcctggccaagggctggaaaccccgcagctgggagcgacttttctaaccttggattttctgccttggggcaccactttgggaagaaagcttggtcccagagagcagcctgctgttgggaggaaggggtgtgtgcagtgggctcccacggcaggtagacggagactcaacaccacgttgctctgtctcctgccccagacagctgaagaaaggcggcaagcaggcatctgcctcctacgactcagaggaagaggaggagggcctgcccatgagctacgatgaaaagcgccagcttagcctggacatcaaccggctgcccggggagaagctgggccgggtagtgcacatcatccaatctcgggagccctcgctcagggactccaaccccgacgagatagaaattgactttgagactctgaaacccaccactttgcgggaactggagagatatgtcaagtcttgtttacagaaaaagcaaaggaaaccgttctgtaagttgcctgcgtggagcgtggtgcttgaagttcctctcccctccttggcctgcccctcctgtcactcctcacggaccctgtgcggcgagcttgggcacagggctgccacgctgtcttggctccttcgtcccaccacagatgccctgaggatatctgtgctcacccagggccagtgggcttggggctgaacccaggcctgagccccacccagccagagccctctttccctgttcttggggacatgggcagcactgcgtgccttggccttaaccttgtccaaggagtgcgcgactctggggctgggctccggccccaaaccccattcattcagggcccagttggggtcctcactgcatgccttcctgaggctcccctccatttggggccttggctgcaggtgacctctcatggtcccttgcagggcagaccagcttgtcttataacaaggacaccctccctttgactggggtcacaagtccagaagcctcacaggacggaccctggggcaccggcccaggcttccctgaagtcagtggcaggaacgagtcactgctggggtctgcaggtctggcagagtaggagggagggcagacccgaggcagcccttgtggcagcccccataggctgtcaagtgagtgcagggctcacttgaacttgcatgtggcctctcgggtgtgcatgggcctcacttgctccttttcctggatggaatgtctgtgtggtcatggtgcgtctgacccacggtaagtcaccgggtcaacttggagggagcgactcaggagtgtcaggcagtggagaccgggcctcctgctcgggcagatggagagcagcggccctggtgaggcaggtccatgaatcagaggctctgccctgcacatgagggacgttggccaaaccgcatcctgtccgtgcacctgtttgcgccataggaatggcctctgtcaccttaggatccaggctttgctcaccctgagggctcagcagatgtgggtggtggtgggtctgtctcatcccagtcatttctgccactcgaagccctggtgacagctttgcatctgtcagctcccagactcatgaaagctgggcagctggcatggatgccagtgtgcagggctggggccttggccacctggatgcagccctggctcctgccccatcggtctgctctgcagtctgagtgcccatttgttccccgacagcagcaagcgggaagaaacaggcagccaagtcgaaagaggagctagctcaggaaaagaagaaggagctggaaaagcgtctgcaggatgtcagcgggcagctgagcagcagcaagaagcccgcccggaaaggtaccgctggcggccgctgtgccacccctctttaggggggtggggggtgtcagcagtaggggtttgagcatcgagcaggcccacgtctgagtgtggcttacctcctgatgagctccatgttcttagacgagctcttgagctcctgaaacctccatttcctggtctgtcactgggggtcataccccaaccctgcagggaggtgtgcacatgtcaagtgtgtgtgaacacagcccattccagggcaccacagacagaggaccccccaggagagggctcttgtggggctggactgggcagcccagccagtgagctgggctcaccgtgagctttctgactgttccctggcagtggcatcagttccatggcaggccgaggtagcagaggcgggaggcccagccccatgccctgcgctttgccaggtcctttgctcaggggagccagcatttgagcccttgcctcctttttctggaccctgttagagcacacatctcttttcctggcttccaggacacacatatgggggggacagtagggtcctatctggactggagcatgttctagctgggggccatggccttgcgacatggtttgcccagtgtcgagacagggcccatgaccctgcccgctgaaggggtctgtctcctgtagtcactctttggacgccccaggcagagtaagcgctccagaaacgccagcagctggtgttcctgtcgctgctggtggccatgtgactggtggatgtttttgatgggcagcctttctcgcatccatcatttcctgttagtagtctgcattcatttttttcctgtctcaagtatattcagatagtcttgttgacctgattaatttcaataaatacttattaaacgactgggtcaggaagtgggtgggtcgtggcacccagtgtgatggtgtcacgctggcatggacgacatgccgccaagcgggtcaagaagcgggtgtgcgagcgcatctccctgcccatgtctccacagagaagcccggctcagcaccctcagggggcccgtccaggctcagcagcagcagctcctccgagtctgggagcagcagctccagcgggtccagctctgacagcagtgactcagaatgaactggcttcggacagaacaggacagatggatgtcgcacacgccgagactctgccgtacccctctgtggttcatattactacttctgttccatggtgtgcaggtctgcttcttaattcagtgttatgatatcttccagtttttgctttcataggtcagagatctatcttgtgtgtgcgttagacttgatgagaaggtgtgaactctgcagaaagtctcttcttcatcactgaattcagtcacttggagatgacaacttcaaatgctaacccgatgaccccagaaaaccgtgtgagattcgtaccgaagaaccttgtggaatccctttgcttaggcccaacctggtcgatagctcgagaaagaattttttccaaggaaatgtctcggatatgggtactgtatttgaaagctgttagctttgtcaacacgcattgtccttgtcatttgggccccgagctctgaccctcgtgtctgacgcggccacctctttctggaggggctgaggacagatgtgcctgcttgtggagaccaggctgggcctaagcgaagggtcatcgcagccccagcccggagcgtggagcccttggggggtggtcgggtgggatgtgcgttctccgctcgtggtgatgtcaggagctcctcggagggaacagagcggctgtgtatgcagcctgcaggtttccatacactgaagcttttacctcaactttaaaaaaaaaaaaagaagaaaagatttaaaaaaaaaaaaaaaggagactttttttgtaaggttcggcaattttctacggaagtccagcccgctgtgagtccccgcctggctagcgctgcccctgctgctgctgccgcgccacccttgggaaccacttcccgagcttatgtgtatataaatagttatttattaacatcattggtcatttttaaaaaaaagaaaataagaaaaaaccgcagaagaaatgcattcacacagtcgcagagatgcaggccttgccagtggtgtgccgggcgcgggtcctgtctggcggcggcctgtcgtctccaggtgctaactcctgccaccgcgcggtgctcacccacgtctgttcgcgcgctcgcccctgggtttgttgggttttttggtttttttctttgtggtttttttttttttttttttttgtatgaaacttggaggcttacaggtatagacagctttcagctacagcacattctaattttttattttgtttagttcttttgtattcacttctggtctctttaagactgttttaaaagaaatcaatttagggaaccccagttatataatataaactttgtaatctgagagaaaaaatgtatagtaaatctaagtcttgatttttaactttctattgtaaaaaataataatatacagagtttaatagaaggtgatgttttggttttgttttcccagaggctgccatatggtctttgagtacggggatgtcccaaactggcccaccaatgagcatggcggctccggccaggaatgccagagttagcctcccaggcttgcgggtggacatgcctgctccctgccagcctccagtggcctggccaggccctcccgagcctgtctgccctccccaggggtggaggagtctctgggccccaggaggattccctcccggagactcgcacggtgctccctgctcacgcgttgtcacagttagtccggaaatgactgaaaccaggcattctcccggacctcagcgtgggggagcctccaggcagacgctgggtatggagctgtggtgtggtctgtcctgtatggtggccagtgctttctgccagcatttctggatggatatagggactatcattagtatcctaatacacggtgattttaaaacaaccataaaattgattcagagtccactgacccttacagatgtaggtatacccttactggagagggaactctgatgaggagatgctggtaaattatcattttttaaattgctggtgagtctgacacttggtgagttttcagccagtttgttaaacttttaattaagttttgtttataataaaaatataaatggatttgaaagtttccattttttaaagttaccctcgttttcaaaggtattttctaaacagatctttaatggactatttaaaccgaatttaaggaattcacacacgacagttgacaggtcttcacgcaggctggttggtaacgtgctgccagcacagggctgggtgatacgtacaccctaagccgggggtgcctggggctggggggcgctccttgcaatgcccctccagccacagggcagtgaggtgctgcctgtgtgagccgtcgggggagcggccggctgtgggggcagcgcagcaggagcatcgtggggcctttccttctcggctggttctctgtgacggtggcgtcggctcgcctctgctcctttcatctagaaagaagccactgaccctgacagcccacggcgggtacactgagcagctgcattggtgctgtcacttttttaaggctttctgtccagacttcaacactggtttcttttcagagtttcgaaggattaatgacttcctcagcgcccttgctggcgggctgagggtgacagtcacgtccgtttcttctgtattagaaggctgcggtgattcaattagattgtcccactgctgagacctgtagggcagcttctaacatgcttttttcaaggggagaggagtagtgacaagtcgtgtgtcggaattggatttgag

SEQ ID NO: 15635 - DNA, 153643 bp, Human
  misc_feature (1)...(153643): n = A,T,C or G
ggtttggaaaattcaactggccacagaggatgacagttttgtctgaccaaggagggaaagggcaaatagcttgattctggaataacaaatttgaagtcaatttcactttaccactgtgtatggctgagcagacagaggtcagcttcaggataagaccgagttcaagtcctgcttctatcacttctgtgctgtggcctcaggcatgagtctgggtgggttacagagaggaagcagtaacagctctcaggccttccctgtccaaatgtctcagattgaaatctgagtttgacctctacttccagcgtggccagaactatgatgtgatcaaaagagcccctggccttgctgtctgccctcacagttcccactgttactacaggatatgggaaaaacagactcccccaaagcacatctataacagacagacagcaaatgcagattattgatttgggctattgttttagtaaatcaacattcttagagaatttctcagctctcaggtgcccacatcttagagttaagtcacattttgagggttgcccaggcaaattcaaagcagcaccaggccctagtggcagctacttcatctttaggcagcatttccctctcaacagggagcatgccacctcccctgggtgcagatcccaggaaaagttacactgaccaaatcaggccactccctgggactgtttcctcaattttggttaataatcaaaggatgatctgaaatcgcaaagaagagactcttggaaaagacataattatggtgccacccgacttaggaactggcatccaagtccacctgtgtgactttcctctgggcctcagtttctccatctgtaaaatgaggtcctgtatttattttttgagacggaatctccctctgtcgcccaggctggagtgaagtggtgtgatctcggctcactgcaacctctgcctcccaggttcaagcaattctctgcctcagccttccgagtagctgctgggattacaggtacccgccaccacacccggctaatttttgtatttttagtagagacggggtttcaccatcttggccaggctggtattaaactcctgacctcgtgatccacccgcctcggcctcccaaagtgctgggattacaggcgtgagacaccgcacccggccgaggtcctgtattaaatggatccttgccagctcctacaacataaggcattaaatgttcccacaacttgctccccgccggctggcagcgaacagggctaaagcctcgacttcctcagaggtgaaaaggtaagcaaacattccgacctcccctagccttgctctcggattggtgctgggcccggctcccaccgcctatcccgaccacatccgtcatctggactgctaatacactcattagcataaagattcctccgaagacctggcgcacggggctgaaccggagtctgtccctttaaggaagagggacagccactctgtccctaagggcactaggcactgcatttcctccacacgggccacgctgtaaactagacaggttccgtgttaatccactctccctcctcaaccccgacagggggatccctggagtgaacaacgcgcggggtcccgggggactgcggaaaggtttggcctctgcgcgtagcaggctccgccaggcaacctctcgcccgaggcggcggcgagctgcaagctaggtggagccggctgcgcggcgggaccccagcgccctggggcaagaccctggtgctggcgccagggcagccgcgggaggtggcttgtgcaggagcggagaggtgcgcccaccccggccccgggcgcgaggggggcggggcttgggccgcggcccggggccaggctcgcggggatgggcggtgctgggtctgcgggagcgggcggggggcggggcgcgcgagcgggctccgggggggcggggcggcggcgcggggcgggctctggcggcctgagtgtcacacacgcggcggctcgggaggcggcggcagtggcagcaacaggcgccgccgggacgggcacgggcgcgcgggctccggcgggcgccggctgccttcctccgtcgctcgctgtctctcccggccgcattctcctccgctgcggggccgagctctccccagcgctcgcaggaaggaagaagggagccgaggacgccgagaagttcccgcggcagccgcggatcccggccaaggcggaggctgcggctccgacggggcaggagcgcgatccacggcgaggggcgtacggccaaagggtccgcggcgtggagcgctcggaccttccgctctcccccgggcgtgggccgggaccccatgagacgcgcccacgaggggcgcgagattcctagcttgggcggcgctaggcggagggaggtgttgcagccgccggagccagagagctgccggcaggaggcggcggcggcaagaacttgaacttggcgtcgggagcgggcgccccggacgccccccgccggggccggggcgccgagggacctgcgccgcagcgctgccccccgaatggccgcggcggcggaccgggctcccgcgccgcggccctaggcggcctctcgccatggccaagtggctaaacaagtacttcagcttgggcaacagcaagaccaagagccccccgcagccgccgcggccagactaccgcgagcagcggcgccgaggcgagcggccttcgcagcccccccaggccgtgccgcaggcctcctccgccgcctcggcgtcctgcggtccggccaccgcctcctgcttctcagcctcttcgggctcgctgcccgacgacagcggcagcaccagcgacctcatccgcgcctaccgcgcgcagaaggagcgagacttcgaggacccctacaacgggcctggctcgtcgctgcgcaaactgcgcgccatgtgccgcctggactactgcggcggcagcggggagccaggcggggtccagcgcgccttctcggcctcgtccgcgtcgggcgccgcgggctgttgctgcgcctcctcgggcgcgggggccgccgcgtcctcgtcctcgtcctccggctctccgcatctctaccgcagcagcagcgagcggcggcccgccacgccggccgaggtgcgctacatctcccccaagcaccgcctcatcaaagtggagagcgccgcgggcggtggggccggggaccccctggggggcgcctgcgcgggcggccgcacctggagcccgacggcctgcggaggcaagaaactgctcaacaagtgcgccgcctcagccgcggaggagagcggggccggcaagaaggacaaggtaaggtgccccttggcctcttcccgaggttccagagccacggtgcgcacggggaaaccgaggcacccgccgctctggtgttgagtctctacttcagcttcggcctaggaccctgggtcggggctggcgtgctgcttcccgcttctgcctcctcccgcgcccttttcctgggaccggcggcctcctgaccccacctctttcgccgctgcttccagaacgtcccctctgagcgagagcgcccggcccagccttgccccaggaagacggacccagtcagtccttctggctgccaaggagtaaagtcagagtcagagctgtctaggacttcgaagagctttgactcctgacaccccttatcccagcctccaccctccgctcacgctgtaggtgggaaactgaggtccagagcaaggaagggactcgcccaatattacacagctttcttggtggcagatccggaccggctgtctccagcgtgtatatgtaaatctctcgcggctgccctgcccggccctgccctgccccacccccagctctaggtttccaaatccgggctgcctggtaccggagctgctccgggaacctccacgcgtgcttttccggttgaaatgcgctgcctgcaagagcgctcctcatcgaacccgtcagttcctcccgctgcgcgcgggagggggtcagcctatcaggcccggctggaaggagaccccacccctcctatcctcacctgcttccttcctgacctcacccctaccccataaggtcccaggaacacggggggactttgtgacagcccccttcctaacgcattaggccacctagattcctccctttgaagcagacgagttaattacagccagactaggtcccctcctcccccttcacactcctgtgaagccctcccttcccccataaaataatacttgttctgtcttctggtggaaggcagtgttttgattaaatctgaggcccggtgggagagctccttccttctcagcgccctggtgcgtggctgttgttctccccaccttcttcccccaaaggtaaacctttgcccaggcctgggctgggggagactgattaagagtctgagttccttttaggactggatgtccagacaggagggagacaggctcttacctgccatctggtgcttggaaagggatcttttttgtttgccaggagagaggaggaagggaatgtccctctagtttttctgcctggcctcccctccccgaggtccccagaatatcccctcccctgtttgatctgcatgggcagtccgtggaagatcccacctctccctggaggcagtttggggcacccctcggaagcttggactctgggtttctaaagcacctaggatgccacacctagatgacgactagctgggagccaggtggctacctaggagctgctttgggagagggggcagatttccctgggagccaccaggaccctgggcctgtgtttggtcagtgagggaaacaccagataggctccgtgcagtcttatgcatggctgaagcttggcttggtgcaggcactggggaaacctggaggtcttgtatataaaaggcacgagagggtcacggctaactgcactggactttatgcatcctccttgttaccctgcagccacaccccaggtgggcagatctcctttctcttccactgctagtggttcaaaacttcagtaaacattttttcccagttacagttaagactgtttcaaacactaaggaatgatttgttttatagccaggatgtcaagatatttaagacttgactcttttcatcaccagatatttcttacgggtcttctctgtgtcctcccctgctgggtgctggagcagggaccctctgcagcgaatgctatgacagaggccatagtggcgtgatggtgatgagtgctatgatgagacctcgtgttacagggttacaggagggatgaagggcaagggagaggttggggggtgtggcatcgaggagtgcaccttggaggcagggccattattgtgagggaggggtggtcaccatggttggctggagaagaaccctgtgcttcagggaactgcaggtgaagtcccttgtggctgaaattgagaggttaagagttgggcagggcctgagtcagggaggaccttgtaggctaagcacagagggggcctgtgaagggatttagctgcgagagtgttgtgatcagatatggttttttagaagatctctctgggttacttttcacctactaggttgtgactgcgagacctttgatcttttgagaagttgtccagatgttctttctacccaggagggaggaggcagccagggaggctcagcaggacgttatagtgcagcgatcctcaaactttagtgcacctatagggctggttacaacagattgctggggcccatcctgcagcgtctgattgagcatgcctggtgggggacctgagtgtttgcattccatcatttcccaggttgaggggaaatggctgagggtcctgggaccatggtttgaaaaccactcatgcaacagtggcttctccttaactgtccctctgggtcttctggtcagggcagccttgggatgcagagactctggatgcccttgtttctgccatctgtgtgtggctacctcctgatcctgggccagcacccctccacctccaccccatcaggcagtcaggaagcagttgttttcacattatttccagccagacagcttttgggaggccaggcacactgtagatccggccttccttctgcccctcactcatggatccaggaaaaccacttctggcacctcatttagtctttatctattgttagaggtctcactctgtcacctaggctggagtgcagttatggctcactgcagcctcaacctcccagcctcaagcaatcctcccgccttagcctcctgagtaactggggccatgtactgtcacgcctggctaattttttttatttgtagagaggaggtctctctgtgttgcccaggctcctgggctcaagcaatcctcctgccttggcctcccaaagtgctgggattacaagtgagaaccacggcaccctgccaacttttccatttagaattatttggaagagaaactagccttactctactggtttctcccctaacatagcccactttttccagcatttactttgtactcagagatgtcttggtacaagtgtgagtgaggaggggaggtagtgaaggatgcaggagacttgtccatgatctctggcctgagctcctggaggagattgacaggaatttcatcctttgtttcccagtgtttttatcttgaagaatttgggaagttcatcacctagaaggtggctttgagctggatctagggttggaagtggaatctcagctcaggggagagggtgactgcacgctgcaggagtgcttatgtgtcagggtgtgtatatgtaagtgtatacatgtgtgtgaacatagacgtgtgtgtatgtgtataaaatctcaatgtgaggcctgttcttggaaagcagcactttcatgcagctgggccttgtttggggaatgagagatgacagtgtgagagaggtaggggcttgaagttggaccccacaggggagaccttgaaggttgttgagccagggaagggatgtactcagagccatggtggaggggcatccaggctataaacagctgccaaaatctggggaaaataggatcaaagttaggggacagttgtagttctggtgagagacggtgaggtcccgagctcctgggatgagaaaacgaaactggaataggtagacacagtattccttcaagttgtgctttatgaaaaaaaaaaaaaatgatgacaaaagaggccagttactttggtaggtctccttttgtgcagccaaacaggtctcatccagttatattttctgctgaagtcttgtttcttttattataattaaataaatgttgtttccaccacaactaagtcaggagcatcatgacatcagttttcccaggttttaaatacatactaatgtgtaccaacactttatattttgtcagcatccagagttgagttaaataacactttttccatagttacagaataaataatatcatgtctaactttaaaaaaaaaaaaaaaaaacatccagcaaacagtttctaaactgcctgctaggcagagggaattcagagagaagtaagtggtggctaactttccaaaaaggaagcttctcagtttgcagttgaataccagcttctcccggtctagtcagggagacagatacaaccagagagacaatatcacaacccgaggaatgccagaagtgtgtgcagagggttgggagggcctgaacttggctgggaagccaaagagggccttcagcagaaggccactcttgagctgagtgtagaaggctgagtgggaattcccaaggcaggggagtggggaagagggcttttcatgcagaaggaataaagcagcctgtgccatggcctggaggctggagaggatggctgggggcagcagggcaggtgtggtgggagactgcagaaggaggttggagcccacaaagggaagaaagtcccatgtgccttgctgcggagttgtgaattatcatttgtcctgtttcacataaaatcattgatgtagggcttgattgaagccggggtcaaacatgagttgtcagtcattcccatttgatgaacagccacactctccagttcttaaaatatcactaatggcaaaggtcagggttgcacttgatagctgtggtttggcttgggacactttcccctttgaagtcccatcccctgaaagcagtgtgagagaaatgctgcgtatcaaatccagtttttcctggttgattccccagaagggaaatacattccccaggcttcatagtaaccacttaatcggtcatttaatcctcactgtcccactgggagaggcttgagtactgtattagctgttgctacataacaaatcaccccaaaaccgcccgtggtttgattgtgggccatgctgtctctattgtagctcttcagctctgccactgtagcttgaaagcagccatagacaatatggaaattaatgggaacagctgtatcccaataaaactttatttacaaaaacaggcagctggcctgtgcgctctagcttccaacccctgctttaaacgataaggttttattatagccaagagcctgcatatctgagtcatttttctagtctcagttgggctcactcatgcctttgcagtcactgggggtggggtgggtatgcagccctgctgatcctggctaggctttcttacgtgtttggtgggctggtttaggatggccttgggctgcaacaattcagctctgttccgtgtggtctctcctcctccagcacatgttcatatgacggcagcagggttccaagaaaaagcaggagcgcataaggtctcttgaggttggaaactggcatggtgacccttctgctgcattctgttgactaaagcaaatcataaggccagccacaattcaaggagagaggaggagctgcagtgtcccatggcaaagggcagggatacaggcaagccattaattagggccttcgatgccatcatctaccttatccccatattccggataaagaaactgaggcttagagaggttgatgacttgcctaatgtcacacagctgcaaagtgatagagcaaggatcacaccagtgcagtcttgagttcaaaacctatatgcttcctctattttccgtggtttcaatggaaataagtagtatgaggcttggatatttactggaatatatgttacatgtctcctcctcccctttacttaatgctactcttcttgcatccctctgctgtaatttctccgctttcagcctttgctttggtgtccctagaagaggccctagagctggcttttctgtttctctgtctcccatctgcctcagagttccagaaatgagatgttaatgcagcacttgagttattttatagagaaattctgagcacagagttggcacatcccaagggacagctgcacaaaacgtgagtcttgtaactgtcatgtcttctcattctaacaccaagcattccttcccttcaaggatttgccgggctgtgtgtgctctgtttggaggaagagactggcggtacattggccctgatcaacaaggaacttaagtttccttgaaggagatcaggtgactgtcctctctaatctgacaatctcagaacatgactgattaccccagggcttaacccccatgacttgaccctatcctctctttgcccccagagcatttctgacccataaaaattagctttaaaagtcaaatctgaaacagctgtggtttcttctgatcagtcagcaaggtctaacttgcctgtggtcaagccttcccctgattagcttagcttgtgctgggagagcccagaagtggtggcctgtggggaatgggtaggccaggcttggccctagaaaataaactgggacgtgtgactttccaacagagctcgcatgctggctggctgacggcaacacaccctgtggctttgtgaggttggttgatggtggtggtaggggtgatgtattttctatttctttttttttttttttttgagacaggatctcactcctgtcccccatactggagtgagtggcacgattacagctcactgcagcctcaacttcccaggctcaggcgattctcccacctcagcctctcaagtagctgggactatagtcacacgccagcacacccaactaatgtttgtatttttttattgcccaggctgatctcaaactcctgggctcaagtgatccgtctgccttggcctcccaaagtgctgggattacaggtgtgagccactgtgcccagaaggttgtgcattttccgcaggacaaaggtggtggtcgtctctgacttcctagctttcatttggcctgtgctgactgagcaattgctatatgcaggccaccatcaggagctgtgtggatacagggatgaaccagggcctggatagtgcccgcccctgaaaagcttatcttttggttgaggacacaggaaccaaggttgaaacccacatctgtatgtcagaatttatctgtaaataaagtggtgtgggtgagctaaaagctgtcttggcacagagactgttctgggcagggccttgatttcatggagccacaggagatgcagggtgaggaggaggtatttgagtaaaaaaggtacaatcacttgaattaagggagttttccactacagtaatattagctaatacttttattatacatactctgagctaggtgcagttctgtgtgctttgtatgtaactttactcctcactacagtcctttgaggtagctactactactgctacttctattttcatttttacatatgaggaaaccaaggcacagacaggttaagtcacttgtctaaagtcaggtcggtggttcatgcctgtaatcccagcacttcctgtaatcccagcacattgggaggccaaggtggatcacctaaggtcgggagttggagaccagcctggccaacatggtgaaacactgtctctattaaaaatacaaaaattagctcggcgtgttggcacatgtctgtaatcccagctacttgggaggctgaggtgggagaattgcttgaacccgggaggcagaggttgtagtgagccgagatcaggccactgcactccagcctgggcaccaaagcgagacactatctcaaaaaataataataataataataaagtcagacagccagtaagtggcagagatgagatgtgaagccagatctagcatctgtttgtaaccactgtgccatactacctcaagctgcacaatcccatgcctgaatttgctttatcatctctgccttatttgtggctagacttactctttgtaaaatgtcccctctgttggcatggtagaagtgactgattccaacatttatgtaagtattccacagcttaaagggcactttcacaccggtaatttgtttgcttctcagagccactctgcgaggaatgggctgtaatctcccctttgcagatggagaaacagaggctcatggggaggagtgcattcttccctgcctcacagcagaggcagagctggtggccagtacctgctgtgtgtgttgaccttgtgttgaggccagtgccctttgtgccggggtggtgtggaggtggcgtggccgaatctggagtctacaggaagggtgacagcctgattgatttccgcttcttcccgtgttttgattctgaaacactttgctgagaccattaaggagcatcgacagaggaccttgcttccacaatggaattttccttctcttcctgtttggtattttccagtaatatttctattaatgtttcactttcagcggcactaacttcctgagagtttgagctttcctaactcccgaggcaggaagaactgaattttcctctaaatcattcagttcctttccagtttctccaaggggagctgtctctggatttcccattatgctgtaaaggaaggatcttggaggtgggtccaggggatggagagagaattagagccccactgagtgactcaggcccagtgttttccaagcaacacgtaatactcctggtcagaaaggggcttcccacggccgaggaggggagagtgactcgacaggtgggtgggtgggtgggggaagcgaattccctggcccactgccgggccttgacttacaggctggacccagagttcccagggggctgtgagagcccatgccaagtcctttcttctcattcattcattcattcattcagtagacactgttgagagcctgctgtgtgttggggattgttctgtttaggtgctgggaatagagccatgaacaaagcagataagagtctatgctcccctgagcttgctctctcatgacaggagtcaagtaaatacagttacgtcaggggtggggactgtggaggaaagtaaagaggaataaagaggcgatggcaaacgtgaatttggggtgggatgctttttatgtgggtgctcagagagggccttgctaagagttgtgatggcatgaaccaccccgctctccaaggacggcattccaggcagagggaagaagaacagtgcagaagcctgaggcagtagcatgcctcggtggttcagggagcaatgcagagatctatatgactgagcggagcaggtgaggaggaggtatgaaggcagctgagggctgagaggtgtggggcagaggatgttggaactcacaagcattgaagaggccttcctcgctaaccctgcatgagatgggggcagcagagggttctgagcagagaagccagccacgcatctgacttgggtttttaaagggtggctctggagattctagagcagagagggcaccagcaggcagaccactgaaagcagggctttgacagcaggtgatgagaagaggggcagattccagcgtgtggtgaaattgggcctcaggatttcctgacagagatgagggagaagagccaggatggctgcagggttttggccccgagcagccactgatgcagtagattcagcagctgaggcctaggggtccagagtgggacactctctgccctctggggtcaggaggtgcctgagatcccagggaagaaatggatggccctctgtctgggtctgtgggaggaaatggggaaaaccgtcaggaagaggaggcctcatgggagatgggtccagaggaaggtgtggatggggcatccaagacagaggggatcccatctacagtggctgagattggaaggggaactctgctgtgtgcagtcaggggtggccagagcttggggcatgccatggtatatttgccagggatagaggaaggtggcaaagggccaggccctgcctgccactagtctgaaattgccccagtactcctaattcaaaagaggccacctgctatgttgcatggctgagctgggcaccacagggcggtggagacagtgcagcgattaagtctccagggacagggctggagcagccactgttttgctcagcagaacatttcattgctggctgcttctgataggaagtggtcccttatattgtgggttcactggtacatgggctatggggagaatgcaaacagaactaggaggaatgagagtctgcaggtttctccaggccacggctaaattctaaaaatgaaaatcatcagaaagttcttaacagtgaaactttaccatcttgttggatgtgcactcccagaaagccagacagcccggtaatccctctggtgcattccaaagccacacatgtgatcggggactgcatggcatttgcggaatggcatggtgcctacctgccctgtgtggggcccttgcaagttggctgtgctctgagccggttcctcagaaagggaccagcttgcattttgagctgtagttccacatttatcttttgactaaccttttaccccttataacaaaattaagacaagtttggtatagaaaataataagtaagcaaaactcagaaaccaaccctaattccgtaattcaaagaaaccaccattaacattttactactttttcatctagccatttttcattgcatatatatatatgtttatttttctcgccacaaaaattaagtgataccgtctatatttttttaaacgtaaagacatggaaagatgtctacaatatcttaaatatttaacaactgtaatttaatagctgcattgtattctgttcacatgttgggcttttcctcgttttcaccaatttaacagtgccgtaatgaacatctttgtaacttaattctttgcataggtctgtgattatttccttggggttgattctgagaattgttggataagacagtaaaaagtctgatacatactttcaaattgtgttctagaaagaccttacaagttgacacctgttttacccttctcacacaatcctcggaattctaatgcaagttagttgcatttgcagtttcctggattcctggtgcaaatgtgtgttgaccatttgtgttgcttttccaaaactgtttactttatcatctgttcatccttttctgctgcagggttttgtctgttgatttgtaagaactctttgtggattaacaatagcagccccttacctgccatttgggttgcagaacattttttaaagtttgtaatttgccttttggttctatatgtggcaattgttgttggttacaatgaattgttttctatttaatcagtctccaccttcatgatttcttgagcatgctgctgagaaaagtcttcccatgtgggcgcggtggctcacgcctataatcccagtactttgggagactgaggcgggtggatcacatgagctcaggattcaagaccagcctgggcagcatggcaaaaacctgtctctactaaaaatacagaaaattacctgtgtgtggtggcatccccctgtagtcccagctactttagaggctgaggcacgagaattgcttgaacccaggagacagaggttgcagtgaactgagattgcgccagtgtattccagcctggaagacagagcaagactctgtctcaaaaaaacaaagtcttccctactgtagtatttatattttcttctaatactttgatggattttttttttacattaaaatttccatccccctagagtttgatttcattgtatgaggtatggttgtcatcttattttccaaatggctagtgtgtgtctgggtaccctgtattgcttgctcatgatcttcaggtaccttttgagacttaaatattttgactccatcttgccctgacagtgtttaggtctcatcagtgattatgataatgatgatgaaggcctgtctttataaaatgacaactttcttctgcagatacccatgcgcttattacacattcaactcctgacatctgaggaaagtaactaggtattaactagggcttcatctttacccaccacagcagaatgccaaacctgctgtggtgtgtgggatgtggccaagacagccttgtcttgcctctggtggagtcggcatcctcctctgataccggaggctgggctgtctaggtgtatttgaggcaatcacggtggtctgccctgcccatgtggcttgagccaagcgagtgtttcagttttcacagagtgggtgtagcgttcagtcatccaaccatattccagcactgggctgagtcctatggaacaatcagagacagttaagcctgggtgctctagctgagagcccaggagtgggtattggagagggaggaattcattgccagcataggcaggcaggtaaatgactccctgagcagacaagagaagcatttgggcgaggtgggtatggctggtgggagagttcagaatgggtaggatttgaaggtgtggcctgtgtgggccacacgattttggtcactcaaattttttaacacctgcaaaaagttcaggtcaccaggttcttcctctgcaccccaccgttttcggcccaccatcaacccaggtgtcccgtgtcttcaatcagtgagagatttttttccagaccactatagcctgtttctctttttctggttcatgctggtgttaggaaaatccatcctgcagtgtttgctgtgaggttgatgacataaacaaattggtattaaaggaaaagattaagtcgtggagtgttcatggggaataaatccaggaaaaatgcagatttctgaacactgccgaacatgactgtggttctaagaggctgaaggtgtctgcctaactcacatcacgtcactgaacccaggaccagccctggcagcacagtaaaattacctgcatagcattttacaaatttcagtttcctaggctcccatcccagattaattaatttctggagatacagccagggcatcagtattttttgaagctcccagatgattgtgatctgcagccaaggtagaaagctgctatccttgacctttggtgtcccagagagctggggatcaccccatccaactctcttccatccatgctgaaaacttccaatgttgagatttgttaccttttgtccggccacctttgcacagctggggttgactttttttttattttaaatgtttactctagctttttgagcacctggtattcacaggaactcgttggttgaactttttttctttgtagattctactactgtcttggtttgactctctgaggtcaagtagaaccagtctaaccttgcttctctcatataaggaccctcagatgtgcgattgtatcttcaaaggcagagagaagctgcaggctataacactgcccacagagccagattcccagccaggaccccagctgctaagggcaaggaccctttgatgtcacaactgtggaggtcttgatggagcccaagtctaggagcttcctgtgggcatgaagtaataggctagagcaggttcccggtgggtgagttgaggttggcactgaggtgttaactgtgcaggcatgtgactggatggggaacaaggtcagattcccaggtggatttggggagtctcagcaaaggagctgtcaggagtggattccagaggagtaggtagcaagtggagcagaggttgcgtggctgaaagcagtgtgatgtcagggttgggcattccctgtcctgcttcttggccccttgtgggggctagctgacaaggtcatacaccacaggagcccagggctgttgctccagacacagcagaacccaagtgtgtcccactgtggtggcatgaaacactcactggctttagggtcggaagtccagagctcaaatcctagccctggtgcttggaagcttagtaacttgggacaagtgataaaattctctgggcctggaatgccccatcttctatgtaggtagaatagtaacagatggtgtttcctgaccattcactctgtgtcaccataggtaacactttcagtacttgatccttaactgtgtgtctttgaggtgttgctgtgagaatccccattttacagatggtaaggcatttgggagatgaggttctggggaagtacattgggtcgttgtgaggattaaataaaatcatttgttgaaatggctgagcacaatgcctagcatttaggaagagctttatgaatgttttatattattttggcctgtgtgtcttgggcctcagtccagctttgaactttgggctttctatagccacagtaaagtcagtggggttgccctgtctgggctgatgatgtggtcctcagagagtgaacctatccttatcttggtgggtctgcttacggttaagctttacctgggatcaccactctgttctaagagcttgaggtatgttagctcactgattcccacaacaccccataggaggcaagttctattaagagtcccattctggctgggtgtggtggctcacacctgtaatcccagcactttgggagactggggtgggcggatcacgaggtcaggagatgtagaccatcctggctaacatggtgaaaccccatctctactgaaaatacaaaaaattagctgggcgtggtggcaagcgcctgtagtcccagctactcaggaggctgaggcaggagaattgcttgaacccgggaggtggaggttgcagtgagctgagatcgcaccactgtactccagcctcggtaacagagagtgactccatctcaaaaaaaaaaagagtctgattttgcagatggagaaactgaggcaaacaagtttgtatcttatcgtagatgacactgctagtagtgggtagagctggagctggggttccagccaggcagtcagtctatgttacacagatgcaagggacagtgacgggtcagctctgtgtcagctgatggccatttatcagctgaataggtctctactgtcatagaaaccacaggtctctactgtcgataaagtgtctagtttgggccaggtactccccataggcacattctcaggacaatgctgccaaaggggcatcaaggaaagcttcatggaggaggcagcatgggagctgggccttcatgcataaggaggatctggatatttagagattggtggatgtgaggaggacatcccgggagaggggccctctgaatggtccctagtagatgatggaggagaagccaggtgtgggaaggccttcagggccaggccacagtttggtctttattctgtgggtaaagaaaggtagtggagggagtgagtgaaagggtcagcctcatgctttagggacacctgtatgtctgtagcctgaggggatagttagaaaggagtgggggtggggaggctctaagctgggcatggaggtggggacccagttaggaggacatggaatgctttaggcagaggcaccaagggcctcaaatactgcaactgactgctcaggcagctctcagatgacactgggcaatcgagagaaattgaccgagcgcttgtcaggaggatagatttttctgtcaatagccgaaacgtcctctgtgggagtttgtgagttactcagtccatcagagcatttgtccacattctgtcagagccggacggaacatgtgctggggtcacggagtctgagccgggaatggctctgctggttggagagttgggcggaggaggccttgtacaagtcagactgcttgtttctgctgaaacatggagcaggaaaggacagagctaccaagcagcccatccatgaggaaagacgtgggggactaaggagatggggagggggctgtgtgtgttctgggggtggacagagctagtcacctgcccttgagatggagctctcccatctgatggcagcacctcgtggagttagagacattccaggatgtccaggcaaatgatggcagttagaaagaagccatgtaaagttgctggtgtcgtagttgaagtcttcagaagacagcagtgcaagaagggaaagggaaaaccagggctctgagccaacgcgggatgctgatcttcagaggacgtccttgcagggagaagctcttcgaaaaacagtaagtgctcagcctcctttaggtccccagagggaaagaaatgttagccacgatgaagatgtttgctgggctcagtcaaagagccccttgaagatccctggacaattccttacacattcaccactccatcagagggccactctgaccggcagagctcgctttacaggctcagaagaaacgctttgtaaagatctaggaataatgttgccatcagtcagctcctgcttgccgggcttctgtggggctctggatcatctgaaagccatctgtggtgtgactgtgaagtgacgagatggtgggagttggtgtcatcacttcctcatcacccacaggacagctgagaacgctgtcacagcctggatgatattcccaggccttgggcctgaaggttgtcaaagtgcagacactcaacccgggcatgctttgaggtctcgcctacttgccctttgtccctctgccttgaattttttttttttttttttttttttagacggagtctcactctgtcaccaggttggagtgcagtgtcgcgatcttggctcactgcaacctctgactccctggttcaggcgattctcctgcctcagcctcccgagtagctgagattacaggcatgcgccaccatgcccagctaaatttttgttattttttagtagagacagggtttcaccatgttggccaggatggtcgcgatctcctgacctcgtgatctgcccgcctcgccttccaaagtgctgggattacaggcatgagccaccctgcctggcctgccttgaattttgtgtgcaacttcgactcagattctttgtcacctgcaaactagggtagaagtgggcctggttttgaaaaggcagagaaacttttctttatccaggcaaactgttttgaggaatccttacagatgattagacttgaagcctccagtgggagcaaaaattgtgacaattcagaggatgctaaataagcagtttgtagtaaaagattgtagtcagtggttgaggagtgaaggcacgttcttttttgtgtgttttctcccatcacccccaaattagaaatctctctttttttttgtatctgcctggcctttttgggaatgattatccttgaaaatatcttaccctttgcttttgatggtttcttctgattacatctgttttctacagactagcagacacttaagagtattggatttcttaacattcggcagcttctagttccatatatattcaagcatttcttactctgaaagtaaatttcagttgtatacattcattcattttgagagtcattttatgcttggacatttctgacgaccaccttcatagttatggggaagggactttagatctgtgaagggtactgaaacaaaacatatattttgttcatacgttcttgtgtcttcccagacttttctttaaaaaaaaatcccaaaaagggaaatcagggcttcccttgcagaaggaggcctggctgccttaaaatatccatatatttgaatttcaaaggtaggtttgaatgtgaaatctaaggtaaccttgcattcatagtctaaattcagagtgagcaaattagattgtcattattaagtctattccttagacttaattggggcatggcattttctgccgcttagttctttagtggtaaaagggaacctttcccattgctgaataaaagactacttgagcccttttgctgaaggactgtgacatttccctgcattggttctggggttggatggtcaagacattgacaggtggatttaagattacagggtgagacttggggaccatagcaagctgtgtttcagatcatcatgcattcaatttttaaatgttggctgggcgcagtggcttacgcctgtaatcccagcactttgggaggccaagacaggaggatcacttgaggtcaggagttcgagaccaacctgaccaacatggtgaaacctcgtctttacaaaaattagccgggtgtggtggcacatgcctgtaatcccagctacttggtaggttgaggcaggagaatcacttgaatccgggaggcggaggttgcagtgagccaagattgcaccactgcactccagcctgggcaacaagagcaagactctgtctccaaaaaaaaaaaaaaaagtacccatggtacctgctgaaatactggcctgcctaggggcctatgagggaagcagtgtgggccagtgttagtgcccagggttagtctgggttcagggtcagactgtgactgtgggcaagtcacttgacctctctgagcctgtttcctttttttttttttttttgctttgttttttgtttgtttgtttttttgagactgagtcttgctgtgttgcccaggctggagtgcagtggtgcgatagctcactgcaacctctgcctcctgggttcaagcgattcttctgtctcagcctcccaagtagctgggattacaggcgcgcctcaccgcacccagccaatttttgcattcttttagtagagatgggcttttgccatgttggctaggctggtttcaaactcctgacctcaggggatctgcccacctcagcctcccaaagtgctgggattacaggcatgagccaccacacccatctgagcctgttttcagtgaggatattggctgggctctcacacctgtaatcccagcactttgggaggccgaggcaggaggatcgcttgagcccagcttgggcaacatagggagaccgcatctctacaaaataaatttaaaaattagccaagtgtggtggcatgcatctgtggtctcagttaattgggaggctgaggtagcaggatcacttaagtctgggaggttacggctgcagtgagccgagatggcgctactgcactccagtctaggtgacagagcgagactctgtctcaaaaataaataaaaaggatgttcgtttctgtcttgagatgagctgagaaggtgcctgtgaatagactgtattgttgccctaaaaatgttgtagacttggttttaggtcaaaaagagtgactggaaacagtgagagagcaacatggagaggcttaaaagttgttaccctgggaacccagtggtgccctcctagggaaaagcacctaaaacatttggcaaaaccaaaaactggaaattacctaaatatccagccatgggaaatggctaacgtgtggcctaaagtgagagggaatacagccaacaaaagctgagttgagtaactccactgcaatatcgttaagatggaaaacactcaacaatgtaatactttttcattttttgtatgtgtatttatcattattattttgaggcagggccttgctatgtcacccaggctagagtgcaacagtgccatcatagctcacagcaacctccacctcaagggctgaagagatcctccagactcagcctcccacgtagctgggactacaggcactcaccaccatgcccagctaatttaaaaattttatgtagagtcaggctctcactgtgctgcccaggctgatctcaaactcaagtgatcctcccacctcagttcccaaagtgctaggattactggcatgagctgctgcaactggccagaagtaatacttttttaaacgcaggatataaaaaatgatgaatatttgtattcttttccaattactgcattcccaccgacatatgtagaaaaaagactggaaggaaatcgaccaaaatgtatacactggttatcgctggaaggttggaatattttacagtttttaaaaacaaatgcaaatcatttaattactattggaaatttttttgaagtggtaacattgcaagcacaacgtgaggagggggatgagaaggtgaggtaagggagcacaggctctccacctcccagcagagtttttgctggggccatctgaatgagttgttgaacttcaaagccgctgagtgtctcattgtgttggaatgctggcgatgaggatcacaggaagtggtgacaagccctttgttatataagctcaccaggcttgctcattggtgccagctttggcccttagtgttcgatcgggactttatctgtctgtgtccggggccacagcgttagctcgggcaaggacctgtgcgggaactgcatagtcaggcacaggaagctgcaactcacacccttgtttgcttaacacccactggcgcattgggctattccatgaaaggagaaaggacaaagtggagggatttactggcgctattcctgacctgtaaagatgggggattttcccttgcctctttggaagaaatctgtctcacatcctccaaaagcaagagcaacctgctttttgatctgctgctgtttctcagttcctgttagttctgtgtttataattgtggtcctgctgaaggcattagccaagaggggtaggaatgttgcagttccagagccagattgcagttttcccctctgttaacttccctgttggaggcaggcagggccattcctcacacaggacaggtgctcagtgaagccttgcagtctccagttttctgcaccgaaggggaggtgtgtgtacacacttgtgggtaagaagattggaccgctgcaactagaaaatagctcagccttgtgcctgaagtgattagctgctttcagttgagcacttactgtatgctatactctgctgggtgcttcaggtacatctctcattggagtcctcacaggaattgtgtaaggaagatactatttttcatacaagtaagcagacttggagaggtcaggggacatacccaaggcctgccaaacttctctgtttttattgacattcctgtgttatctggataccagggactggactcttggagaacatgaactcatttttcactcatcccccacagctggcactgaacctgaaacactggccactttgggtacgttgaaccttgaggtgccatggctaggtgatgttggcaaggcccctcccctccctgggccacagtgtctgcatttgtaaaaaggccaggtgttcttttctctcaccaggccccatcttttccaaaaacttcccaggacagcccttaacagccctctccagaccgcaggttcctgtggaatgtggtttgtcttgtaagaggtagtcataagccacaagcgacgaagggatttttactgtcaggcctgtcaggccgaggcccaaacattatatgactgttgtccccaattaatgagacacaagaaaccaagttgtgcaactttacaatgaagccacatctcattgcgatttcaattccttccgtgttagaggcttgcgtcctgcccctggcaagtttgtatgtttcattgcttggcgtgatcacccaccttttcacctaaattggtttggaaaagccgtgggcagtttctagaaattaaatccactccagagtatggaagattgaccacccaagatgttcagaggaatgtggtgtctcctgagggccctactcggagaaggaggacccgggggggcttcgagcatcagtatattgccctcagggcaactgcttgttcttgtttgcctgtattcaattcttatgtgtctaacacagaggtcacaaactttttctgtaaagggccaaatagtatttcaggctttgcagcaacacggtttctgttgcctctgttcacttcttcagggagccacagacaatatataaatgagcaggcctggccacgttcagcaatgctttacttacagaagtgaagctttgcccaaccctggctgaaaacattaggtgcctcttttctttttttttcttatctcggctcactgcaacttccgcctcccggttttgagcgattctcccacctcagcctcctgaatagctgggattacaggcacacaccaccacgcctggctaattttcgtatttttagtagacacagggtttcatcatgttggccaggctggtcttgaactcctgacctcaggtgatccgccctcctctgcctcccaaagtgctaggattacaggcgtgagccacctgtgcctggtgcctcttttcataatcatgacccatgttaacttgtaatctctgtgttttatacatacccattttgacctgattgttttgaccccactccctcttggtttctttcaagctgtctctggcctagacacgctagaagatctttaatcaatctttacattgcacagaagttgcccacgttctcatgtcaaaaaacatacgtctttttaaaatgcaccgtttttattgtacctgtgttgtgctgtgtaggatctcacgttgtatagtcaggttcattacaaagtggtaggaaattgatatgttgtcaaattgtttattgttgtggctttgttttttttggagacagggtctcactctgttgtccaggctgaagcgcagtggcacaatcccggctcactgcgacctctacctcccagattcaagagattctcctgccttagcctcccgagtagctgggattacaggtgcgcgccacctatcggctaatttttatatttttagtagagacttgggggtggggggggtctcaccatgttgaccaagctggtctcgaactcctggcctcaagtgatccacccacctcagcctcccagagtgctgggattacaggcgtgagccaccgcacctggtcgttgtggcttttacaaatgttactagaagaaaagttccatacctgatatcccatgtggctgtagtcttgacccttttgatttgtcctttatcttctgtcttccaaaagtgagtctggacgtgtcatcatttagacactacccatggcttctatcatgtccagactcatagcttgacattccagctgacccttacctcttggaaaggcttctttttactccatcccttccatgacagccagctgggaacctctgaccttgtgccaggatgcaaggctcacctgtatgcctctgtgtcttcacttgtgtgtcacacctttatcctcctcatcctcttaagttcagctcagctgtcctgccatttgggaggcttcctgacctcccacccctccctcctctgtgtacacatgtccacacctctggcggaagcagtcacaccatgtcatggctcctggagagccacagtgagagccctgcaccttgcacggggcctgaccccagagtggatgcaggagtgcttgtcagataagtgatctcagagaggttgattgaagagccagtatgctgtaaaaccccaatagtccccaaattgccagtaactccaacaagggaaaaaacctccaaactccagtgccctccagagcagccaagactctacattttaggcttctagtggcctcatgcaggcctgtgctgcctgccttttggtgtggtggtgggcattggaaagagcagctttgattctcctcagtggcaggtgggagtgatgattaaaaacagttagtaattaccacctcctctatggagagcttttagctggggacttgtgtgtgatctgcaaaggattcaggacccatgagaccttaggagtgcttcagctccttcagcatcatgcttggcacatagtaggtgcttagtaaacgtcttatagatgaataaatgaattagattagaaagagacttttctggaaagagttgttgcagccagattgaagggctgcaaataccatactaaggagttaattgagcctttggcccacaggcagtgggactccaggacaggtttgtgcagggagggacgtctgcacaacatgtgtcgcgctcaccccattatttgccctttccggtgtgactgagttgccagataatgaggtgttgggctgcacaaagcgcttccttgtgctagagagaggcagggcctgccttgaagccagttggccaccggcctcctccctgtaatttatgtgcagtggcaggttagagtgggctgccaggcagaaccagggcatgcccgcttctccaggtcaacaccttggtgtgctggttccagcataggggccatggccctggattgaggcctggccctgagctttctctgccaccagtgcgttcagggagaatggtttcttttcttaatttttttttttttttgagacggagttttgctcctgttcctcaggctggagtgcaatggcataatctctgctcacctcaacctccacctcccgggttcaagccattctcctgcctcagcctcccaagtagctgggattacaggcatgtgccaccacacccagctagttttgtatttttagtagagatggggtttctccatgttggtcaggctggtctcaaactcccgacctcaggtgatccccccgcctcggcctcccaaagtgctgggattacaggtgtgagccactgcacccggccagggtggatgatttctatggcaggggaagggggagccccactgaccctcgatacctctcccctccagctccatgttcccagactcagacaccttgcgtttctctcccatctaaaggtggctgccttcacagcggtgcttccagtgatcactttttcagggaggatgcaactcactgctttcagacagggaaatgcacagttaagatgtcagtccccagaatctaagtacatggagcagttatcctgttcaaaggaggctgttgttttgtctttgtttttggttcagtcccctatgtgtctactaggtaatatccccaggcataggcacagtggggaatgcaggacagggcactgtggcataggcagagagaagctgggggcagagcattggacacaaggacttccactgcaaagcaagacagggtgttgcagtgtgtcagatggattgattctgggagagtaatctgggcaggctacttggaggaggtggttttggtctgggcttgaacactgggtaggggaagaatgaaatgtactctaggcagagagcacagcttggccaaaagcacggagtttggcaaggacaagttgggtctggtgagaaaggtagaggactggagctcagagtgggaacaggtggggttgtgggcggtctggcagaccgggggagtttgagcagctcctagagcatggccagagacttagctgggtagtcatgggtctgaggagtctctgtgactgcagggagtctgggaaagcccagagcctggcctggcctggggcggacatttggtggggatagtgagaattaacaggaattcgacttcgaggctgggccaggtcgccccaggaaagcccatgcttggccaggctggaattgggcccctgctattctggctgtggctgctgctttcttggcccagccttccaagagcctgtcacaagtgatttccgagggaagccaacagaggagcatggtggaaatgtcactcccttggaggtagatcccctcttaaacacccagctgaaggtggaggcaagagagtgctaacccctgcaccggcactttccagcttgctttgagctgccccaggaggcagagagactggggattcccccttcccattttagggttggagaagtgaacttcttggtcacccagaagtcagtgaatacctgagcgggactggggcctccccactctggacccagtgtgttacgcacaacactgctcctcagtaattaaagggcatgtgtgcagtttggaggtgaggttagcaattaaacgataactgaagatgatgggtgatttctggatctactagtacatagtgagctcttactgtgtcccgggcaccatgctaaactctgccttgctttgttgcagcaacactcgtgggtaggtattttcgttaccctgatgaggagacaggggcacagagggtttaagtaacatacttggtgacccggcacaggacagatgtggcagtcccaccctagggcctgcgctccaaaccttgatgccttctgggcgaagccagacgtcggcacgtttcccccgtctgccccagtgctcctagcgtgctttataattagaacagactgcagcaccagctaatgacttcctcatgagattaatattcagaaactcgggagaaaattgaagaacaagaaaggaaataggtagagaatgaggttgtttccactaaggcccaaagcactatttaaaaagtatgtttgagagccgacttcggctgcgttttggcaatcagaaggcttgcactgtacctctcctctgcttgtgcttcgggcattcagtaccggcccctgtcacgacctgtttgtggagggcagctgatcacatccctcctgtcaaagcataagcctgaaccagttcctcgacttctcagaaccaccagtggcttcccactgcctttgggaataatgttgagttgctttaacctggtatccaaatctccaccccaccaccacccccaatgaggttttctccacctcccttttcttccccgaactcaccgaagttttatacctctgcacttgcctgtgcccatttctgaagcaggcatgcccttctccttcccatcacccatccagcctagcaaatgcaggtttgcctcagatcctgctagttggcaaaactctgtcccaacgcagtctccctcttgccccatacccataggtcatgcctgggccttgcttgtgactacctggcccatctcatgtcatagtggtaaggtcactttaggtctgagtcccttccccatacacagcccccgcctgactggtggattcaccggtgcgtgtgcatggttatgggaagggagctggggtagaacctttactgggcaaaggtaaaatgcaggctcttgattagggaaaagggctttctgggtatcaggcatgaaggggaaaggcttgtttcagtttgtgtagaaagagagaaaaggacttggtggtggccacttttgaccctccatccctgcccagaagaaactaagctgtggcttgttagcctggagaagaggacttcggtaaggacaaatgtcctcagaccttctctgcttgagtcccaccaggtgcacagtcctgtggaagttaactctaagcgtccctggggcagtatcttccaccccagccctgccacgtgtccccagtgtggctttattcccacctaaccccaccccgcaccctcccttgccactcatcttccagagtgcacatcacacctctgctccaatactttcatgcttcctccatttatggcaaagccccaaagactttagcatctagagccctcaaaatctatccccaaactccttttcttcattttgctctatacctccccacaaactctgcaacgttgtaaactggtctcttgactgccactttcctcacttgcagcccccccaccgtagtgtgccctattgctgatacccctgcctgagcccaggaaagaccgccacctcctccaggaagccctcccagccactccagcactacctgcctgtctgcctgcccgcccactcgcttgctgttggtggtatggcatgcagtggctggggacaggggtagctcttcacttgagcagagcagcggagctctggctgaccctgtgccctctctgtccctccactgcactgcatgggtgccgacacatgtctggggaggcctcccttcccaagccccccctttagggataacggccggcattcatgtggcagcttcccaccgtggtctggtttcctcctcacgacagccctcagcggaccatcatctctgtcttacccttgaggcagccaagacttgcccaaggtcacacacatggccagccagtggcgcagtcgaggccacaccccagcctttccccatcgagttgtgccccctctgcttctctgaacctaatgttcagctgccatggacggtgagttctgagccttggaaggagtcgccttcctgcacacagcagatagcggctatggggaaagaccggctgacctgaggtagtgtactaatttctgaggaggaaaaacccccaggcttatcctccagaaacaatcaccacaagaattaggcggctgtaaacacgcctggggcgcagctctagaatgcagtttcagaacccaaatcctgggttctggcttaaaataagactggggcctagggattcatggagggcagggcatgggccgccagactcctgtcgagaggcccatttctcctcctctcccctcgcccctcgagctccagctgcaagttgccccagaggcctgtggcctactggaccagccgctgccctcgctgaggcaggaggggatggtgggcccggccagcctggcctggactcatgagggagctgagcttccctgaggtacttcttatatcagggctgtttccggatgacccctttgctacgtgttttactgcccttgtgtggtcaagttaaagaggttgttcaggaagtaggattacaacgggaccttgtcgtggctttgtaacctctgctctgtagatggcagggactgggcccacagggaggggccaagggtagtaaaatccagaatcttggaatccattcattcacatactcctttgccacaaagtgggatgggtgtgcttggccccagggccatgacccccttcggatcttgcagacttcttgcaaacttgaagtggcagcagcacatacaggctaatgactaagcagttcccactgcgctttaaagtcttgccttaggctttcaattgtgcttatcattcaaaatgctcttttttgcaaaagagcccattttgtcagttttcttcttgtttagatttaatgattaatcagaaaagtggttttttgtttttaggtttttttgtctggtttggagataacattggaggcttaacgcctgacagcagtatctgacagggcactttatcttaaggatgcttttcaccattccagctatgtattatccacatttttccggggaagaaaatgttctctggcgaccccttttttgtagtgtagtgtcctgggctgtcacgcccgcccgccagccctgcctgataagcgataagcgtcaggagttcagaaacatgtttttcttcacggctgacagtctgtctcaaaaaacttccatctcctcacttcctcgggctcctgatcccacccgctccattcctgcctttgttctctttggcacacactccctctccggggttccatctgcctttccctacttctccttgatacctccctggggggtggcccctgcccactgtcactccccaacacccagtttctccctgccccacccccggggcctcctagatgcccaggcagctcattggttggcctgggaagcggggctggctcatgacccgagtagggagcagagtgggctgcatccctgtgtcctggggaaggaggcactgggctggggcaggaaggagtctgggagtcaggcagacccgctgctttcctttgctgtgtgacattgagcacatttcttaatctctctgagccagtttcctcatttgtaaaatacatttattcatctactcagtaccttactgtgtgccaggccctgcattagactcagggaccaaaaagataaagtgaacataggccctgtcccagagtctccagtttggggtggaggtggggcttcttagtaatcatggtaagatgactccctgggtgttagggaaggggaagtgacagacacagatgtgttttatgaaccgcaaagtgcagtgcacacgtggagagtgttggttcctggggctcccaggtccattgcttttgtgatagaacagggcctgccttgtggtgctcttaagtctggaggtcccccacgcctgacctgaccacgcctggtgcctgtgcgcccagcctgttgtgtgctgctgagctctggcctgcatggaatggctgggctggggcacacatgcatggggcgtaggatggggagggcagagccggacagccagacccaagctataaagcagggttaggggaagattctgggtgctgtttggagttctccaaatagagtttggcctgacttttaaaaactcttagacaatgtgttaggagttagttaaaccacttttagtcagtaggaagagagccagattttaaaaaaaatcttgttagagtgtgacagaatgtgaaatgtcactttttagctcctcttctagcccagccaccttgtgtcatgcctatttgtgagcctgtggctatcccccaatgagcctgtgtctcctgcaggaaggaccactccttctgctctatgttccagagcccagcacaggatctgccccaaggtcagcccagggaggctgaatggaggagcagacagaacttcagggctcagaggagagaggctcacttctagcggaggtggggttctcagaatggtacatgggggctgaatcgatgataatgacacacagttgagcccctcctgttgccaagcactgaggtgggttctgttactatccccactttatagtgaagaaactgaggcccagagaggttgagcaaacttctcaaggtgacacagtgtggatttcaacccacatttcactctagagctcatgttctcatgtgccgagcattggaggttagatagaatttgaacatgcagtgatcagagaagagagaagggcacagtatgagtgaagaccccctggggaagttgggggctggtgactctgcgtgtgactggagcgggcagtggtgggggcaggtgtcggaaacaagctcacagccctgttgaccatgggcctatatggaggtaagataggaagtttccaaatgacacggagtactccagcaattggtactttacacagactacagacaagagccctgtgtgccatctctttctccagttctcttgtttgagcccactgttgtgtcataaggagatcgcaggattcttctccgggaaaagagggagttgtgtcagcctagtagggcccaaagccaggctgtctacagggcagtacacagaactgcttttaccccagctcccgtgctgcggggtcctgcaccagtcccttgctctctctgggtctattttgctgtctctgcagggaggagtttcatagtagagtcacttctaagtctgttgagcataagattaagagacagcacccgagtttgagtcagggctctgcaacttaactgctttggtgaccttggacatgttatccagccaccccatgccttggtttttttcatctgtaaaatggggacaatatgagaatcaaatccatagggatgttgtattaaaagaactgagcatagtccctggtagctgctctcagtatttcttgtattattattcagcttctcccatccttgctctctcaagtccctcactgtcctgtggctcaatggagagaaccccagagagtctggggctcagagactctccagttatctccactagcagagctcctgctaggcgggggatgcctgggtctgccctgtctttcggagctcatttgctctgtagacgttgagatcatcgccgccagtggccacccagcctcagccaagctcttgcaacattcccaagggctctgggggttccttgtgcccaagtcctgcgtgggcagagctctaggcaggcggcacgttttggcaagtctttagtggtgtcattggtaaagagtttgctgtggctgcgcttgttaggactgaagaaatacagtttttacagccctaacttttgttcctcccagatgctaataaactgttagcaattttggttaaaatgtggctgttttagaaattcattcccctgttagttctacctcgttgaggtttggtctggagagagggcagtgccccatgcgttagagtgggtcggggcgaatgtggctggtgtttctctggggtcttcaccttatggggcagcagggcttgagcaagaaggcctggtatcccaagctctggaacaggagtttgggcctgtctgtgcctgggtgctgcagggagaagatcttgggctcagattctttgcctcttgactcactgtatgaccttgagcgagtcacttcccctcgctgggtttgggaaatcactggggataatgctgaggttttgcacgcgcctgtttctgctggagaccagagagtgattctcagtcttggatggattgtatccaagctcctaggggagcttttagaaatactaatcccaggccccaccttgggccacttaaatcagaatttctgggggccaaacttaggcatggtgcattgtaaaagctccccaggagtttttctgatgtgcagctatgttgagaatcactggactaaaccaggagtactgtatgaccctcaggaacctaaaatattttctatatggtaatttacaggagagggttgctgacctctccctagattatccactcatggaaggtagacactgactgagctttgtccttctgtccccaagacctaccccaccgtgggcattgctgaacttcaggatgtgattctgtgcttctcccatggcacccaacctttcacatgccactggggaaagaggtggagaacctctctcactgagcagcctgtgaaagtgagagggagggatgcagttttataaggttggagcaaccccttcaacactggctcccctatccccagtcctatgcttcagggtaccataaaaatctcaggaggactatagagtttctagtggcaaaggatctcagtctaggtcctccttgccaagtgctcaacccgcttctgcttggaggtcccctgtgacagggagctcactacctccccaaatactctgttatactttgaatagctctgtctgatcattcttcctgaaattgagttgaaatctttttgagaacttctactggttggttctcattctgttctctgatcccacagaacacgcctgcatcctgtgccaggggttgaccactgtcttgcatgcccccaacagatacccctgaatcttctctagtagatacccctcggtcccttcaattatgcccatgagacgtgggggagagtctgggctctttatcatcctggtgaccgctccttaattaaagtacaaggcccaggccggatggggtggctcatgcctgtaatcccagcactttgggaggccgaggtgggcagatcacctgaggccaggagttctagaccagcctgaccaacatggtgaaacaccatctctgctaaaaatacaaaaaatagccaggcatggtggtgcacacctgtaatcccagctactctggaggctgaggcaggagaatcacttgaacccgggaggcagaggttgcagtgagctgagatcgcaccactgcactccagcctgggtggcagagcgagactgcgtctcaataaaacaaacaaatgaacaaaccaaaaacatgaagtactagagaagattcaggggtatctgttgggggcatgcaagacagtggtcaacccctggcacaggatgcaggcgtgttctgtgggatcagaggacagaatgagaaccaaccagtagaagttctcaaaaagatttcaactcaatttcaggaagaatgatcagacagagctattcaaagtataacagagtatttggggaggtagtgagctccctgccacaggggacctcccaaagagctggacgtgattctccattggtcctttggttgtacagagtagagggagacagtctcctctctcatggtggatcataacatcattatcactgtccttgcagcctgtggtcaggttggctgtgggaagctgtgttagaccacatgagcactgcatcactttagtaaaggtcccaggcagtggaggcctctgaattcttgcatacaggtggcaagttattacattatttcttcctcctgtctacctgcagttggttttatgaggggcgttagtacacttcccaaagggcttgcccgcagggtgagaggtgcacattgaactccctcaccaggcagatgggaagtgtggccatgagagagagcttcaggggccctgggtttatgacatcgctgggccaggaatgaggttaatatttttaatggcgaagggtgagccccgttattacccgagctcattcatcaatggcagaacccgtttcacctgttaagtgccctcggtgtgggtaattcatgaatgggaatccaattttctttttaaaacccaagccacctcccccttcttaaatccaggaggtggtgctgggggggtgtcaggattttacagcagttttttcctgggtaggaaaggctgtggacagctttgagggcctttcctgccttactcaccaagcaggcctgcgtgagccagtccataagactgagagttatggagaggctggggctgcaacagctctagttgtgggacccaggatagatgggaaactcgggaccacctgttttatcctgttgcccactgatcagaggatgggcataacaaaaatatggggagggggagtgtaacgagaccactcaggtggaccctctccaagcccttccgaaatgattggtcaactagggcattggattaattttaatttttattttttgtggaggcagggtctccctatattgtccaggctggtctcgaactcgcgggctcaagtgatcttcccaaattctaccagcatgagccaccgcaccagctggggtattggtttaaatgtctccaaggagtacatttttctgggatctgtgggttggaagggccccctccccgaattggctggccccagtcactggtgttatccctgataaatgggcatgatcatggggcacccatagaggtgatggggtgctcacttttatcttaggaaagcataggctttaaattattcccagatgccccattggagccagcacctgctttgagggtgattgcaggctaaccatgctgaccctgagggccgcctcatctccttagatcgtccagtcctcactgcattgtggatgcttggttttctaattcagctggtctcaccctaaccagatgaaaatggaaccacttctaccataaaattccattttcttgctggttctgatgagaaaaatcaggttttctttacagtcatgtttgaaaataacaacagccagcatattttagcacttagtacttagtgcatactgggcccagtaccagggctcactctttctagagaagcaggttttccttctggctgtcattccctcctctgcctggcacgggtatgcttccatgtgcagaggtttggtgttggggtccggggcctctccatggggacaacttcaaaacaacgctggtgctcattctgtgtaacttgaagacaaggactgtgccacgctgcactggctttggtatgtggggaagtaggatcccccaggcaggagggatacggctggtacagggtggagggagaggagagctggaagccaggcttcaaaggctgcaggcggaagcactgcttccccaggtgtggcccgggcagggcaggttgcaggtgtgccggagtcacagggcagctgaggaaggggaagggagacttccagcactcagctgacttaagggagttgtcaggtggcctttgctcacggttggcgcaactgagccaagctggcaaagctgctgcttcttcctgtcaaacttcccttcagagatctcttcctgttgcccagaaggagcctggacttagaaactcatacaacaggctgtaggtagcccaggagagccagagctttggggtgacgctggcctgggttgaaacctgcgtagccttctgtgctctgaggccttggcagggttcctagacatttctgagcttcggttttctcatctgaaaatgaggtgattaggaaggatgaaatacgatgatgtacgtgaaagcacagagccaagagcctggcttgtagagaaggtgctctctaggcggtgccccctctgtaagcatcgtcccttagcctcctgcctgttctagtcctctagaacactcaggcgcttggagggtctggtccgaggttctcgggccctggcactggaggatcccaggctctgggactcagcccccatgagtcctgcccggtcccaggtcttcacagagaagtgggtgaagagagaaagctgggtggtaggttgaggtgtcttgtgatagccaagttatcagcaaggggcctgcctccccttgatttactcatcagcagtggatcaaagtttgctcttttgaaatgggtaagtctgggattcagttcaagatacctttgcctccctttcaggatagaatgtttccagtggcaggtgatttatgactttgcatttggaaggagattttacaatgtgcattaataaataagggccattctgggcccgattcatacagccgttgtcaagtgctgtgttggtgtttcatggaaaccagctcccgtgatggtctcagatgtccccttaaagcggaagggacacagggtgggaagagggtctggaaaagtcagtgctcttaagcaataacatgcacaccagaccattgacatcataggaaggcttggtttctaaagtaatactaaaaggactgaaacactcacctggggtaatgcttccctagaaagcatggtgatctccaatgaaattagaaaaatggacggttaggggtttcttatgaagctaaacttactcaccttaaaggactatgctttattctcaatttcctttttacctttttactgttaaattgttattgtctttatcttttttcgtttgattttgttttgttttgttttttgagacatagtctctcgctctgtcaccaggctagagtgcagtggcgagatctcggctcactgcaacctctgcctcccgggttcaagcgattctcctgcctcagtctcccaagtagctgggattacaagcacacaccaccacgcccagctaatttttgtatttttagtagagacggggtttcaccatggttggccatgatggtctctatctcctgacctcgtgatgctcccaccttggcttcccaaagtgctggggttaaaggcatgagccaccatgcccagccctttccttcataaaatgtgggtgaagacagatggcggttgggttcttttagtgtgcgtgatcttgtctttccccccttttttttttgtataatttttttgtatagtagtccatgaaatccaggattctggccctaacaacccactctacccattctacagatggggaaattgaggagctgatagaatgacttagctaatggtgccctgctggcaagaggaggggattacagtctgggcctcaagctccccatggaaacttctggatgttggtgtttggggaggggtcatcacgatcagctacataatttgcagggcccatcccacaaaaaataagaatgtgaggcccctcatttaaaaattattaagaatttccaaatggtgatggcaggctgttaaaccaagtgcaggggccttttgcgactgcacaggccactcacctgtgaagctagccctggaaactataaacatcagtccctgatatactggcatttaaaaataagaacctaatgttcttaaccccagaaataaagtgcattgggcccggcctcttaaaatccccgttatgcctgacttagagcatttcctctgctctctgcagccctctgtgaggaagcttgaggttagagaaagcagcaagtgggaggaatcgcagcagtgaggcctcttatatacctggaggaaagaggtgggcaggtggtgtttatctgggctcattttgctgtgtcgtctacagagtgtgcgctctgggggctcaacatctctgaggggggaagttgtacatggtccaggactaatggatctggggtcccctgccccaggccagacctgtgtgggcttggttgggtgggcagttgctctctgactgggagcagcagctggtgtgatagctgggtccagccagatagctggttccattggccacagctgctggtcatgccctcactggactttgtggtttagggcagactgcagcccttctccctttccccactggctgtgagagtacacccacatccatctcgcagtgatgtggagaaaaccagttgcaatgcatgctgttgtgctgaagcatatgggagtgtgggcatacttgcttgtgtacacgcatgcacgtgtacatctaggtgcaggggcagatgctgtgcaaatgtgtacacatttacttatttatcaaatacttcagcagtgcttaccatgcatattggtctaagcatttgacaaatactaactcatttaaatctcatagcaggccgggtgtggtggctcacacctgtaatcccagcacttttggaggctgaggcaggcgtatcacttgaggtcaggagttcgagagcagcctggccaacatggtgaaaccctgtctgtactaaaaatacaaagattagctggacgtggtggcgtgtgcctgtaatcccagctactcgggaggcagaggtgagagaattgcttgaaccaggggatggaggttgcagtgagcctagatcacgccattgcacttcaccctgggcaacagagcgagattccatctaaaaaataaacaaattaaaaaaaaaaatctcatagcaaccccatgagggtaggtcttggtattattctcattttataaatgaggaaatggaagcacagagagatcaagtatgtcatgtaagttgcccaaagtcatgcagccagaaaatgggcaagcacttgagtaaaaccttgcttgtctatactgttgtatgaattgtcccttattggtaggacttctggctttgccctggagagaaatggccccatagaccctctgtagattaatttgctcattgactcccccagcatttactcacacccctttatgccaggctggggctgggcagagttgattggaccacttggtgttgaaagctttgggcctggtggagatttcaaggcaaaggctgtggtggactagaatcatttacatgtttacaaataggcttctggctaggatgcagtaaggggtccagggccatgaagggaaagctccaggagcaaggagggttccctgggcctgggaagctcggtggtcctgtatccacttgtccatgccctggccctggagggcttgatcacagaggagcagcaggcaaggtgccccctcaccctcaccctaccaccccgtggaatggcaggtgaccagggaggcagagagcatgcatctgtgtgctgtatttcatttctttctggtcctttttctatggatataaacacatttctttgatgttatattttagaaaaatggaatccttttataagtactgttttgagacctgattttgtcaattgctgagatgccagaaaggattttgttttaatgaataaatagactccttaacttctttcactggctgttagtatgtctcctcagctaactcagcctgcgctggagctggccttgccgggttagaggtgccacaggccttctggctggagttcctcttcgcaattctggtgtggcctgagccatatttgtttgcacaaaggaggagattggttttagaggcagtcaggaagggtatcactgagggtggcttgcttctctgtgtgtggggttgtgagcaagcctgggtttccagcaccccagctgcagggtgatgaaatgggcacaccgtggtgttctgatttaccactagccagtcgtgagggactatggcctggcccacatggacttgcccctgaggccttcataggtatcacagggtgcatgagcccgtccattattggcacaacagctctgggccctccttgaagctgccaggctgattgatgttgcaggatctaaagaggcccatagggtccccatttggttttgtccatgtgcttcctcggggaggtgcctgcttagtctctgggacagggccctagaccaggagaaaatgatacttgggctttgggaggggaggcagcctgcactagggagggtggcttctggggactcctgtgattctgcgcagtctccaatgcatttgcaaagccattatctgcttcaaaccctaggtgggagatggggtgtgagatccggggtaggagccaagcagatgggagccccgcacagtaccattgcttcagctagggaaaacgcaccagaagagacctcttggctcagctccatccctctccaggaggcaccccctgccctgggcagcagatgctgtcaagacccaccctgtcccttctgcctccccagtctggccttctccaactggctcatccacatctctgtgcccgagggcttttctagaacataggaatgggaacagccgctctgcctacaccaggagctcccaggagttggtgcctgacccccagctccctcactcttggtaaggtaattctgaggggtgggttgtgcatggtttcccagagtttcctctgtcagatcatgctccatctagttgcccaccatgggtagctggctttgtaacccagctttcctgatacccttctcaggcccattttccctgtccccggtaagtgtctcctcccagatcaaccacttgcattttagtgcctgcttcaaggtctgtgtctgggttccccagactaaaaggcatggcctgtggcctctagaggataagagcagcatcttttctgtgttctctagtgcccttgtgcccttgcctatgccagcataatgtgacaggcactatgtatcccttggttcattgactcagcttctcctgcaccgcagaaggaagatgttttcccagtgaaagtgggagggctcaggcttagagaaagtagagctccatagctggtgagaaatttggaagcattggagctcagggcccggaatccaccaccctggaggccctgccctgccctgcccctggtttcagcccagcacaccttgctgggaccctgctgtgcaccaggtgctatattgtaataaaaaggaaacagagctccagaacctgccttcctggtggagcggaagcagacaggcctacacatagctgcaattcagggcagggtgggaagggcccttcacccaggcatttactcaccctgcctggcacatgccagcctgccttggggaggtgaactgaataatgcccatctcccctggggacctggaagcaatgcaagagcagggggaggaggcctgcctttcctctcctctgtatccccagcacagagcccattgcctggcacgtggaggcacgaggtgatcggactgaacagcgataaacaccatcacagacctgcttgacatcgcaaagccctagccaccctaagtttcctgtacattagaaagcgccgagtacatgtgagaaacaggcctgtgaggttcagggtttcccagcctagatgacggcacaggagaaagagttcatcaaggcttggttgctggaggatacagcattattttaaaaagtgaatcagcatttatggagcacctggtgttaagcggaatgtaattgggagccctcaaacatggggctggtaattgtggctgatgctgcctatcctcaataaagagagagtgactcttggggagagcagctgtttagtgctgcttgtgccttaaaggggcctggcccagccttttagctcccctgtgggaaatgtgcatgagtcatcctaatgggtcccgttcggggagaaatgatccttcacttagtgcgggttcccgcgcctctgcagctgatcattaaaaggcactgtgctggcccgatctcgtgctcctccaggcctgagctctttctcccctttaaccttggcttctagcacaggaagcacacacgagagagagggtgcacttggtgactcccgggccttggctggggcacagaggcctggctttgaaaggtaccacattgcacaggaaaggcctttggctcacaggcgctgctgttttgcttttacatacttttcctgtgagcacactggaagttattcttactgtacagagccttacgttaccgtgagaaagcctcacgggcattcctgatccttccttgggaagggggtgggggaccaacaggctgtgcctatcagaagcagaaaaatgcctcgaattaagctgtctaaaaccagtttgggaggcactctgtaaatatgtagttcaacagatgacataggtcctctcctggttgggatttgatgggagtctagttctgtcacccgctcaggagtgttctgctgtgtcatttgttacttggagcctctggtggctcctcatcaacatggggagggggatagtctggatttctgatgtccaggtgaccctgggcaagacccagactctgcaggctggatggtgtgttgagctgatggtgatcacacctgacactgagcacttgctgtgcaccaccctgttccgaatacaccatgtgcgttggctcaggtaggccttgccccatcctcatttcacagatgaggagggtgagagcagagggctaaatgatttgtggaaccatccggcacctgtgaccctgagcttaactagtaccttccccttacccttccagccttcagctccgaaggagaaaggagaagaaaatcttgctcttactcttcgcgaccagggctggtctgagagctggcttagtaaccagctttcctgatacccttctcaggcccattttccctgtccctggtaagtgtcgcctcaggcccctaggggagcactcgtaccccctagagcaggaagcctgagaggaagggctgtctggcaaggtggacagaggttgatggagtctgcaggagagctgagcagagccaagtaggagttgaggggagaatgaggggcggctaagtcagtggctccatggggacccagcctggcccggagcccacctcccacagagagctgtccacagcgatgggtggttggtccttgtaaggggaggtaggggggttcttctgtgaggcagttgtggtgattatactctgacatttttaaagatgattttaagaggaaagttagtggtataggcattgaagaaatcgtgtggacctgggagtttggaaacatgggttgggttacctggtcctggcattaactttactaagttcatccccactcacagccttctgtccccagtggataaatggttttcaaactatgcatggtgtcactttcttcagtggtgcatgtgtaagattccctttgcagaaatcatgcacacacaagagtttgagatctagcagaatagaccatcccccagggatcctttcagtagtggctgcagacccctccccgggtgtttttgtcctcaggagggatgtgctggattttctatccatagtccctggctgaaagcacttaagaaattctaggattgaggtatttctgagttcaaaatagaacctcccactacttgagagatgctgaaaagcctgtctctaccacttgaggttctggggtaaacagagggtggagccaggctctgttcccagcagcctcctacccaggacccacagctcactctgagggggtgaagctggaagacagtgggctgtgtgtgtgtgtgacggagagagagaggctgagcaagcaggcttgagaggagctgacagaggctggaatttggaatgtgtttttcctaacaagttggagcctgcaggtgtctaggcaagcagctgtggccgtgggaggggcaggactggaaagaccagtggtgaccactttaaccccccacactcccagcctcctgacatgtggggcaggtcactgtcaggtctgtaaaggagcatttaggacagaacaccttaggtcagtagaaaaacggatagtggctgctgggagacagatttcagctcagtgtagggaagacactttagtggtgatggccgtcccagaggactgtgttgccacatcatgagctccctgcccctgaaggcatgtgggcggagtacttggcaggggccttcatgatgcaagagggggctttgaactttgaggcaagccagatcttagaaggtagaaagcaaaccaatcctaaatggagtggaaaaccaacctccccaccgtctgatttccagcagttgcagctgagtgcatgaatgtagctaattaatcttccctaaattaatttccttaccatgtcagcagtgatttattggcgtgcctataaggagagttggtctatgatgatagtcaaagctgaggacaggaagaggcgagtagggggcgcttgtgtgtgtacctgcatgggtgtcccatatccctgagtggtgtaacagcctggtgctgtggacccctcagggccctggatgctggccataggcaagtcacacttctgtctcccagcacacaggcggaagtgcctcgagagttatgagaggttctccaccactttgccaggtgccccaactagggcatgaatcttacccaaagcaggaaaggggggaaaaaagggcattcacaaacattttcctttttgtgtttgagaaataggacagctgttgtcatgcataattgtacccattttccctggtaatcaccggggccttggcgggggtttcttttcacgtctttgtcctgtcttccctaccagattttcatcttctcgtgggcagagaccctgcctgaaagtgcttttgcccctcaccgcacttaccttcatcctggaggtgccatctgctctgtaacaaggacacggccttttctttataaattactgacacatccttggatcatctgattatttgctccttacaacgtttatgtgaagctgagaaggcaaaccaccctgctccacttcacaggtgacctgccgaaactcagagaaaacaggttgcacggagttacccagcaagggtgtagcagaaccagttccagagctccacttgcctggactgtccctgcctggctgcatcctttctgcactgccagctgcctttctgtatatttacatagcctcgggcagctgctgcagcccagctgccaccggtcagccttgggactttggaaatgctgcctgcctccgccatggcaggggttctgcaacccacttagccagtccttaaagccagggctctgcttggggcagctcagacctctacgtccaagttgagtctgggctttgcactgtatgtgcactagaaagatactgagtgtggcatccagccagctgaccttccccccaaagcagaagcccatcttagagcctctgtttggacaccccacgcagcaggagctccctttcccaggcagcgtgttcctttactggctgtcgatgtctttcctgaatcacctggcttgtgtctgtatggcttctgggtctgcacagaacatctgtccactaccgcttctctgagcggcctcatcattatttgaagccctctccagacccccaaatctctgtttctgtaatgtcatctttgttggcatggcaacagagcctccttcctgtggacatcaggcccgctagggcctgtgttatgggggggtcccaaaggaggactgggacttcaggcctcggagcggggacagaggcacttgtgctgctgctgccgcctcacgtccccaaatgctatttgctcaccttcaaggagccctcctgaccctcagagctggggagagggccagggctcccggcaagccaagacaaagagccccaggccatcattctctcagagtgaccctctcacagtcaatgacaggcctgtgtcacacaccaaaccgcatttttagccaggtgaataatgagtgttgaattacgatgcagtcgacgcgtcgcatctgtgcacctgctgccttgctaaggtaaaggagagagtgtcttgttttcactgttcattactgtggccctagacaggggggcttgcttcatgaccttcctatgatgtgctcaacaacactctgtgggtgtatgtaatgtgatgaggggaggcacaacttcatcaatgatcatattctctaagagattagtggcccccaaactgttaaggaaattaatgtatagtcttaaaggtgaatcagtgagaaaatggtctgactgggagcattgagaacattctcaagtgcattcatatgcggtttgctttggcatagagcagaagtcaagggcctggcaagaatcaggggccttgtggggtgctgccccctcactttccggggagaggagagcagcacagagacccttcagccagcaagacactctctcctttgccttagcagggtggcggatgtgcagatgcgacgtgctgactgcatcataattcaacactcattattcacctgtctaaaaatgcagtgtggtgtgtgacacaggcctgtgctgtcccacagacagcagggcacatgaaggtgaccatggggcaatagggacagtgtgggccactcgatcctggaagacagcagccagtctgcctctctcatcattcttttttttttttcttttgagacagagtctcgctgtgtcacccaggctggagtgcagtggcacgatctcagctaactgcaacctccgcctcctgggttcaagcaattcttctgcctcagcttcccaagtagctgggactgcaggcatgcaccaccacgcccagctaatttttgtattttttaatagagacagagtttcactatatgttggataggcttggtcttgaactcagggttatctgacctcaggttatctgcccacctcggcctcccaaagtgctgggactacaggtgtgagccaccgtgcccagcctcatcattcttttttattttatttttattttttgagacagagtttcgctcttactgcccaggctggagtgcaatggcgcgatctcggctcaccacaacctccacctcccgggttcaagtgattctcctgcctcagcctcccaagtagctgggattacaggcatgcaccaccaggcccagctaatttttttgtgtttttaggagagactgggtttctccacgttggtcgggctggtctcgaactgctgacctcaggtaatccgcccgcctcggcctcccaaaatgctgggattacagatgtgagccactaagcccggacatgcctcatcattctttttagcaggtttgagcaatttcagcagagattccctttgcatttctgcagtggctcctcttctgaagtgccaccagcccttcctgtagccgggtgatcttcctagaacgagtttgctgagagtaaattggccttggcctgaaagctgctgtgggtttcaaacagaaagccttgccttgcaagatcctcggggctaggatccctgttgggccacccccccaccccgtcactttcagggtggtgacagggcagaagtctttttttaaatttatttaaatttttattttcataggttattggagaacaggtggtgtttggttacatgactaagttctttagtggtgatttgtgagattttggtagccctctccccctgcacaggccgaattgctcaatctggagccagcccacatgattgcagaggggttaccatttcctccatgtcttagatcctggagatggcacgtcgggtcctctttttctccagttgacccccagggaagaaaacaaaagagctgcatgttagcacaaacttcttgcttcacttcaacgaacagggctgagcaatacctgggaaaagtacaattccagagtaatatctggaggcttgtctctagactggtggggaagggtgctggctctagcttattgtttcccaagctttcctgataaggatcacctggcttgcttgttaaaatacagattattggggctaggaatctgtttccttaacaagcgttccaagccattcctgtcttcaggcaagtttgggaaacattctgtctactgtaccaaaaatagcctgtggaagaggagtgcttttaagcaagtttagttttgcacatagtacatgaataggttctccttgtttgaaaatgttttaacattgcagagaaggtctcttttgacttcccctaagcaccccattccaagtccttccctccttcccaaagaggggtcagtttggagtgtgcatctcccagaccctttctttaacttaatagagatacaggtttctgttttgtttttcattaagtaggtatgatgttgtagttatcattctacagcttgcttgctttccattcagagctatgtcatggagtgctgtgccagctcacacagagcaactgctttttttaaattttttttttcagcctgctgcataatgttacatcgtatggaactagcacagtttatttagcgattcctctattgatggatgcagtagtttcgggtggtttctcatgattacttcaggcagcatccttcccatggacccttatgcacatttgggaataaatactgagaagtaaaattgctgggtcaaacttggcgcatttggggattttaatggattctgcccaaagttacccttgtaagtgtctccacccaagtgcatttccactgaaagcatgtggagaggacccaattctgctcacaagtgcagctgtcccacaaaagcaactaaaactctgaccagtccatagggaagtgtggccaaggggcaacacccaccttcctctagtcctttcctttgggatgaacagctgcagactacttcctatcacaaagtgaagtttctaagataaaaacacaggggccccagcagtgtgcgttccagagaggaggcatggagaggccatccccaggccactgctggtttgctaggtgactgacaacgccctgcagtgggccctgtggaaaacaaggggaggtcagagcaggtctccaggaggacaaacctgtggaagccctgtaggggctttgggctgacctggggtctgtagttttgtctgaaagcaagaaaggtgcttgcctggggtttagcactcatcccaagaggccgagcaaacaaaagatgacgtggctcactgactaagcagccgcactctacagcctttttttctgctactgctcagctctgcctctgtggctgccaggtctctgccaatctgagactaaaaggaaagcttcttgtggacccaggtggcctggcctgcagaggagtcccggctggctcccttttggttgaattgttcaattagatatacaggagttgtccactaactgggaagttttaaagcaaagcaaaagcaatcccgtcagaaatccaatctcacatctggagaaaactcattctctttcttttagctcaaaaaagcagcacgcttcacacaaaccttctgcatggccatctggactggcggtgagccccaggcagcttggacagtggtcacactgcccagtcctgatggctggggcccatggtacttcacagggcactctggttgactgcctgctcaactctcctaacacctggttgaatttttattcccaaaactaggacatcattttgcaaaagatcagacagttcagtgtagtgtttgcaaagtttcaggttgctcaaacctcaaatttctttccctccaccaacctcactttgaagttcaaaagcaaattgattaaatatacattttaggaactttccaatttgcttcttaaactaacagaattctagacttttttttttttttcaatggaaggattttcaactgtcagcaggtataactggaaccatatgtcagcagagaccaggggcttttcctggttttaggatttgtacattcttactgaaacggaagtaagtggagcaggcagccgcagctccatgacagcctgagctcagatctcattttaattagaaaatataggtagcacttgctgaatcacagtccttccagaactcctgtcccagggcaaacaaagatttggtttatatcctgcaaacctctgtgtttgcaaattacagagcacttctgagagctggaatggcgatttctagattactatggagactgcaacccaactgcctctcccaccccgccagcaaatccccccaaatgattttgttttccaggggagacattttttcccttccttattgcaaaatagatggagcatgttcatgttgaagagagacagtgaggaaatctgggacaagagaaataagattagatgtcatccacagcagcaactcattttctccatttggatgtctggccccttgaactctgagacacaaaaccctgcacctgaccagcatctgaactgttccgtttgacagcagtttatgtgtataattttctccctaatgtattctgcaaatggtagagtagaaatagcaaatgaaagacattgcaaggcctagctctctcccaccccttctttccctggcctggtgtcatttgagctcagtgagtctcaagaaaggctgccattacaatgtcagcatctggaagccacccctactgggtccccactgggactcagagcctgagccacagccacggagaaagtggtggagtagcggcagcgggagccatagatgctccagtgctgggcactctgggcttcggtcttcactgatgagcttctcttgtttggggagcagtgaccgctgtgtgctaaacctcccgttggcctccagccacttgccagggacagagctgccgcctgctgtccctttccgggcatcacattcctggcagctggcggtcacttgctcaccctgccaggacggctgccacaagctgccatttaccaggcagacaaagggggattttcccttcccctgagtttgcaggcccctcaaatgccttacattccaggagctgagagaacaggctcctgtggtttctaattaaacccacaatttaaataacaattcatgtaaccccaagggttgagaggaacgctaacctgccccctcccaagagaagcagccgggtggcactggctgaggagctgagggcttggtctttgccagaaatgtgaccaaaaagggcaagagggaagtcccaggacaagtttatgatgaagcggggctaagcaggaggggcgtggattcggtgggttctgtgcctctcctaaaggttaggaagtaaaaagagggaggaacacttgccatgtttaattggagcctgcaatcgagaatttttactcttctccagggaaaacgtggaacggtggtctctgaagtgttagaatcccagatactcaggttctcatgggagtgccccccacccccaggtgactcactctttgtctgtgagttggagaatttttctctggggagaagaggcaggggctgtgttctggactacagacaagtggggagctcaggcagggccctgggaggcagaagatctggccaagcctctgctcacactggacctcagtttacccatgtgttgtcgaggggtctttgggtttgttgctttcaggtccttactggccctggctgtctgtcgatccttgagctgcttttgtgtttttatttggtctgtctggggccacagtgatctttgtatgtagttgatctcaccaaattgttgtctgatgacccaaggcgtggttatgttccaggtctggggaaatggaacgccgagctaattatctctagacaaactcttctgtgcctcagccagcaccaggagcatgtcagcatttctaggctttctgtgatctcgtttccaacttttcctccacttccattccattaaaccgagcaactcacattccctgaggatgccctccaggttctcgcctccatgcttagtgtgcattgttaccttcaccagatgcccttctgttctcacctcactgtgcctggagccagccaggcatgcacgagctcagagggctcttcatcgcagtggagccctgccagtatgggtcccattcgttacccctgtgagatgtggagctccctgagtccgggcgccggctttagttcctgcctcccctgcctctccttgctcatctagctgaggcccaaagcctagctgtgaagagatgtgaaacaaaaaagccaaaggtggactcacacctgccatcttcctccctgcaggtgaccatagccgatgactactcagatccctttgatgccaagaatgatctcaagagcaaagcaggaaagggggagagtgctggctacatggagccctatgaggcacagaggatcatgacaggtaagtggagctgaagcgcaggggctcacagctggggttgtaggggtagaaagggagtgagggcactgccgggtggtccccaaccagcctcactgggggcatggtgtgtgctttcaagttggtaggtgggagcaatgctgtattaagtcttccccacagtttacctgcttatgtttcacctatattaggaaaaaaactggccgggcaccatgagagtccaaatacaaggatatcacgtgcagttaaccaaaggtaggggccaagaagtaagtggggagaggagggagaaaaagtagttctatcagaaatttctgagtgaagaaagatagcatttgagacataaaactttacttagagcttcctagtaggcagggcaaaaagggaagcaggctgggtcacctggctttcgttgcttagtagaagagagctggccagattactagtagagacaaaattatttctggccgcatcccgagaaatctttgttttggagctggaagcagcataaataaccctggtctacatgacaggtttacaggaagcatggagacattcccccagtggctgttttcctgttggcccttgatgacaaaaccttgtcaaagcaattgtgtggagtcaagaagaatgtggctgggtatgcagcatcctgggggcctattttagccaggataatacaagacttggagcatctttaagaagtgaagggttagcagacatcagtcatcttgtaggcaggattagggggaggtcacaagcaaaagggaaacccctgttgtggcttctcctggttcaagagggcaggccagacactgaagagcagctgtgtaggctgcccctgtgaccccacacaggcagtgccatgggcaggggcacatcagcacattgtgctgcagggtgcaggagagtggctgggagcaagtttggggctgcctgggctttggaggcctatcaaattggtaccctgtgtatctggacacttgggatacagatacctctttctgtggccctcttattgtttgtctggtttttgtttggttttttgcattcctgtctttgagcaccttctcctgattccttcttgaattaggagaaagaagggagaggaagcggcatttactgagcactgagcgtgtgccgggtccatgtccagcgtcagcttatagggctgtgtagccgtgcaggttgattgttgaaggatctgggtgcaccttctaggctctgcctttgctgttctctgcctcctgctcctcctgttcatggaaggagattctctgaccaccagtgtggcctccagaacacttagccacttcgtgagggccagggcagagagcagtggaccagagggacttaggtccagacttctggagcatccctctcatgcccactcccatctttctaatctcctctggcaaagcagcctcagtgggcaacaagaggccaagagttgagcttgtgtttggatctggggtcctgagggaaggcagcctgctgtcctccagtggctcagggaagcaggctggctgggggagtcctcaccacagatgtgatgcatgcctgggccctgcgacaaccacagccagtgcatgccctcacctccatcaggcttggtgagacaccagctctgtggaagccccaggaccagctccagcccttgggctgtggcctgcggcctgcacctccctacagctctgtcagtcttgcattcagcaggcgttggctccggtttaaaggagcagtggttacaggagcgactttgggtcatgttcagaatgtcagggtggggagggatcattgaggtcatctaaacctaacagcctcattttacagattgggaaactgaggttggggcgggggggacagagacttgcttgaggacgcacagtgaattgatggcagagtacaaagtatggcctgcgctttgcaaactttggggtggggtactgaaggaagtgtagtgtttgcatcagatgctggggcacctagacatgaggaaatggcaggagcccctgccagggaccagactccatgctgggcactttgacatataccctcattaagcctcattatgtttcttcatcatgaggctgagggaaactgagaggttcggctcctttcctggagtcgcaccaatagaagtaagtggcttgccctgagtgcagaacatgggacaggggctgaggtcccatggagccacaggcaggatgttgttacaggagtccacactcgggaatggaagggggatgggagagggcatctgctgggagccccagtctcatggagggtttgcccctgcctggtgccttaggaatggagccggagttccctactgggtgctgctgaagacctcaaaggtgagtagttgttcacctggctagaaattacctgaggaacttcggctttttttgagacagggtcttcctctgttgcccaggctggagtacagtggcataatcttggctcactgcaaccttcgcctcccaggctcaagcagtcctcctgcctcagcctcctgagtagttgagaccataggcacgtgccaccgtgccaggctaattttcttgtagttttagtagagacggggtctcactgtgtcatctaggctggtctggactgaagcaatcctcccaccatggcctcctaaagtgctaggattgcaggcatgagccactgcaccgactttgccttttaaatgagggtacaccccatggggttaggtccaaggcagggcaatttgattgaggcagtttgatttagaacctcttaaagacctcatgcattctctctccaaagaagcattctagcatatgctgctctgtgtttgcatcctagcttggcagctgtgccctagtttacccacaattcttatttttaagaatataggttattaaaaggggtgttttctgtttgtaacgatccttgctgaagctccctttgactcaaaattatttgtgtgtaattctttgtggcgtcaccccagtgattgatggcagggctgcatatgggtaggatgagccatcagtgcgtagatgctccaggaggcttgcagagctgacgtgaagcttttcgaaggggagatggtgggggaagagagagtggtgctggtgatggcagtggagtgggagtgacatggaaaaagtttaaccttttagaatgatcctttttggatgatattacattttatgtgtatgtgagcgtgtaacttgtagttacagggcatcatcttgaataagtaagcataacgctgacaagaaggctgtgccctccgtgtgccgcaggtggcgtacctgtacaggaggagcgtgggctggagtcaagcagatatgggatggtcacttgccacctgaatgacccagggacctcggttttcccctgcaaagcagtagcctcagagcaggcagtcattagtgcttctagccgctttgggctgctaactggctgtgcgacgatgggcagcacgttgtatgcccccatatttacttacatatggaatgaggggccggtgataacaacaacggggaggcagctggtaagctctctagtacttgcttacagcacttgatgtcagttcttaactgggtcctcaccattaccctttggagtataggctgcccacttgactaatggagaaaccaaggcacagagaggttaaaaaactagcccaagacgtcccagctggtaagtcagttgtggggctgacttcctagcctgtttgaaccatcatgtggagcattctttccagggcctctccagccttggtgcactgtagtttggttttcagattccccagcatagccgtcttgggcagtgattcactgacgaggctttgtcctctgtgtcccttggctccatgcagcaggtggtggggagattggcccagccctgtggactacagctaggatggaaggcgtgaggaagtgtgcctgtttctcccaggggctcctctcacccctgccctctaaatgcctcagcttatcctctccacaggctccagtttgtgtcaccggcaggaggtatgttctgcttccaagatggatgctcagcccttcacaaacctccgagcccaattgtctgggcctcacttgccatccccatcgcctctctcaccccagcagcatctctgggggtgtctccttaaaccctacagctctatggaacctagttggagaactagtgacctggtccaagctttcttttttatagatagggaaactgaggctcaaagaagttataatccttttgagattttttttaaaacccactgattaaatgtgaagctgtcttgtaaaccagtgaactgcctatccccagaggtatcagagcagaggcaagacagccagcattgggcagtgacatgaaagggagttgagtctcagatgggtggctggctcaagcgacttctgaggtctgcattaaccctgagctcccaggatgccatgtttcactgtgatctgcgttttaagcagagtgactcactagtcacccaggaccagccccacaaagacagcacctgagaccaactgaataggagggatctgggtagggctggcagcttcctttctcagtgctggcctggctaattgttcagtcctatttccccttttcatcttccttgactcgtctctcaagatcaaattctggtcttggccttttctatgccctgctgcccatctgggcctcagtttccttgtgtacaatttaaagagaaagtaccagagcgtttctgggttcccttcatgccccatcatctctgtatttggaatccccaggccaagcctcctgttgaggcagtgatcaggcagctagcttcacagccccttctttccctcttccccaggtcttgatcccaggcttaaggtccccggatgcatgaaatcctgctgatgcagcaggaagggcgctggacactgatcaggctgacttgggtgcctggataggtcagggtgcctagcccactgagagccgtggtgtcatggtaaaatagggcctgtgatcctgatgcccatgtggaaaacaaactttgcacatgtgcataagattgttgttattagaggacagagggcctgtttgtccttcctgtggaatgctgtgctgttgaattctctagttattccctgtaggatcacctacccacctggaagtaggttgcacccttgccagtgctggagcaggtggtccctgggccctctgcagtgcgctcggtcattgcaggggctccaggccgggctgtgttggagactacaccaaataacctgggcagataccgccactgccctccaggaacatccacagagcagataggcatggacctggagtggtcagtggtgggtgcactgagatgagcatgtggctctccaggagttcagaggagggaacaagggcttccaatttgggtgatccaagtagagtgggttgtgggaggtggcggtgatgagaactgagtcaggcatcccaggccgagggaaaagcttgagaaaagcatagaggtgggcccttgttgctagagaggagtggctggagatgaggcttttgatgggataatgataggaaaatctcatggggcaagagcatgtagagactgactgggatctggaagcccaagttaacctaaaggcacagcgtgtttttgtgcctgagatcgtctcttcactggccttcagccctaggaattctcagaggtaaccaaggagttatggtggcatggatgacagtcattagcttttgcaaagggcttccctgtgtgccaggcactgctccaagtactttccagagattagctcacttaatcctcgcctatgaggtatagggatgttcatcatccccattttacagaggagaatactgagcctcagattaaataagcagcagaaacagaaccaagatgcaccttctggagccctcgcttacaactaaaacactctctcatctgtcctgtgttccccagagtctgaggaataattggaaaatttagttacttaggccgcctttttagatgttactaacccttcctctggcatcctttataaaactgttcaaagtgtcatctcacaggatgaatctttaagcattaattgaaagcattttcacataatttttaatatgtaagcaattacacattaaaaagtccttagcatgtttttattattaaatcaactttatagcctaataagaggaaattaaagtcatttcacacagagcccccctgctttgacgtggctgttttccttgcttacaactggccttctgccctttttaactgtgtgctagtaggcaccgtccagatgaagccagtcactgattttaaaggcaagaggggattttttttgtattttctcatcctctggtgtggcctcttctagtggcaacatgctctctgggagaatcatggggtttatcatgttaaagacgatgttccaattgtggcctctgtgtttcaggagaaaggaggcaggaagtacaggttctagccttggctctgcccctggctctgcccttgggcaggttgcttctcttctctgggcttcagttccctcatctctaaaatcagattctgcctccttcactgggtgtcaagaggattcttagaggtcatgggtctggagtgacttcataaatcctttggttacccgcctctgcggtcacactgggcttctccagctgcccttgtcaggcctggttctaacagtcctgagggtcctgccccacccccagccacctccatgtggcatcagcctcagcccctcccaaaagcatgcatgctgctgtctctgctctcaggacagacaggacaccattctggacagccagctctagaggcccttcctagggctcctgttctctcattctggaatgaactctcccggagaccggcaaatgcttctcagaaaaaggagcctgtgagtcttgcttgggtgtcagagaagctgcctctggccaccctgcctgagacttcagccttcctctcatatttgccgtcagccctgacccctggttccaggcagcactgttcccctgagctgggaaagcaaagggccttctgtctgggtcctgagtccaggccattcccagccccagctctgtagtgccgtggactctgctcccaggatgtccacacacttgcctccctgcacagctctgctccccaaagcctgtaccctgagccccctcacttccttctgtcctgctgcctctcaccctctccaggcctcaagctcctccctggcctgccctccccaccaagacaccacaggcttcagcctgtcctggtggtcacagctctcccccagctggatcatggcaggatggaactgtccttgaggagcagtgcttctggccccatataggcttcctgcccgaggcccagagagggttgtgcactagccaagtttacacagcagcaagccacagggcaagtctcctgacttccatcctggagctcctgggccttattttgaaatgttgtgaaatctgttgtcaatcctcctgcctggcaggtagcaggcttggtcgtagactgtgcagagttccctggctggtctgtcatttgccagaatgacttacctaccggacaggaaggagatcatcaagtgtaaatagatttcatattagtcacctgatgactttcctattcttaagaaacagcagggctcacacacccagcccagtggtgctcacccgcagagctgtgggcggggagagaagtgggaagcctgggtttccatggcgaccagcgggcccactctaggagccacttcctattctctcaccccggctcccctcttgtctttgacccctgacactgagcacgttcaggttttcaggaaagttgcagcaggcctggaataggccaaggagagcagacagtcattgatagcacccccgctgtgggctgagggtccttgccctccaggtgctcctgtcacatggggaaggtggacaggggcccagagaacacttgatgtctgtagtataaaacaaactaagaaaaattacactggagagagaaatctggtcttggagaacacagaagaaggagtggtacagcctctgggaccaaagtgtgctgcacaaagagggcagcatcccagcaaagccaagcttgaggtcctgactcaaaatgacctcctcagggaggccttctggccacttatcttacatttccacccctcccccacctctctgatgttgttccttaacacttgtcattatttagcatattacatactttttttacatttcccttgtttgttgtctgtctcactgctgagatgtggccttcacaagggcagagatataggttttgttccctgttagaacctgaagtacctggtacaaagtaggttgtcagtaaacactggttgaatgaatgagtgcattaattcactcctgggacctgggctggtccacagagtcctgggtgcccctcaggagcccagggacctcctatcctcctccaaagaatgccagatctggaaagtctgagtttagccacttgctaggtgggcagggaggctgccttggcgtcagggtgggagttgggtgggcgttctgaccagttctgtctccgcagccggcggactgcatagggatagctgattctgcctcttttccttccctctctgggccgagagctccgtgaaggaagggactggtcctcacccatcttcatttctcttctgggcccagtaaatattcaccgattgcatgaatgagtataggaatgcaagtctgtatggagaagaaagaaaaggaaacaaacaaatactcactataagcagcctctcccattctgctgtgacttgcttgcttgaagtcacagggcctgggtcaggggaaaaatgcagtgcattcattcattgactgggtggctatttgtgagcacctgccatgtgctggcaccgttctatgctcccgggtctatgcatgaacaaaacaaagttgttctcatggagttaacagttgagtgagggaccaaggtggcagtagcctacccatgattccccgaaactcatttactagatgctgtggctccgggttatcaagggctggaattcaggggctttctcaaagtcaggagctgagtggagacttgtccccagggccagggccaccttcagtaggaaggatggtctcagtgctgtcttctggggataagggggacagctgtggcccagtggctggcaggtgtgttcctctgtccttggccccagtagaggagcacgggccctgagggttgccattggttttccccgtgctgctggcactaagcctcatagatgtgagggcccaacaaacagattgcagtcctgctgagcgtttgtcagcgagggctcaggcccctcggaacacatccctaactccttgtctttcctggcagctgtgagagaaacgtgcattttacccaaggtagaaatacaggaataggaatgtgaaatggaggagttcacctccccaggcctgcctcagccttgcatttcagaatcccagagagacattaaaagatctgaaagtgcagaaactgatggagatacctgtcctgaaataggctcagggagactcagattaatctgcagcaaagctcctgcatcctgtacccgcccagctccctgcgtgctgggcagggtgtggaaaccttgcggaaacccacactgcaggggtgtggcacgattaggaagtcatttaggaaaacaggcccgcctgggagtgtgggatggaatcttgcagcgcctagcaagaggcagggagacaggttctatggttccgaggctatagcaatcatctaggccaggtcaggtgctgtggagtcagggtaggtgtggtggaagggcccaccagccagtgggtgctgtgtggaagggagaggagagggtgggatgacaccaccagtggggtcctctgttagtgggaggatgggaaagtcagtcacctgatggggcctgtcctatctgagtagggaagggaggttcctggggaggagtcagagttgagatgtggtcacctttgaggtgggagcagccagctaggtgcttgggagagattgaatgcattcatgtgttagggaaggtgctggagtcagatcagaggagggccccaaactattccagggacctgggggccaccatgagaagtcctggcctgtgtttctggtctggggagaggagtagtatgcagggagtggccaaggagacagccggccacagttcctgcctttcagaagcctgaaggaggagattccgtgatttgccccacaccctattatttgactaattaattagtactctcctctaagtagggctcaggctggctttctggaaacttacagagatgacagcagtctgtgtttaaagggtaccttttatatatgataccaggactctccctaaggctccgagaggaagcagatgagatgatttccattttgcagatgagaaagctgagtcctggtggctgacaggacttctggccccttctccctacagggatcactgcctggtgatgcaagggagggatgctgagtaacagcaggtctgagtcctcccttggtggcggcaatgtagccggtgcctcaggttcagtgctcttccccatctcctggagagtcctgccttctccctttcagccagcttggcccgtttgcgttcctgtggttagtgagggctggctgtggtccttttccaaaacaggcagctgagcagaaggaaataaaatgccacctcttcactctccctttcagggtataggcgtgtaattgtacctggccaccttaaagcaccgaaagaggggccgtctcccaagcccaagcctcaacttttgggcctctcttttcctactgcccacgtcaccccattctgtccatatgccgtcacagccctcaccatgtccactgtgatgtatctgctagactgggaacccctggagggcaggatgacaggacaggccggggccagggtgtcttgtgctcagactgtcggtgccctgtgtttgaggttttggcctggaactttctggtgaagaatgtcccctcatccagaacttgctggttttggtggaatgatgtgtgcacatggtgagtaaacatcccccacaaatctctcagctcccagaactgggtctcatgcctgctgggccggctcacctctgccctggccaatggggcagtgtgtatcctgtccctggcacctcagctgatctctcacttgctggcctgtggccgtgttccttcccatctgctaagcctcgagtctctgcgtggacgctggcacatgcactcatgtgcccgtgcccccagccacacagccctccgtgaagctaccctctctggcaactcctcaccaggtcgggggccttccaagtcttcatgctgccctagtgggcctctcttggcccctgggtcccccttccccaccctctgcccctcaggctgggttctggagtcctcaacttcctgaagtgaatggccttcatcatgcctgccttcagctctagcctcttgctgcccaattcagaacacctctggcctggtccccccacctttgccagcacagccctgggagggtgggctggggggtgcccacctcctcagcagatctttattcactcagctccaccgcggcccttcccttccgagtcccacgcagcccccagcagctcaggttcaccttccccagaagcctctgcatgcttcaggctcccgatctgctgctttccccaggtgcctgtggctcaaggcagaaccaggccagctggcattcagttttctgctcaggtggtgtttactgaagccctgtgctctcatgcccttcacagcatctctcctaagcctccctaaggcccagggagggagcgcctgggttgtttccattttccagtgagaaacctggagcagaggcttccgcaacagctgggggcctgggagcacctccaggaacctgggagttgtgttccaaagcccaggcaggagcagggcaggcagtcaatgggccggatggaccctgggctgagggaagcacatgggcctgagatagatcccccgggccagctcctgccctccccagtaacagaagcagaggcctggagccaggaggcccccagcaacagcctcaccaccccacacaattgggaaccagccggtgggcgacagcatcctcccttccttgacctcttctaggatttgcttccatttctgtgctgtgtcctttaccttacggagaactgtttctgctgagtgagtctttactgggggaagggttagtgctgagccactgagtggcctgctccagtgggcactgagggacatagtacagttgggacagtgtcagagctatgtaagatagaggaggggcagcccggccccatgctcctgtcctccccttcagggtgaagctctggagggtcttcgtggagaatccatggaagccctgctgttctgggcactgcaacgagcacaggggctgggaggtggagcccaccttggccctcccctcaggagggctgtccactgggatgtggcttatgactgctgtcatgtgtgggtgtagaaccctgccctcgtgggacggggagccgcggggaggatgtggcccattctgcttggttaggggtggatgttggttaggactgggtgggaagggtggtggaagcggttgcagcgaggggcatggcctagccccagggttcaagggtggagttggaaggaagtagaggcctcagcctaggacagaacccaaggaggtcctgtgtttagctgaaggggactcagaattgtgaaaagcacccacctggggcaggtccctatgcctttggctcgcccatccctgcccccttctcactctcatccccagcacagcccaggctgccatgcaaagtgagctgtcctccagctgatcctcagaggaaactagacaatatttttaattattgtctaatttacacccagaaattaggaggaagggcttggtccttattaatagcccagcctgtttacccctagacttgaaactaattttcatctggaccaagatttgttgtaaattcccaaggctccgtactaataaaaagtttctggctgccttttgggccccagccctatgccctgggtctggctcccaaatttgcagaaatgtgtgatttcttggggtgagacagggtggatcttaaaactcacggtctccaccccagggaacttgatgcagggtcctggagtctgcaggatctagtactgcagttaaaattcacagtctggttttagctcactttttaactgaactgtatgtgatgctgttggaaaagcttgaacttgggcattagaacctttcccctctctggaaatcttctttcacagagagagaattttagagccaagctaggttgggggactagacagatggtggtggggctagggtgaggagggtgtgggaggagggttctcacaactgtcccctgaatggtggcctgagctgaagtcctagcccagggccccttccagtcactaggatgccttcttatgtgtttcacgtggttcggtagtgctctttcaaagcaaggcctcctgccctgccttcccctgtaggaaccctgtccaggtcggtcagggttcctgtcctctaggtcctctgcagggagtgatggcttttccacctctctgtttaagcatttaggaggaaaacttctttgtttcaggacacgtatggctttgtagaaatttctaattaatattgtcagattgttggcatttctctaatttcttccaagactgtggccttcagttatatgtgtggggttattgctatcaccatttatatttatttctccttttgctgactactcacatctcatttcatcctcagaacaaccctggaggcagtccttgctatcctttttttaagatagacaaactggaaaaccagagaatcgaagtgacccacccagggtcagccagctgtagtgccagggcttgagctagggtctctttgctatatcacatcagtccctgtccccttcccctcccttccattaaaaagagtctgtgctcagagccaggtcctgtgaggtgggatcagggtggatgaaagtcactcaccaccactcgtgctctctggagctcatggggaggatgcagatggccttttctcttctctcctgttcatctcctttgggctgttatctacagaggtctcagcgggtaagtgtgggtgaactgccaagcgctcaagtcattgttctaactccatggtagacgctgggagagaacctttctgccagcaaggatgtggcctccaagggaactaaccctaaccctctgtggccagccagtctcctcccactctaagaggctgcttgtgcctcagtgtccctggcacctggtctcaccatgcagcgaggcaggaccgcagaagacctaacttggagagtatcgaacccaacccgcctggacatggcttccaggtcaaagcgtccaaagggcttggcctggagaagccatccttgtctgaaggacagaactggccaggctctccccagcccacaaagagccttgcatgtcttcccattcagggtgaggaaaggcataattgtgtctggacagagccctgggtttgacactagccatggagctgtaattatcgtccttaattacacgatggtgcctttgccaggaaggtgtgcttgacgattatctcctctcctgacaagggtggttccgtctccctttgtaagtactgatgtaaacacacaggctcacttgagatttcaggattaccaaagagccattcagagttgcctacctaaggacccctgcctttcagaggagaaaggggcaagccaggtatcagccatgcaagtgctttcttgcctgctgctgaaaaagaatgtccatttacctctgagttgacttggtctctgaaaccgaaaaaaagaattaacttttccctgatgcttaaaataaagaaaaaaggaagagcaaaaagccatgtaacagtgccccatgcgtttacataccaagcacatccctgctgattggattctcacaccaccctggcgagacaggcaggacacgtggtgctatctccattgtatagatggtgagatgaggtctcagagaggctaagggactttcccgaagtcacataggaaaccaggactaaagcactctgccagcaccctgactaaaagccaggctttggcacctgcagggcagtattttggttcattttgtgagatccctcaaccccaactggctctggggctcctatgtggcaagtaaagcctctcagccttgaggggcttccgagggccaaatgccatgcactttataggactgaattgaggggcagcccccaaagactttggaggccaaatcacactgcatttcccaatggactgtacaggttagcccagcgttgcagacagaatcagcccacccggcctcggaacagcgccacctgggaatcagcacacagtgcagaggatgggaggctcaggagaatgcccccgccccctggctctgctcaccacattgggtcaaggtgaagggcaggctgccctgaagatccatgagtgcagggccttccagggtcagttggtaccatggtcaacatggggaaacaagggcaaggtcgtgggcagtggtgaaaatgcggattcctaggccccatcctgtagaggccctcactgaagcccgagaacttgcactgtaatacatggctccatggctctgggacagatggtcccatggttagagagtccctgctttagcaaagagcttaggcctggggtctccttcagttgttcaagctgtggtctggcctggcctggtctgccagcagcagcaattctcgctgacttctcgctccctctcttttctctctccactgcctgtgggagggatggacatccgttctgttgtctccttgaagctacctgtgcaagtcctgaggacccagccctgggcctgtggaaaggaatggaaaccacccactcaggtgtggtgccccagcctcgtggctcttcttgtcagccttcacaaagctgtgattcatactggaatcttgtaaatctctgaatggccaaatagaacagggctgggggtagagggcatggggtgactagtggagagagtcatgagctggaggctgcaggagtgaattgcagctcctccgacagccggtttgagcttggacaaggcatgcctcagtttctccatctctgaagtcaaggcttcagccagatcctaaggtgactttagtgctaacctgtcctggtagtggtggcagtcacacaaagacacgctggatgcacacagggacacaatctcccagaacacagaagcctcccacgtgctgctggtggttgggctgctgcctcggctgcctttgtttgtccccagtctctgtcagacctccactcagtatgcggcgcttggtgtctgcagcttccactcagcactccagaaacctgtttgtgagctcaagtcacactagcctccctaggggatatctttccacagaagcctactttcgaattgggcctaattgtagcatatatacctttaaataattttttttagtgtatttgaaacagctgtcattttgcatgtgcatcagctgaataaagtggagcagccatttgagctcctggtcaccccgagtctgcagcaggcttccttcaccccttgcaggagagagacctcagggaggagagaagctaggaggtttgagaacagagtgagatcagctcgcctgctagtctcagcctttcacagatccctcctcactgtcccctgatgagtttcccaggcctggctagatcatgttactttcctgctcagagatctccactgggttcctcagatctgagcccagactttccaggccttcctcaaatcccacaccctatagggttcccagggtccagcagcaccccatcacccacttgctttcctgtgtaaacgctcactgtcctcctcactgaggggctccccagggctctgtgatcccgcagggacttcctccctcttgttctgccttgctcttgagttcctccagcagcctgggcagggcctgagtgactcacagtgggttccccagagcctagcacagagcttggctcttgggaagagctggttgaaactggatgaaaaatgggcctttcctctgcttccatctcatccttgcctttgaagtcagtttaatggctgcaaacatattaatcatttggatttcctgtttgtccctgaaaaataagcattcaaaataggatttcgaggacaggcagggcagctcacacctgtaatcctagcactttgggaggccgaggagggtgcatagcttgagctcaagagtttgaggctaacctaggcaacatggtgaaaccccgtctctactaaaaattcaaaaattagctgggcgtggtggcgtgtgcctgtagtctcagctattcgggaggctgaggcaggaggattgcttgagcccaggaggtggaggttgcagtgaactgagaccgtgccacggcactccagcctaggtgacagagccagaccctgtctttaaataaataaacaaaataggattttgagaccatcagaacatgtgctttcctggatttgaaaacaggcgatgcagagaccatgtatctggccctgagggtggtgggggaggttgtgagtctctggggcgcctgcagttctgggaagtttaccgtttatggagtccttggtggtcaggaagcccaggccagcaggatagcggtccagctcagtactgtgttggggccctggccctagtgcttccctccctcctccctcctccctccaagctgcctgctcccggccactggtgccttggaatcgtaactcagagctcagagcaacaggaatgctgtaaatccccgtcgcgctcccctttacaagcaggcagttgggcacggcggcactttacaagagaaagcagctccaccacagcagaatgcagcaagtgcctgtcacacgggctgtcctgccactgcctctgcttgctcggttggacacagtgggtaccacaagccaggaagaagcatcactcttgttcatccccatcccatcccagggccctctgccccttagcagggtctcctcctgggcctcaggcccccagggccttgttgtcctttctgccacttgcccttgtcacacagtgagaagctgctgtcgccctggacagctgttgtttgataagctggccatctgccctggggtgatggagcagagtgcctcggcctccgtgtctctgtgatgtgagaggtacagggttccagtcctgaggtggtggagctggacagcccagaaggccaaccacaaagatgagataacttggggtagcagtactttaggagttttgcccactctgcagtcattttgtaccctcctgtgccagcttctacactgggcgtccagagattgacataaatgagatccaagccccagtggatgtggactcaggtctgacatgtcttgggctttactttgcgctgtggggacctccacagaggtatttcgatcactcaggttccaggggaaaaggaggcaggaaaggcttccaaggaattggagcttggcctaagtcttaaaagatgagcaggccaggagggaaggggctgtctaggcagcagcccaagctcagacctggaggagaggactagctagtggctctggggacccaccagtggtttcgtaggtgctgagctgacacctgagttgggtcctgaagttaactcagaggtgggtgtcatgtagagaagagggaaaggatggcttgcaaatggagatacagcctgtggccggcatggctgcagcttcaagaacttacagaggggagacgtggctgccaagatgttcgatgactagttcataaagggctttctgagccccctaaggggcttggactgtacccacaggactatctggagttgttgaaccttcacctgctcccacccacctcctgcctgtcagcttcccatttccctgactcagactattgagctcattgaaatcctcctgacaccaggcagacacacagattgatcacatagagcctctgctctcaaacctggatcaagcaagaaaattagtccaggataagccggtagatatggagagtcacagggcagttagagccagcactggcaatgtcttaaggccttgggtgattaattgacatgtgaatcagacagataattagtgctacattggggtaccaaagggacagaattcttctccagggtgattaagagactacagtagaaggaggggagatataggcccaaccttgaatgcctttgggtgttgaatgaggagctgaaagaaaggccattgctggggaggtggggaccagcaggctccaaccttggcccagagccagcacatcagtggacactctgtgtctgtccaacattaggagatgaggagccagttggtactatagagataagggctttagactctcatctaagtgttcattgaattaccaaatttttttaaagaactgctgctttatttaggctctgggctcctatgtacatgatcacagaattctgcacacgtacaggcctcaggcctgagttaaggaccctccacccaagggctggacaggctgcaaggctgtcccagctatgtgctatttctccctgttgagcaggcttcaaccatgagtaccagctaagctcagactttatgatccaggcgagaaacaggaaagttcatcctgggtgtgagggaaggggaggggttcagatgctcctgaaagtggagtcgcttcatgcagcctgtggacagatggcctggtggcttcctcagcaggctgccctgtgtccactcccacctgcagaccctggctgactacgggcacacagaatggctgcagtcatttcggcttggacattattcaaaaccaccatttcaggtcatccaccacatagaaaaatctctacaaagcaccctggtacatttcattttaaacagtgggagctttctggtgaaccctgtaagagaaattagttgcaaattaaacccccaggaaacaatgatttgacctattgtatagaattgttgggtgtaagccaattggatgttcaaagacacctgcctaagatggtgatttgggtctcagagcaactgattttaaacccctctggcaaacgtaagggagtgccgtcaagtgtcttcagaacagtgaccttctctgcagaatagatgagaatgatgggaatcagccagcatggaatgaggcccctgcaggtgttgggggctttctggataagtttgtcgagcacccttggtctcattgctccctctgccccctaatattccttctgatattaatatacatgacattgacggtgaggaaagcaagctaggaaggaggctccccgctagtggaggaggaatgagagtgtaaggacctttggggtgatgcaagattcagtagggcctctgaggtcctgtgctccccaggcttggagcacgctgtgacccaggctggcctgtggaggagcatttttccagactgactgacagtggccagagctgggaaaagcagggccttctccccatcagcagtgggcaggtggctggaatatcaggcccagaggccagcaggtatacacagcagaggagggctcgcgctaagaggagtttaaagattccttgggagggtggggtgggacttccccaggaaagtgtccgcctctgtctcaccaggacaaggatgagtgggatgagctggagcctcagcggtcatgtggcctgtggctggtgcctccctccgtcaggggacgtgagtgaaatctgaagtgcgtgtctgtgtggtggcagctgtaacgtgacagctgccgcccgcctgcccttcccccagcctgttctcgagtgaggaagcttgtctggcagcgccaactcagctgtcatcccacatcaatttttgtaggttcccagctagtggaagagtgccaaatgcaagcagatgatatacttaatgaaacactcaggaagaacgtttcagttccagatattaagggtttgtgtgtcatgttgctgagccctggaatcagatcatgccttctcagccttgtcacagagtacagggctcttccttttaggggtgaatgtaaaaaatatttcacggtgaggtagatgtttatgctattgaagggcagcatacatgactgatattatgaaagaaaaaaaaacgagaagtcttccccatgtggacataaaccgattgactggtgagtcatttataccagatgtcagctagaaggaaggttgtgtgtctgcgcactctatgtatattcctcatatgtaacatctgcatggggttttatggttacaggtctcttttatataccttttgtttggttttattttaaacagcgccatgaaattgatattaatattctccccactccacaacagaggttgccaagtctctactggggcaaatcgctccccagagggcataggctggtaggcggcagagccagggtttgaacctaagtctcccgagtccagttccaaaatgaacttactggtatttggaattgccagtgtatttcgtatgtggaatcaaatgggaagtaatcagtcatttgagttacatttgcatttattctaacctgatcaagttggaatgagggatgggacagaagagaataatatttatatgcacggtgctcttcattggttactctttcatatctactgacttatttgacttttgaggagctggaagcagagagaagttggaggatttgctggggtcacacagcttggagtggccagctgagagtccattccagatctcatggtcactttctactctctcacattgcagtgttgctataaccatctataaagtaacaaagggataatatgaaaaagggtgattctgtaagtaaatgaaccactgaggtcaatcagccgcctatggttccattattttgcagacaaggaagctgcaaaggagacggggtgctgtctggggtctcccagcagcagctggggccaggcttctgactctagccatgttccacccattgccgtcctgggtctcagcttcaggcaagtcttcacagtctaagttttttgtaggtctttgagccaatagacaggaatgctcttggagttgatctcagttctgtatcgtcagcttcctatttagaagagaaccttaaaattccaaagttcaggtaactcctccctgccaagtgagactgtaagctcaggcttatatcaaaaattccgtatttctcaacggtgaagtccacatttacactcccagttatttttaggtgggaactttatattttctttttttttttaagggagaataaattaacaaatatatgtttaacttacattaacacaaactcaatgtttatgttaacataaagaataggatttcttcattgtaatttctttttattattattattatactttaagttctaaggtacttgtgcacaacgtgcaggtttgtcacatatgtatacatgtgccatgttggtgtgctgcacccattaacccatcgtttacattaggtatatctcctaatgctatccctccctgggaactttatattttctgtttcatatcacattggcttccctgcctaactgaggttatattttctgtctcacaatagtgttggagcagccttatttttagctcagttcgtttttcttcctgtgacttcctttttcttgtttaacacacacacgcgcacacacattcaagtaggcatccgttcccatcgcactctccctgccagttctcattcacttggtcacaagacttcatccaaaaggcaagtgttaagcctcatctcattccaggaaaaaaggaagaggaagagccttcagcaaacctcaagaatcttcttgtaacataggctgctgcttgtcattttattaaaatctcttcacctgtcgctcacctcgcctgccgctaactcctggctgagacactctcatgtgcacagctgataagaaatgctttggagctcccttgcagagaaacctattgactgctgttgggggcatgttctcaggagcttgggtatcaggctcctagagggcctagagtgtgagactgtgtgtgtgtgtgtgtgtttgtgtgtgtgtgcatgcatatacgtatatggtgctcaccagaccctgtttctatctctgatacctgtagcatttgattctggtggcaggcaccccatggagagcacttgcctgtggtcctgtggttgatgatccttgttggtgctgtctagttcatttacaccatgctgtatggtggcaggccaccggtgagaatccagtctaaaatgttaggaaacaggccaggggaacacgacttacccagccccctgcatgggataaagtacggggcagaccccaggcccctgctcaccccgagtcttcctcagaatccttcagtggctccctgttgcccctccactgaagtgtaagcctctttagcctagtggtacttgagcaggtgacacacttacctagccccaaagaagaccacgtttttaggccatgagcttctctaaagctggaccaggtttttatttattttttatttttatttttttgagatggaatttcgctcttgttgcccagggtggaatgcaatggcgcgatctcagctcactgcaacctccgcctcctgggttgaagtgattctcctgcctcagcctcctgagtagctgggactacaggcgaccaccaccacacctggctaatttttgtatttttagtagagacggggtttcaccatgttggccaggctggtctcgaactcctgacctcaggtgaccctcccacctcggcctctcaaagtgctgggattacaggtgtgagccaccgtgcccggctggaccaagtttttattgttcagtgttttcccataaaacagcaacacaggtgctccggaggggaggagtggaagaatgaactagtgaagtgatatgttgtatctggacctcctcctttacctactctagccactagtcaccagaagcatgtttctggtgtgggagcctgggaccccatgttaatctgtgggaaagaacctgtcgtggtgctgcctgtaaccccttcagatccctcagtgaggcgtagcctcttctgacagggtgtctgacctccttcactcccaagcacaccttccttcacagagcacagcctgtgggttatcatccatctcagtttggtttttggttcagagctttgctgatcaaaattgggtgatgggcatcactttgccttgtgacttagagggtatcaagcttccaggagagtggggccctttgcagtgaaaccatgggtcccaaaaagtcattaggcctgtccttgtagctgtgtttttagggaaatctttcatcatttcctgtgctgagaccataactatggttctttaataatcgagtacctctgtggatgaccagggtcatgtttgggggaatgttataattaaaatgtacatcttggagttgaaaaccaatacataatttgttccaaacttaatttcctaaacttcaaaatgtataaacattacatgaagtgaaaattgtttagaaatactcttgaatgcagaagcccatttcactggaatattaagtagaagttgatggaattccatgacgcagtgtccctgaaagcgtggagccctgaggagagcgtgcacagactctgatcagagaagcggaggtgggaaattctagccctgccataccagctcaggtatctgccctctcagtctcagcctcagtttccccatctgtcctaggggttaatgtagaactcctggcactgtgcctcattccacatagaccctcaacaagtgctgtcacagatattgataatatcaaacaggagagtcttcatgtgccacatttgcaacttccttttaaaattttaattatcacattaggtaatatgtgctctgagtaagaagattcagcatacaggcttataggaggtaaaaagtgaaatctccctcccgagacaaggattgttaataatttatgtattcttatagcccttttcccatttgcttacaaaaatacacatctgtgcgtatctacaaacacagttttctacattaattctatcctgccaaacattattctttgtcacagatcttgtctgaggtcatttgttctattgaacgattccgtgtgactgtagtgtgatgtgttcagttgttttcctgttcatagacttgtaggttattcctagtttctggtcccttcattctgggctcccttcattctgtagcaaaatttgtgagcagttatttctgcctgtgggtctggatatttctgtagagtaggtttctaaaagtggaactttaggccacaggatatttacctctgaaaagggcatttccagtttatactcctccaacagtctatgagtacagttccctttttagaatacacaaatttttttttaaacatttgttttctgtgctaaattctgaatttgcaaaaggctgtgtgtttatgttattccatttcaccagtatttgctgagcatctgtggagctgggttctgctgtgggaatcacaggggatgtgttaagtggattcaactggaacttgacccccagaggtggggtggggtgagcctgagcacgcaaagggctagaaaatggtagaagcctcaaggctcccagggtggaggagagatgacagtgggagtattggattcatctctgagcccctgtaccacctccaacacccttgacagtttagagtacctggtgctctaaacagaggctgaaacttgaagctggagcagcagcatgtcagcagggcacctagaggggactccattggaacagaccaccaggggagatgaggccatctctactcaatcaaggtgcctccagtctcgtgttctggaagttgatgacatctttcacacagtctggaacctcttaaggacggcttttcagggccctgagcaggggctattctcgtttcttccagcacaaaaatgttgattatccagatgtttccttccacataattcttgggatggttgtgtggatggtgtcatctataatagctattgacaggaaagagccgcctgagaggaattttgaatagtggcaactttcaggttcctggctcttgtgcatggcatcccacacacaccttttccttccccactcctctttaaaacaaaagcgaaaacagcaacaacaacaacactttaatagggttttatgtgctgtaacaccaagaaatacaagaagtgacgttagagttggaaaggccattagggtaggaagtggagacatagtaactgtgccgaccgctcactctgtgactttggcaaggcccttcaattttgagtttcccgtttccccacttaaatggagttgccggctctgtctgcaatcaggtggttacaagaaccaaataatgcaaagggttttgtggaccttgaagtgctatatggaaggagggagtcttgctgttagtcctttttgttaaattttggttgacccctggcaggtgatcgctcctgggccaggtaggaagtcccaccaagatccttgggctcatggtggctttgctactgtcaagtctcctgaaggaagaattgcaggtcctcttagggaactgctatttggctgcatgcctcgttctttggggtcaggagaaggggcagacggatccctctgtattgtgataaagataattcctcatagacttgactttgaattgatccagtctttgcaggacctttgtttcctaagaagagaaacagacaagcagctagtctaaggaccacgttctggacatgtggggaaagggctgtccatagaggcatgtattagggttctccagagaaacagagccaataaaatgtgtgtgtgagagagagagtgtgtgtgtgtgtatgtgcatgtgcagagagatttataaaaaaaaaatggatcatgtgattatgaaaactgccaagtcccaaaatttgttggtaagttagtaagctggagacccaggagagccagtggtttagtaccagtccaagactaaaggcctgggaaccaggagagtcaatgatgtagttcaagtctgaaggcaggaaaaaggctaatgccccagctcaaaggcagtcaggcagtagagttctctctgactcaggagaaggtccacctttttgttctatgcaggccttcaactgattggatgaggcccaccaacaaggaggggtgtgcaatctgcactattcagtgtactaatttaaatgttgatgtcatccagaaacactcagaataatatttgacgaactatctgggcaccccataggacaaccatgttgacgcataaaaagaaccatcccaggcaggaaagcacagctttgtgtatggaagagaagcttgtcggtgggcagagttcttgttgcatgtagtggtcggattttggaggcatttgctggaaggtggtcaggatgccaggtcagcgtccaacatgctagtaggatgggtgctcttgacaggtccccttccaccttaacttgatggagccacagcattagcaagttacaagaagaagccggtgtgaatatccactctttgtagaagcagactgagaaactctggagtcagaaaggcctctgagatcatctggttcaacccctctcacctcatctgcgaggaatattagccctgatggatcaggcagctggccaaggtcacacagctggtgagcggggagccaggctggtcccaggctggcagcctcgtcattgttatccagaaggcaaaggttgtctctcagtccctggggggattagtgcctctcttgaagcagttccaaagtgaagaagggtgggcagagcatgtgccaagatctcagcaagttgcttccgcaggggcagctgtgctgggcactgggcacattgtcaacagcacccctcagcttgaggcagtgaccctgtgacgccccaggtatacaggtggggctactttggttgggaaggctggcatgtggtgaggggtacctcagcccaggtgaccagggcccccagggtatataggtagaggggaaggtcctccccagcagaggaccctggctctactctaggcagctggcaccctgcccccactaccagtttgtaatcactaagcaccagccaggccggcaccagcagcctgtgttggccgcccctctgacgcatctagaatgtgctgaatacctccttggtgggccactctcttcctcgtgataccaccccaggctttcctcccaggccccccaaccatgatgaatcctgtagggacttgtatgtggtcagataaacctcagggctagagggcagggagcctgagattactccagtgaccctgactgatgaccaactgacagccagagggaggaagcgacttgcctggtgtcactcaaccttgtgggatccggacagagctggagctgggactgggctctttagtgcctgccttccttgctgacctgaatgtgtccgtgttcttttgtccctagtggagtggagggaacactgacttgggctggaaaggcactgtagatagctgcacagttaaggacatggactttggagccagactgcctccatcccttcctcgcttgccctgtggctgtccataaaatggcagtgtctgtggggtaccacctcatggggttgtcttgagagttaaacgagaagctggatggcatgcacttagcagactccagcacgcagtgttcctagaatggtgattactgcactattgacaattgagtttttgcgatgttggcccaaccactgagcttgtctgagctgtggacttggcagcagtcaggcggggagggtcctggctgcaccacagcccctctgaggttcgctctgtgaggttctgtgagagctgcaggtgaagccacttggtgagcagggaagcccccacagggtaaggggtatagccgtgactggtctggcgtgaaagcctgtcccctatggctttacctcattagagtgtggtcccaggcctctctggaggcagagaccgcaccgtgcccagcagactggaagatcgcgtgtgtggggcgctggcccttcgtgcagctgtggtctgtcgatactcagaaggaacaagctgggacgcacatctgcctgtgtgtgctgcagccctgtgaagtccctgctgggccctggctttctgcagcacaggggccccggggatgcccgccctgtcatggttggcctgaggatgctgatgccacccgtgctagcccagcccctgctcatcatcccagtggatatgccagcatttccacatctgggggctgttcacaggagtgtgttttgctttctggagccctgggcatcttctgcccacttcttgaaagggtggagccctagttgtttggaaggcccaaccttcagattatcagtgtctagttaccacatccccatgtgtcctgccagcttcttaaaggattttgtgtatgtgaagcacaaacccaatgaaggctcctggtccacctttcccagtttcttgcctttagtggctgcacccctagtcctggcatcccagatcctccatagctggccccaccttctgtgggggccattccctgtttccttctacctcatgagcattaggcttaaggcagcaagaaccctgattttcacctcaacatcccccagctttcctctctcccaaacttggtttatgcttgtcctgccccagttgccctttgtcctgatggcctcatcgtcctctcctggagagccttctacacctgggcccactcctcgctgtttgtgacaccaggcagggtccgttggcatccctggccctcaaggtgtctccttgcatcaggacttgagattctgtgaaatgccacctcctccctgaagttttactgaatcctagggctagatttcctttctgcctccatcaagctgctggtacatacaccactctaggacgctgggagccaggcagaactaggcttgtcctggcttagcctctgctcctgtctgaacctcagtttctgaattataaaatgcagtataactcttgcctctctgttttgaggatgaggagtaatttactcccagtgcccaggacacaggacagtgcctggcgcaggcaggcgctcactcgtcactgctgtccaactcagcgcttacagacggtggtgtcccgattctcctgctaagccatgagttccctaggaggcaggaccctcatctaatgcatctagtgctcagcatctggcctcaggtctaatgtggcacatagtaggggttcagtgggtattcgaggaagaaaaacaggcaccccacttgcctatgaagttggatgttgcagtcggcgaggatttagaaagcagtctcctaagtagacatggctcctttaaagggaggcccactcgccccctgcttttggcccccagagcagcaagctcgcctcagtgagtctccacgggggatggcgccagaacgcaggcctgcagcggcttagaggcctccgcacgcaaaggcagtcactggaagatgcagagtgatggtagggctaatggacactgtggatcattgcagagctgcacggcaaggtccacgtggcctttttactcacaatgaaagcaattggtcgtcatcaggtttgcaggctttgtctctcttcgagtacttcaggccagaggggctcacgagaagaccctgtccttgtacagacaaccaagggaagggagcaaacccaggcaccctgactccagacttgggcctttcccttgccctcaggctgagcataaaagatcaggcagtacaggttcagccaggcagccataggccctgctctgctcctaaggtgaccattgttgtcccacagccctgcttccgcagagcccaccctctgttggttgggtgtttctgtgcatgcctggaaaagagatgacagaagaactccaattagtcagtctcctggctcctagacagctccggaaactagactagatagatgaggaggaggtggggcctcctgccgtgtgacggttggggtggctccagctccgtctctgagctgccctgccctgccttgcccttgccgtcctgcagccctgctcttccatgccactcaccctcagcctctgagggacccctgaattcagacgttgaagcaccctggttagggggaggattcttctccagcagacgtttgaatggtttagatgggggtaaagtcacctcccttttgatgtggcacctggaacttggctggttttgccgcgtgtctaattaggaagaaccgcctggcactcccgcagagctcatcgctcactccgtggtgccaggtgtgcttttaacacctcagggacctgactgcaatagacgccctggccccagaagaccaaaaacaagacagactgatttaaaaaaaaaatgtcagaaagtgtctggaaaaggccaggagagccctggtccaggagttaaggagcctggggcctagtccctgtgactttcttcccttcccctgacctcagtttccccatctataaaatggggtgactagacatacatgagaccttccctgtgtgtttcacgttacgtacaagagctgacctagagtatggctcctatgtgggggtgtcagattatcaaagtggcactggcctcgggagttgtggacccagaaatggcaacaggctcaaaggttggtattgggaccctcccgttcccagtgcatttttggcctgtgaggcttcagtcagcaggccttctgtggctctgtgggcaaagacagccttggaggaggaagagtcttggagatggggctccaaggaagcccccaggagtggtcgttgaaatggcaatattcacaaaacgccttctgtgcaccaggcactgttcgaaacacttgacgtatatggattcatttaatcctcgtaacatccttcctccagtgggtgccgttttctcccctctagagatgaagaaactgaggtaacttgccccaggtcacctgttggagccaggattcagactaagcactctagtgggatcggtgttttcacccagcacacagtgctgctatgcctgtcggttcacctggacccagggctttgcctccctccaggtggttggcgaggggcagccccgctaagtggcaagtgcatcattccagtaatgcagcccttcctgacaccgctggggccctgagcctaatctacctgcaaccctggcgtctcaggcacggatccccggtggctgcaaagccatgtgagagagatcagatggcatgcctaccactggcagaatagaggtttcctgggttgagaggtagtggcagggcctgggagtgaagagccatacaactctacctagcttgctaccccatgattagggagtggtatggattcccagacaagcccagctgggaaaattagaggtgaagggcctgcaggccagcgtctatcatttccagcaaggctcctgcacgtctgtgccagcctgtgtcctgcccagctcctccctgcccagaggttcctgggcatcactcctttaccactcctggggatgctgccgtgcagtacttttaaggccatccagaaacccacttccatctgcctccagcatcatctcccaccaggtacctgtcagtccccagccctctcgagcaacctcatgtacaccttaagcttttgactccctgggcctctgccttggttcttcctctggtacccattttcgccgccacatcactgtgctatgacctcctgtctaaattcttttaaggccctcccaggttcccccaatggaaacctgtctcttagttatcagattgtggtatcaagtctgctcccattaaggaggctgagctgtgtctgtccctgttgggagctctgccttctcctaccaagagcttcatgaaggccaggactgcatctcattcctctctgtctcctctcatactgggcattcagtagatagttggttggttgggaggacaggtggatgccagcacagctggaaaagatggagggggggggggcaccagagaggcctgctgatttccttggcctcagttttccagcgagcaaacccaagccttttttttctattcctgaagagaaggtaaagaagtaaagaacaggtttcttctgatgtttaccataagacatgttatgtatcatttcattagatgcttattcttttttttttctttgaaacagagttttgctcttgttgcgcaggctggagtgcaatagtgtgatcttggctcaccacaacctccgcctaccaggttcaagtgattcttctgcctcagcctcccgagtagctaggactacaggcgtgtgccaccacacctggctaatttttttttttcttctgtttttagtagagacggggtttcactatgttagccaggatagtttcaatctcctgaactcatgatccgcccgcctcggcctcccaaagtggtgggattacaggtgtgagccactgcacccggcctacttatccattttttttgagacggagttttgctcttttgccccggctggagtaaagtggcgcaatctcagctcactgcaacctccgccccctgggtacaagcaattctcctgcctcagccttcccagtagctgggattataggtgcccaccaccacacccctctaatttttgtatttttagtagagacggggttttaccatgttggccaggctggtctcgaactcctgtcctcaggtgatccaccccccttggcctcccaaagcgctaggagtacaggcgtgagccaccacatctggcccatcttctttcaaaatacagattttgagactctccataataaaatgtttaggcatacttcattttattgtgcattgcttcattgtggtttgcaggtattgcattttttttttttttacaaaatgaaggtttgtggcaaccttccttcaagtaagtctatcagcatcatttttccaacagcgtgtgctcattttgtgtctctgtgtcacattttggtaattctcatatttcaaacctttttattattatagctgttacggtgacctgtgatcagtgatctttgatgttactgttgtaattgttttggggcaccacaaactgcacccacagaagatggcgaacttaataaatgttatgtgtgttctgactgccccactgactgaccattccttcatctcttcccctctccttgggcctctctattctgtaaaacacaacaatgttgaaatcaggcctattaataattcaacaatggcctctacatgttcaaaggaaagggagagtcacacatctctcactttaaaccaaaatcttggaaataagcctagtgcagaagtcatgtcaaaaaccgagatctgccgaaaggtaggcttcttgcaccgaatagttagccaggttgtggatgtaaaggaaaagttgttgaagaaaattaaaagtgtcactcctgcgaatacacaattgaaaagaaagcaaaacagccttgttatgctattagagagagagtttggtctagatagaagctcaaaccagccacaaattcccttaaatcaaagcctaatctggagcaaggccctaactcttcaattctgtgaaggctgagagagtggaggaagcttcagaaaagctaacagaggttgatttctgaggtttaaggaaagaagccatttccataacatggaagtgtgtggtgaagcagcaagtgctgatgtagaaactgcagcaagttatccagaagatctagctgaggtcatcgatgaaggtggctatgcaaaacaacagattttcagtgtagacaaagcagccttctattggaagaagatgccatctaggactttcagagccatagggaagtcaatgcctggcttcaaagcttcaaaggacaggctgcctctcttgttagggactaatgcagctggtgattgtaagttgaagccagtgctcatttgccattctgaaaaatcctggagcccttaagaattatgctaaatctaccctgctcgtgccctgtgaatggaacaacaaagcctggatggcagttcctctgtttacagcatggtttactgaatattttaagcccacttttgagaccaacttttcaggaaaaaaagattcctttaaagatactactgctgattgacactgttcttggtcacccaagagctcagctggggatgtacgaggagatgaatgttgttttcatgcctgctaacacaacatccattccgcggcccatggatcaaggagtaatctcaactttgaagtcttattatttaagaaatacatctcataaggctatagctgccagagatagtgattcctctgatggacctgggcaaagtaaactgaaaaccttctggggaagatttactgttctagaagccattaagtacatttgtgattcatgaaaggggtcaaaatagccacattaacaggagtttggaagaagagtccagtcctcacagatgactttgaggccttcaagacttcagtggaggaagtaactgcaaatatgatgaaaataacaagagaactagcattagaagtggagtctgaagatgttactgaattgcaggaatcttatgatcaaacttgaacaaataaagagttgcttcttatggatgagcaaagacagttttcttgagatagaatctattcctgatgaagatgctgggaacattgttaaaatgacaacataggatttagaatagtacataaacttagttgatgaagcagcagcagagtttgaaaagattgactccaattttgaaagaagttctgccgtggataaaatgttataaaacagcctttcgctaagagaaatctttcgtgaaaggaagagtcaatctatgtggcaaattttattgtctcattttaagaaattcccacagctggggggaggggcataaaaaattttccacagccacctcagccttcaggaactaccaccctgatcagtcggcagccggcaacatcaaagcaagaccctccaccagcaaaaagatgactcactgaaggcttagatgattgtaagcagtttttggcaataaaatatttttaaaattaaggttctacatttttttaaggcagtggtattgcacatttaataaactacagtataatataaatataacttttgtatgcattggaaaaccaaaaaattttacaggtacctgccaccatgcctggctaatttttgtattattagtagagatggggtttcaccatgttggccagactggtctcggactcttgacctcaagtgatctgcccaccttggcctcccaaagtgctggggttacaggcatgaaccactgcacccaactttggtgggggggcctgttttttttgttgttgttgtttttttgttttttttttttcagggaggcactaagttggtgaatactggagcagagtatagcttgttgcttgtggactgggcaatcttttaaacccccatcacatcctctcaggattactgcctgctctcttccccagcccttaccttctccacattcccatgggcagaccccgccatggccgcagtctgtggggagcacacctgcctagctctcctggtgaatgggcccaggcaaattcttagggtccctttcagttcaaacattctctgattctaaagaaagtgctttagtcttcttttctttctatgtatgtagttctgtttacaaacctttctgctccagaggtcaacagaaacccccatcctgttaatgtttctgctttctgcctaagaggcatgaaattacagactgccacttaatattaaaggtcattttgcatgaatgtgtagatgctgatgttcagataacttgtgacttaaaacatatggtcacagactcccttgtgagatcggtctctggaccctcatggattggcccagctaataaggaagacgggcctggtagttaggcaggaggcagcaacatctggcaagctggcctggcacaagggccttcgatgtcctggagctgttggtgagcctctcccaggagagaagatgctcccaaatgggcattttctcagggaaaggcagctgcttcctaaatacacgcagctcctggaagcccagcctgcttaaaatcatatttactctctttcatgtgctcatcttaattacattttttctgctctagtgtctttattcattatttaaaacaactttcaaaaataattacgcgataatcccttctcctctacacagtagctgtttaccttcctgtattgggtttttcagctcttggtgttgtggatgtctgtacttacaacgttgctgtcatcacagtgtagatataggccaaatctgtgatgtcagtatttaccaatgcccaggcaaggagcagaattccctgtggggccctgctcatattgacggagacttgtttaaaaagcctgcattatactttgccccccacacataaacaatcttgcattttactttttagcttagcataatttcttgcatggtttcccatgtcgctacataatcttcagattgatcattttaatggctgcttaatattccatccagttaacatgccataatttacttaactcttccctattgttggggccttaatgaaaatttgaattcgccatgtaatgtagtgggggaggcttgttttaatgattaccgttataacatcccctgccctaactgcatgccattactagtccagctttggtaaggtgcagatgcttctggaacaataaatcctgcatgagaggtgtatgcacaagtcctctgatttaatagctaatctgttcactgcacatgtttccctttaaggctggtgtttatggagaatatctgtctctaatgcatattgtttaacactaaactgtatgcatttggcatattgtcccagatcctttatcactactgtcagggactttcataaagtatctggaatttgggggtaaatagtggtttctggctgtcagttctgtttcatttatcccaccacattcactgagtatctctttggcatgagagtgagcaaaagcactcctgattatcaggggcccgacgggaagtacatctgtgaattgtttgtggttcctttagattaaatggtgaattgcatgaaaagtacttcatcaactgtgtacatgggagtggttgctggtcctgcttttgtgaaggagggtgaagaggaaggtggttttcccaggtcagtgccttctcagctgccgtatcctcagcccccagaattctgcagacaggaggctagacttcactcctcagaacggaggaagacgaatacaggtgatgaggaccctacaagacaataagttgcagattagtttggtagatttagtgatttacgaagttgtccaccgtacttaacagttggtcttcaccgtaaagtgacaaagtcctaccactcttttcccttctcttttcctgttcctccctctgtaaaaaaaggaagcatcatcctcaaaactaataaatgatccgagtttactcatgggacccaataaaagctgtgtttgccaaagtgtgggacaccttctcatagatgtgatattaggtgccctgagaactacatagtgagaaggtttttcccttcttattctctctctttccagggagagaagattattcatatttgccagagaaagtgtctgtttgctgattgcatttcccggtggctctccaacacttgcaaatctcacctctcagcagagaaagcaagccccacgctcagcttcccagcaggcatcagcacctaccttgctggtttttattcattctgcttagtatctatttttggcaaagaataatggcttatgggatggtgatccaaagtctcttttttaaatgagtttattttatctaaaaagtgaggcgagataaataaaaatgataagtaaccacccaggttactaccacccaactggtaggcagaaatggcccaagtcatgaagtcacatgactaaataaagcttgggaaatactagcataaagttaattcatgtaaacactaatgatcacaggcacagtatccttggcttctgtttcttcgtggcgtgtgtccacatgagccggcctgaatcataaagcccagcctgaaagcagctctctttctcggaagggctgatgtcatttgtgtgtgttttatcagctgctcttcaaggagcataactcctgtggcttctgccatatctttatgccatcagaattctgatttcgggaagacctcaagagagcattgaaatagctcacttacagtcctcaccccttttgcatcaaggctcacctctgctccctcacctccttggacctggtactccagccaacatggatggtaaatatacataatgatggaatattagcctgaaaaaggaaagtcatacacaggctacaacatggaagaaccttgaaaacattatgaaactgaatgattccacattgttcaggatgtgcctagaccgatcagattcatagagacagaaagtagaagggtaattgtgggggctgaggagggataatggggagagttagtgtttaatgggtacagggtttcagtttgggaagatgaaacagttctagagnnnnnnnnnnnnnnnnnnnnatagtgtgaatgtacctaatgccactgaactgtacgttaatcatggctaaaatggtcaatgttggctgggtgcggtggctcacacctgtaatcccagcactttgggaggcagaggcagggagatcacatgaggtcaggagttcgaggccagccttgccaacatggcaaaaccccgtctccactaaaaatacaaaaattagccaggtgtggtggtgcacatttgtgctcctagctatttgggaggctgagacacaagaatcgtgtaaacccgggagccagagtttgcagtgagccgagattgtagcactgcactccagcctgggtaacagagtaagactccatctcaaaaaataaaataaaataaaaaagtgctcaatgttattatatgtattttaccacaataaaaaataaagtaggcagcaagcacgttctttccagcctcatcgcattggcttgccctggtcctaccaccagaaagccacccctctcctgcttccacttgtcagagctgacagttcaaatgccatctcccttccctcctgccctgccactcccaggccctacactgagccccctttgccgccaagcatgatggtaatttaggcacatgttgtgtctgctgggaacagtgaggttcctgaaaccaacctccatggtaaaccttccccacattccccgcttgggccatgcacatagtatccatgatcaaacagcaggtaaaatttccctgtttgactgggaagtgcctgattttagcatcctagcatccatccttccagccactactggcctcccaggactgagcagcagccaaaatgaacacctcctgtctgggacctcatctagacaggcagtcatccctcagcccacaccagtgccaggccttagcatcttctctagaagatcaagagcttgctttctttattcagaagtgaagctggacaccctctcaaatccctaaataaattcagtctatttaaaagatggtctgggggaggtagaaataaagggaaggggtcactcaggctttgcgggggagaaaagtggcctctggtctccttggggaggctcttgttggttcttttaaatgaatgtgtgagctggtgggaactgggaactgcatggcccagtcttttccttgtacagatgaggactgaaagtccaaagagggcaaggaactgccctagagggaaagaccccagcctgtttatgaagcaaggggtcagaagctctgcgtgttctgggtgggcatcaggacacacctggagcatcatgttcacatctgggctctacctcttaagcctgagattcatgagtggatggaggcagggctgtcattaggcctgcgagcatgtgagccttgtgagcaagcctggcccaggaagagcagagatgcggcactgggggttggtggggtgggtaaaacccagacaggggtctgtctctctgtcgttctcacctccccgctggcagctctgagtttgtggtgtttctgggtgggaatgcaggtgaggaagtgcagtatccatttcatctctgcttccttcctttttgcctgcagaatttcagaggcaggaaagtgtccggtcccagcataaaggtatccagttatatgacaccccttacgaacctgaaggccaaagtgttgactcggactcggagagcacagtcagcccccgactgcgggagagcaagctgccccaggatgacgacaggcccgccgatgagtacgaccagccttgggagtggaaccgggtcaccatcccagccctggcaggtaaggagccctgaccctgctcaggaggcagctgctgagctgcgctcagcactcaccttggtccccacctgcgctcaggacaaactccagggttgtttaataatccagttgggtggtcttttttctcagtaccctcaaagatgtaggctgcagaggaaagggagaggtgagggtagggaaaccaggccgaggagaaattctgggtctggcttccagggtctcagtgttccagcctccacactttaaagagagggctcagatgctctcattgtctggttctgtcttggtcctatttattgataataccctagctcactgaagccaagagttcagtttttggtttatttatttatttatttatttttgagacagagtttcgctcttgttgcccaggctggagtgcagtgatgcgatctcggctcaccgcaacctccatctcccaggttcaagtgattctcctgcctcagcctctcaagcagctgggattacaggtgcctgccacaatgctcagctaattttttgtatttttagtagagacggggtttcactatgttggccaggctgctgtcaaactcctgacctcaggtgatccgcccacctcggcctcccaaagtgctgggattacaggcgtgagccaccacacccggcctgatttcagttttcagaaggaactttcttagaaggtaagaggaacccagtgtgcacagcagctcctgttggccctcagcgggcccattgatcccacccagtgctgcgagctgagctagccctgcagggctcacaggaccactgtgtcttctatcccagtttcagcgtgcacacgctcacagagcacaggtgatggacagagctcagcccctcccagatgaccctcccctggccaagagccccttgagtgacttgggtatctccttcctactcaaaggctggtttttctagaatctgggtatctgtcacaattctagaactcctctcccacagcccttttgaaaagtgatcttgggcatgtgcatcataagtcataaatctaagctaacacctttttattctaatcccactccttagaatctgtgccaaagttatgataaaaaattcagaaggccgggcgcggtggctcacgcctgtagtcctggcactttgggaggccgaggcgggtggatcacctgaggttgggagttcgagaccagcctgaccaacatggagaaaccctatctctactaaaaatacaaaattagctgggcgtggtggcacatgactgtaatctcagctactcgggaggccgaggcaggagaatcgcttgaacctgggaggtggaggttgcggtgagccgagatcgcaccattgcactccagcctgggcaacaagagcaaaaaataaaaataaaaaataaaaaaattcggaaaaggcactgtttataatcatggaaaatggagagcaacccgaatgtccagcaatggggactggatttctgtgcgtctgtgtggtggaatattggaatgttgtgtagcctctaaaaggtgatgttcagcaagagttcataataacctagagaaatgcttatgtctaatgttaagagatgaaaagccagatgccaaacaatgtttaggtatctcagagtttaggcatgtaaaaagagagacagtgagtgacatttaattcctaccacactgacaatcataaagggaaactttttatctttagtttgtttaaaatttattttgccttaaatctcccctttttttgtatataactagaccctttctacctttctaaccccgaacagtgaggcctctaccctgccctcatcccaggccccttaattgctgttctagccattccaacacagattactcacagttctgtgaatatagcatgcgctgagcaaatcccatttttctagctaaaatgcccttccctgcctgtcttatctggaacaattctatgcctcctttgaggcccagcttaaacattatcatctctccaagccctccctggtacacagccatgcactccacaggcttcctgctgcccctataggtctgtcgagtttcctgcatacatcactgggggaagatttctcacaccacatcagggttagttctgtaggtgttggtcttgcctgccaggctgtgaggtcctcaaggacaacctgtcccatcacctttctggagccccagcccctggccgagagccaaagataagagtcatcctgtggctgcaggtccttagttgccccaggtctctcctgtgcattttacagcctcctctgttcccttgaaccaaaggaacccaaggtctgtcccctgggcatggctgatcaggggctgtgtttctctgggcatgggaggaactggggccatccaagagcttactctttgcaaacaccagtttgattaaagggctaaaaaggctcatgtgacaactttcccagacaccgaggacccacattataacgcagcaccacaggcaggtgtggggactcaccctcccctggactgaccccctgtgggcctctcaggggctgcccttgcctttgatggtctagtctagtctggcatcttgttactcaaagtgcagtccctgaaccagcagcattggcctcacccagtgctggttagaaatgcagggtctcaggtcccatcccaggcctatgagtcagaatctgttttaacaagatcccaggtgatctgtgaaagtgaaaagcaattcccctattggacatcatctttgaagaaaactctcaggccagaacttgcccacttctgcccaaaggtggttttagaactcctgtacatttagttgttcacaaaggatcataaggtctcagatggaactgtctcagaatgagtttctgagcccacaagcatccgttttggcctgggttttgtgtggcagagttgccatcacaggtgtcacggtcagtctgagttattgggctgttgatagaagatagacagagaatcacatccacgtctgtgtctcatccggtcactggcctctgtaggtcctactccagggcgggtgctggctgtgcttttcccaagctgcttttggctcagttctgcttcctggggcatagaaggaggaggccatctcactcaggagctggaggggtcctatgggcaccagccttctcttcccatgtctgtggacagagtccattaggcgcagcattggcaggtgagaagcatcctcactgttactgtcgctggagggaaagtggagaggtcggtgggccacctctcaagtggtgaggataagttgaagcagcttggttagattgctgatgtgttgccacagccccatgtgtaaaaccagaagtgcagcttcccgggaaggatggcgaggacccccacctgagtcagtgttgtgtgtgcatgagagtgtacatccatctgcatgtgtgtgggtgtgtatgcaagtgtatgcactcacacttgagcgagtcgttggtgtggtcagtgagtaaggcagcttggctgggccccatccttagcatagtacctgtcagaaatgccctgtgcagttttttcttggcttttgggagctctctgcactgagtctttggagcctgaggtgcaggatccatagctggaggaagagctgtatggggtggagttggctggccaaaatcattaccctctcctttcaccccttatatttgctgattgtgcagatttggcctggatggggaaacttgggcggggaatggggtcagtgctttcaaatttccaaagggtggagagtgtgggggactcctaagggacagacctgggcctgccaaagggggagtcacagggatgtagggcccaggtgaagggtaagaattttggttagaactgaatgtgtgtaatgagcttcccatcactgggggtttgcaagcagaagcttgagcgaggcagggctctgacaaagggcgtgtcctgggaggtcagtctgcaaccagctctgggtatgcatccaggcttcattccatcagagcctcagcgtgctggtcagagacagggagaggggaagatggctgaattagctccatccatctatgaagcaaaagtgccttccagctttcaaagcactgtcccgaattgcgttcaagaaaagcacctctcaggcactgcctcagcattctccactggggcgcccttcttgggcagtgtttctggaagtcagcgccttccttcccatctcatcaggctggggctgccaccgcggaaggctcagttatcacttcccagttgtcacaaaaacagctcttagagtgtgtgaggtggccccaacttcttaggaatgaaagtttccccttctctgagaatggctgacatggaatttaattaaggattcagagagttgttggtgagaaatacttggagccgtccaaacagcaaaccctgggtgttcgttgcctgctcttctccaggaagctgactgtggcctcaccagacccccactcccacttgtcggatcccaatccccaggacaatgcccagtcaggttccaccacgggctgctggctgcagggagtggactgcagctctgcctccacagggaagtgatgtggcttccatcaagctgtcagcccccttcccacccggcagagacaccagccttccagagcaggctagactctgttcctggcccactttgaatcaccccaggagtctttacagcaaccagcaaggccagcagttgggtctagaaatggccttcttgctctgtccccaacccacccccgccagatgcagcttgggcccacacgaggcctatgtggcaccccctgcccaatgttgggaaggggacaaggagccttggatgatgtcatggtgtctgggggtggtgcaggttggtgtggcaggtctacctggttgccaggctgtgtggcacagattgcaagatggacaaatggaacctgagcagaaagtggccacgtagggaggggcccacaggcagggaccaaggagctggggtggatagcctgtagaagcagacctcggtggaggtggcaaagacaccaaatcggtgtcttcacacctctgaaggaccagtgtgaggactgggcatgaacatgtcctgggagtctcagtttctccacctgggaagtaagaccagtagttcccacttcagaagggtcttggtgagatttgatgggtatcacatcaggaaagtactggcattgttgctagcatttactgagcactttctgtgtgcattctctcattcaatcctcataatcaccctctgggaggttagtttcctccttttacagataaggaagctaaggtcccatgagaagaaataacttggctgggggcccagcccatggctggtcagcagcagagccggactttgaacctgtcagctccaactccagagcccctgccctaacccagtcaaatgtctggcctctctggtgctatccaagatgctgcaggaaatatgattggagctctcatccccccacagccctcaagaggtatcgcatgcccttcatctcacttgcactaatttcttcatctcacttgcactaatttctgcgacatctacaccaggatatgtaactgggtggtggcttcccacctgaaatggttccagtcagggtttctgtgggggactgggttctggaggttcgtgctttcattggagggggaccagcgccatcccatgggttggtcttctcctaccaccactcagcacagagaggggcccgtataccatagagtcccacataccatagagtcccactccctgtccttctggggaaactaaggctcagagtggagaagggaacagctggagacctcatggcagagccagtcaggccatacatagaggaatgaccagcatttccttttaacccagtgagtaaacggctatgtctttaataatttgcacttgtatctgagaagtaagtaactgcagctcttgagcttgatagaggagccagatgacaggagggtgtgtgaagggcaccccccagaccttcttgagaaactaagtcatctcatttcgattcaccatctgaagctttgtctccgtgaaagttactcttcaggcagtgtccttggctcagccaggtctgcctcatagcaaagataaaagacacatgactcaaatactgctcagcatacttattttgggtacttatctgtcttccccactagctccttggcagatttctctgccctagaagtttaggacagtgtcttgcatgttgggacccatggggcaatgggatgagtcagacagtcccaagttcacatgccggctccacccttcaccacttcgggacctgagacagactgttcagtctccctgagccttagtttacttatctgtaaaatggggatggtcacaacttctcacactggatctctgtgttgattaaataaaaacaaaagatctgaatgaaaagacatggtaagccctaaaggatcatttggtgttttggttttcagaattggttttggtgttcagagggggcttgctgtattacataaaattcaatttaacataaaaaccatgttgcataaagaagtacttagtggccacagaggacctgtttccaaagctcattcccagttatgcctggcaatgggaagcacggatggtgtggaaagcaccacttcttcaggaaaccccatatcccaattccagcaacagttctaacgagtcccctggttcttccattctttactcagtccctcccgaggattgggccactggtcccctgggtgggagagggtccccagggccttcctccgatccgcgccttccctattctaggtctgacatgtctgtggatttcttttttgcctggagcagtaagtcttaaacttgaaggcatcagaatcacctggaggaagtgttatacagattgctggggttccacccccagggttcctgattcggtagatccggggtgaggcatgggagtttgcatttccaacaggttcccaggtgatgctgatgctgccatctggcgaccccactttgagaacatagagggtacagagtacatgctttgtattaggtgtggggttggggtagagttagggaggggaagtcacctcctccaggaagctttccctgacacaaccggttccttcccctctgtgcttctactacaccctgtactggagtacattggtttattcggaaatagctagatacgcactagacactgtcagcgtgtggggtgcttatgctatggtatcaccccttagccagcctccctcttgagttttgacaccttcaaagcctcatcaaatgaggctaaaagggaaagtaaggccccaggtatgtctatttcctaaacaactatgaatcatctcagagccagctcaactagctaatttaaaataatcccattaaggtaaggaaggatggggaggaaccagggacaggaaattaacatttattgagcaataattataaacctggcataggttaaccctacagagccttgcaaggtagggttcacttcattgtcgtcactcagatgacagtagtgaagctcagagagggtgagcagcttgcccacagtcacacagctgtgaacttgggccagtctgactgcacagcacttgttctctccactgctgccttgatatcctgtgtgtggctggggtcaggctggaattcccttgcacactggtacaaggcagaagcagttgcacccataccatgttgccctcgtgacttgtcaccgtccccctcaaacacagtcgctctgaagctggtttaacaccaccattgtgtgtgtagggcactgctccacacttgctattcccaccaagctatgtgactcatcttcacgtgctcagaataaacagggccccggcatctgcagagggtcccttggagaaccttaaacccggccaccaccaccacctgtcctagccaggagaatgctgtctcttccaaactggctccccttaggctcccatgatgcttcctgtcccctgtatagcttcccagaatgccttgagcctgtgaggaaattaacaattgtgttggtaccaaatgctttttgctatgtaatgagtaacagttgtaattaatgtttaacacctgtgaacagcaggtctgcccaggaaaggggggtttcagtgagagaacggggatcacttgtttcctttggctaatgtattactgagggacaggtttttccagttggtttttctatttgacgtatgaataaattcatttagtaatcttaaaaaaaggagaggaaaaaaacaccaatgtttaatagctttgtttcatctgctaattacattgatagaaatattcctccaagtgcctttgtctcctcagtggaaaaaaaacaaagatttgatagaatacttttgctcttctgtttggcagctcagagatcttcatgtggagatttttaagttccctgaggtcagagaccctgcctgtcttgttcacacctgtgatctgtgcctggcacacagtgagccctcagatatttgagtaaatcaggccggacgcagtggcttacgcctgtaatcccagcactttgggaggctgtggcgggtggatcacctgaggtcaggagctcgagaccagcctggccaatatggtgaaaccctgtctccacttgaatccaggtctctacttgagtccaggtctcctgaatcctggaggcccctaacaagttcagcataaaccctgtgtgagtgcaatacagtctcaaaaacaaccacagtaaccacagtgatacatctatgagcactcactgtgcccccaactctcagtgcatagtaccgcccccactgtacagatgaggaaacagagacagcttggcccaggtcatcccgccagcaagtgacagcacaggactttaaatccagataccccggccccaaaatacaaaattagctgggcatggtgacaggcacctataatcccagctactcaggtggctgaggcaggagaatcacttgaaccccggaggtggaggttgtagtcagccaaaatcgtgccactcactccagcctgggcaacagagtgagactccgtctcgagaaaaaaaaaaaaaaaaagatatttgagtaaatcgggtctcaggaaaaccaaccctgtgttctcttaggagcagtagaataccagtaaatctcatggcctgcccacacacagtcggtgtgttttcatgtctttcttgcatgctgtatacctgtctcctcactaggtgaggcagtaggagggcatttctgagtagccattgactgctgtggctgccacctctggtctcaacttccagggagaagtggacagcatgtccctgcctgtctgaggattgactatgaatccagatgccacattgtgggcctggagactggtgtgttggttgggtgcaggcagccctggcaagccatatttgtggccagtacctggcttgtccccccgacctccactccccatctctcctggcctccctcacagccatccacaatgggcagcagagaaacatacacagtggggctggggctttgggtcttatggacagggagactcatttccacaaatgcccagcctgctccttgcaggtctttgggcttgtggatggggaaaaagtcactttcccaggctctaggattctaaataagtgtctgtgggtgtctgcaggtgaaagtgtcgggagacatactgtatcagacgtgtgtaggtcccaggtatgttttacagatgggcctggcccggaactcaggaaggagctcaggtgctggggccaggggtatctggatttaaagtcctgtgctgtcacttgctggcgggatgacctgggccaagttgtctctgtttcttcatctgtacagtgggggcggtactatgcactgagagttgggggcacagtgagtgctcatagatgtatcactgtggttactgtggttgtttttgagactgtattgcactcacacagggtttatgctgaacttgttaggggcctccaggactcaggagacctggactcaagtccaagttcacgtctaactgttgactctgggtgagtcagtcctttttccagccctccatttcccatctgcataatgagttatgacaataaatatggcttgctttggcagccgtagaggcctctgcgttcgggttatttcatcatcttcatcgggctttatctttagatttcctgtagtcaagcatcagatcttagggtggggtctttgctcccagtaatagcattcatttttcctctggggatgtcacaaataagagaagaaaggcatgccccttctgccaggcccgccgtccccatcccaggtttggacatgtgtgtacggcgttcctggaacccaggcagcgtcctggcacctgcttcacagccttcccgcttgcctgctttgtggtgagtcgctggccgcctcccctcacaatgaggacctctgttctcaggcacctcccatcatgagtggcagcacaatgccctgaggcctgtgtgtgtcttccaggcgaacacagaggcctcttgttggtgatcctggaaatacaaatcaaacatttgctaagccacttgtcctacaggtacctgaaaggaacctacactcactgggcaggtggggtaggtgggtgagcaaaactcactcttgaactagagggaagaaggggcctcacctctctgggcctcggttgtgtcatctataaaatggtaattctcatacttgtttgggaattctaatacttgttttgctgtgtgttggtgagggtcagatgagatgatacagtacgttgtttggaaagctgaaacagcagaggcccattgtcatgtgaacagggtttcagtcatctacagatgttagtgcattgttgtgaaagttgatggcattttcatagactccgggggtcatgtagtccaccctacctcccaaaccaatgcataatctcccctccttgccccttcctggggtcgcacaactacctgggcagcagtgccttctgggctctccacctcagctctccccactctcacccacctttccccctcaccaacaccccagagtcccagcctagctgttggtgctgtgcaggaacccctgccagggactgtgcaaggccttgggcaccttgactctgcctctgtacattcgtgaaccaacaccagggctgcaacagccttcaagcccctcctgtcagccacatatggtttacaaatgtggcccatgttcattccagctcatgtgcagaggggctaagaagcctgtggcggttgagagctccttgcaagcagtctacacacggtgccttgtttttcatcattccaacctttattgcctctgtttaaaggaaactccatcttatactggagaactgagagggtcatagacttcaggccagaaagaagcagccagacagtcagagcttggagaaccatgccagtctcctctgggtcctgttgctccgttccagttctctttgaatgaccccctatccccgggggccactgcccgcacccttggtcaatggtgaggacaagaggatgtgcggcagactgtcagctcttctctcactgcacctccgccggggaaggcactcctgggttggggaggctgcccaggactgcagtcccaaagcagagggctcaagggctagcgctgggacccattgcctgtcatagcaacctgttcctattgccctgggcaacttacctaaccataccgggcgtcacttttaaaaacgagggcagtaatagcactgacctcataggtttgccacaacaactagaggagaacgtggactttaagtcccccatggtgcctgcccatgagcaggaatcactaaataaagagtaagctaggccaggcgtggtggctccttcctataatcccagcgtttgggggagactgaggtaggaggatcacttgaggctaggagttcaagaccagcctgggtaagatagcgagaggccacctctacaaacttaaaaaaaaaaaacttagcccagcatggtagcatgcgcctgtagtccctactgcttgggaggctgaggtaggaggatggcttgagcccaggaattcaaggttacattgagctatgatcgtgctactgcactccagcctgagcgacagaatgagaccctgtctcttaaaaaaaaaaaaaagaaagatgaagccatttttcaaaactgttcccaaaatcacttgagtgagtccagctcctgagtttcctttgttgactgatgaatggaagatttacagtcctgctgagccaggtgcaggttcattccttcaactgatgttgagcatccactgtacatcagacactgttttaggtatcgggaatttagccttgaacaaaacagaatgaaatgccctatcttcttggagcttctcactcaggaatttcagcaggagtcagaaaaaggggtggtttctgatacaggcattgtatcagagcgtacatgtgaccatgggtcagggtctcccgcttacagggggcctgcctggaccttggtacatcatctgttaccttcacggtacaggtattgtcagccctggtttgcagatgaggcagctaaggctcaaagaagtttaagaaacatgccccaagtcactcagtaatgacagagacaggattcaaacccaggtcctcctgactcctaaactgtgagtcgagtcactgcagctcctccattccctgggtgggtttcagccacgggccattcatcggagctagctgcaggtcagccatggggagactccgaggagactgaggcacatggccccatctctgcaaagtgtccaattctgagaagacacctacatgcctcagtgttgcagaggccagtgccaggacagtggtgcagactttggagctcagaggaggagaaaggaattctacctgggggtctagagcaaaacctaccccaggagataacgttggagctgagctctgaagaatagctggggtttttgcagagaaatagtgaagtaaagggattctagagggtagacttagccaaacaaagccctaaagacaaaaaggcagatgatagatctggggactggctgtcctttgtgattggaacctaagggtgggtgtggaacccacaggggttttgtaggggaagttgcatcattacatcaaattcagaggaacttgagcgccagaatgaatttgtcctttgtcttggggcactggggagcagggagggtttgcaaacccaggagagctatgctttagaggtccatcggctttttggagtttactctctggccagctctgaacagtggacaggacagtggaaagagatccaccctgaaggaacacatttatctcatccaagcaccttctccacatgaaacttctgtgagttaggggcagacaagagactggagagggcaaagaaaaataaatcccaggcgcagcacccacagcacccaggctgactgagaagagtggtgtggatgccccctgagctacaggagatgtactgagggctgggagccaccaagagggagatgataattctctgcaggtggcatcagggtaagctttgtggaggaggtggcgtttgtgccagacctttcctagacatcattcagatggagcagaagggcagtaattccaggcctagaagtaggaagtgcacagcagggaggccagatgaatgaggcccagctcctgccagaccagcagccctcaggtattcttgtggggaatgaagacccaagggtggggtgagcctgaccttgcaggcctgcagtcctgggcttgaccctcaccctgctatttggctttgagaccctggaggagttcctcctactactcctctggaccgccgttcctcacccattacccacgtggcagggccagtaggagggatagagctaagctaggtgtcttggatgctgtcttctgttgttggcagtgaccacattttaggactgattggtgtaaaatctgtcatacaatcagaaaggggaccaatccagatgggagggccaggaaagcttcctagaagcaaggcacttgagctgggtctcaaggaatgagtcctgccaccatggcagaacttttggaaaaacattgaccagcctctctcttccatcaaccaccagggtctggtccccatcattggaaccaaagtcagaagggctcccagagcctcaacctgcacagctctgagtcttactttcctccttcagattccaacttccatttttaattgcccataggtgaaattaattaggttctgtcattctaatgactcatgggggtagcatattttttctctaaatgcagatcttcttttgaaggactgtgtctttatcttttgcagaaaaatcactaaattaaaagaattgccatgttaaattgcagattaaggagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttaggctgccaaatcactgcaacttggaagtttgtatatttgtattttaggtgaaatgatttgcctaattaagcctgtcactcatcaccacctgttctctctaagatatatggctatattattaagcttgccagcaaatgtgtaaattatttcagtggggaattacattgttgactaggacgttactagtttttatccaatttatctggtatgaaaccgatttttttttcccaataaagctaaacagcagttcattaagtttcttcatttaatcacttattgagcacctgttatgttgccggtaatgggctaggtatgggggaaggggcacatgatacagcccctaccctcagggggctcaccgggagccaggtaggacatgcagttagggtgctaagatcaaggtgagtcttgggagaggtgaggtccaggaaggcttcctgaaataggtgacctctggagggtaagtggtattagtgaggtgaagagattggtggacctgaggctggacaagcagccgggtcctagagagccttttgggttgtgccgaaaagcttgggctccctccacaatcatgttctgtgctccatgcctctctgctcaccttctgtgtcgggatgtcgattgtagagatttatattggcagaaatcccccaatcctgattttagccagtggagccccaggatgtcaggagtgaaagtgacttataattcatctggtccctcggtctcctgagcctgtggcaaaactaagcctagaacctcacttccagcttagtccccttcctatgccagggcaagccgcagcccttcaacactggcagccctatgggccaggatgcctgctgagttgtatcctctctattcctgacaaccagaaaattagcagcagggaggcatcatggagaagtgcaggctagtcccatgctccctgaccacatccccttctgtgcccatcccaatgggggcatcaccctcccccaagccagaaatctgggcatcacacagcagttatcccggactcactcccacaagtagtcaagcttctacatccctcccgtcattgagggggtcagcctccatcacctttccctgactggtcttcccgtcttcagggattgaccccaaacccaccctccaccagcactcagagaggtctctaaagcccattctctgattatccccatctataagttcaagtccaagctctttagaaaggggctccaggatgacatggccccaatttgtctgtctagccccagtgctctcccctgcccaaggtcacccatggagggctctgcaaagtaggggctcgggtaagaacctgcttcacctctttctctccttctcccaaccccctgtccaagaccatatgtcccatgattggttgccatcagggtgccgtcattcagccagaaccccactgggagatccaggctactggaaggccagcgaggggtagatgctggtggtgatgtgtgtgctggggccccagctccaggttttaggccactatcacaaaagcccccttattagctgatgggaaagggccttctcactctccagccccaggacctgtcccctgggaaggccttgaggtcattgctgtctgtgtgtagttggacacaggaaagaactgtggccagaaggaagggcaggaacccccagcgagtcctcactctgcctcctctccacaccaccagccctggcatcacggagctgtgggtgtctctaggttaaggcatggcctccatgctgctttctggaagcttaattagggcctttggtgagtcttcctctcataggtaaggccagcccatccttccagcgcttaggtcaacagcctgtggtcaccagtagtcgtccttctctgatgctgcacttcagcctgtggtcacccgtagtcctcctctcatggtgcactttgcatgcacaggcgagtcctgccatctctgcctgcagaatgtggctggatctgaccactggcgggcactgcctcgctgccctcctgtgtgcccgtgtacacatgctctctgtccctctaattagccagctatactttctagagcagttttaggttcacagcaaaatcagacagagtccagagtgttcccatacaccccttgcctccatctcttttcagcacagcaatcctgtaaggaagcgcccagtcagaacggctctccacgtctctcagaacaaagccagagtccttcccaagactaggaagcccagcttccttcccaactcccttccagtcactctggatcattttgtgtctcactctaggcacagtcccaccccagggcccttgaacttgttcttccttctgcctggagtgtccttcctacagatgttccttcctcccttcagatatttattcagatgtcacctttggagagggctttcctgccctgctgtatttttctcagtggcacttgtccccagccactgataggcagattgatttattgcctgtctctcctcacgaggaccctgcgctccataaggcaggtatctctgtctgttgtgcccatcactattttcccagccttgaagtgtgcctagtacatgtggataagtggttaggagtgtcatcgcgggtggactacctgtcggtgtcactgctgggtagcaggctggccacacgctcagcacagtccagaaagtgggtgggtccggtgtctctggagccttctgttggcaagagcctcccttcccactgttttccaaagtggttgatggagaaagagtgtcttagagggacagaaatgccccacagtccctgatagggaagatggttcagtggctgagatgtagaacaggttcatcacgctcctcggtttcagcagacagcacgttaccccgccagcgctgaggtttctccaggaccttctgtgagcatgggggttgattttcgtgtgtctggccgggcttggaggatagcttgccacaatcatgcttgctggttagaggagaggtttacgcctttgtgtggcacagccagggacatgtttgtgagcctgcagctggcctcggcttcaggaaccttcctctgcaggctctggcctcgtttcttaggcaccctctgtgtgtcaggcgctggagtatcctcttatctgaccttcacagcagcctggggactcaaagaggttcaatagcgtagccaaggctcgcagctaatcattggcaggcttaggagaagaactcaggttggttcagttgcttctgtgaggtgactagtactgtgtgtgcattgagcagacacaataagtgtgatttataataacagcacagactaccttccacaggtacaggcacagtgctaagatttctaggtgtgtcatctgctttaatccccatgagatgggtgctgtcattatccctgtttttcagagaaggaaacaggcccagctggataactggcaaggtggtctccaggaaccctctggcaactccagttttagctcagcgctttctgctctttgtgatgtctccagggtctccctcaaggagcatcctcccccagcctgtgggggtgaacgatgctcccacaggcccagggcggggagaagagcatgtggaatggcccttcctgtgctatgggcactgctttagcctcacctgggcgctgggtcctgggcccatgcgggggatctgaatacaggggatgtagcatgacccctaagtggcactctataggagtatcccagggaaaggggcagatgtggccagtatggcctgaggtgggatgagaggaggagaggagccacttggaggcagatttttggcccaatacaagaaacagctttttcccctgagaactgtccagaggacagagctcccccaaggcagtgcccccacaaggcagtgccatgccccccgctagaggccacagggaggtttctgtgggggtaaggctgagcccagtggcctctggaggttcagccagcccctcacacgcaccattgggctgtgatcacgtgggtgtcctgtcttaggaagccaaaatcttttgtgccatgttatgtcattgcttgaaacccttcctcctgcaagctgtaaattgccaactagaccagctgaacgttacccttctgtgcctcacagtagctccctgggctgagctctgctaaccctgcactttctctctctccccacagcacagtttaatggcaacgagaagcggcagtcatccccctcaccttcgcgggaccggcggcgccagcttcgtgcccctggagggggctttaagcctatcaaacatgggagccctgagttctgcgggatcctaggagaaagggtggatcctgccgtccccctggagaagcaaatgtaagttcttgggagcaaagcccaacctcacctcccagttcacctagtttttgccctctctttcatgtcatcttcttttaaaaatccacagactgggccgggcgtggtggctcacacctgtaatcccagcactttgggaggccgaggtgggtggatcacttgcctaggagttcaagaccagcctggacaacatagtgagagcctgtctctacaaaaaaaagaaaaaaaatacaaaaattaaccaggtatgatggcatgcacctgtagttccagctacttgggagactgaggcaggagactgaattgaggccaggaggttgaggctgtgttgagctgtgatcacactactgcagtcgagcctgggcaacagagcgagaccctgtctcaaaaaaaaataaataaatacccagactgaggcatgctagaactccaggggccttctagcctgcccctacctccccctctgtgtatacatgggcaggttaaggctcttggaaggttgaggctcccacccagccagtggtaggcccaggattagaacacatacctcctagcttctagccctgaactttttctctccacactgtgttgccacccttaccttcaatggcaggaggaactgcaaaagagtctacagggtgcactcctcctttttacatcctagtttctcatttcatcatgcagcaaataagtccttggaaaaactaaatataaactaaatcctttcccctaagtgtaaaactatgtgtaaattagatttattttctagctacagtcgtgttcttgctccatgtctgcttgatactgttagagttgggcgaggcctttccactcttgatgcgggttttcccagcccctttgcccagagatttcccacctccagtcagtggccaagtcccatccatgctgcccccaaggtcccacatccctttccgttcttgctgccccccagcactgtgcagggctgggccctttattgcccctccccttggccatggttatcatctccctgctctgccaaatcatccctgggtgcagggtcctgctctgctctgaaaccttcagtggctccacattacctccaggataaagtcccacctccctagcctgccattcattctgtgaattgtctgcaaactatgttttcagtttctaaccgtgtctcataactggactagaatgagcttctccaggaacttgacaaagcaggtgcaggacttgtgctggtgtcctcaggtgtcttgtctgcttaaacaagcaaatgtgcaataaagggttgtcagcccattgcctagatgagaacatcagggcccagagtggtgcagagccttggcaaggactcacggctcagagtgcccccaacctcatgacccagaccccaccctctcccctcccctctcctccacttactctttgctcattcccaccctttgcctggtatggagtaggcacacatgaggccacaagactcactgacaaccacacatggttcgtgagccttccctggtgtgtgtcacgtactgtatttgtcttggggattctggtcttggcatggccggcagggcataccctcacaggaaattctcactcggtgagcaggatgcagggttttccgaatgacatcatatgctgcccttttaagcaagtgctgtcacctctggaggcttctgccacctttgtgagtgctcccagccggtgctgtgaatcatttctcacagccatgcagatcgtctgacaggttttgcttatttctgatcaaactgtgcacttttaatcaacaaactgtgactcacagatgttcggcgtgcgtcctgaccagcagtggccaggtctgcctgggtcagtctgggcccagcctgcccactcccacccccagactcagccttcatctcaaggtgggagggttgggctctctttcctttcccattcccacttgatggggcccccagccaagtccagaggcatgactggcttttcctcccccatcgtctcatctccccacgattaactccccaagatgagtcagaagtcctgactcatcacccgaggggtttgcttaaggtaaaatcccatttcggttagagcctgatgaccccagtaaagaggatcacctagtcccccacctgaactgatgctgttctagagttcaggaggcgccttccagtctgaacctctcctccaccctagcacagagggaggtaggaggggagaccgaggcactggggtgtgccccaggtcacacggggtggccatggatgggcaggcacacatctgcctaggtgctcctaccacctgccttccctcctgggacagcagaaaggtgctccagtgctcagggtctgtccccactgcctcctggaggcagccccacctgcacccctcttccttcctccatcattaccatcagtatatgaacgtgtcccagtaacaaactttgccaacataagtaaaaaaaaaaaaccttgactcaacattcctctcaactgcccctgctgagaacagaaactccatgagggcaggaacttgtctaggtcaccactgcatcccctgtgcctagaacagtgcccagcaggtaacaggtgctgaataaatagctgttgcgtgaatgaacagtctccaaagagctgccagcacttctcccctctctgtcacctccccttctctctcacccaccacagccagcctcctttttctgccccggtccccagacgaccccctctgtcctccgtggcagtcaccacagttgaccactctccttctgggcctctgggcctggtgctcctcctgcctccctggccactcttccatctcctctgctggctccttgcctctgcttgacctgaaggtctgactttccagggctcagtctccaactacgtgctctccctgggttgtctctcccaggatcctagtggtgactcacagacatgtagcatcagcccacacctctcccagagctcctgactcctacgtccagttgcttcctggcatctccatttggctgacaagtgggcatctcaaacttaatgtgttcaaaactgggctcctgatcttctcctcgaaacttgcccctcccccagcttccgcacctccataaacggtgtcacatctaactagttatggttcaagccacaaacccgtcatcatcttgattcctttttttgccggacaccagcatctgttgctttaccaaattctgccagtgctccctcctaagtaccaccagaatccattattcctccatctccgcggccacctgccgtgtgaactacttcactagcatcctgacttgtctcctctggcccctcctcacgccaacctgactgactgtctgtaagatttcccagggcaagtaacatctcttaaaactcttattgctgtggatgaaatcaaacttctcctcctgggcacaagaactgggcctacctcctgcccgctgctcacagtgcctgggtcattcttgccgcctttctgctctgtgagcactgcaagcgcattcctacctcaggacctttgcacttgctgcctgttttgcagagatgttttctttggctcttcacgattggctccttctcatgttctcaggccacatgtcatctcctcaggggcctcccctgcccattcatttctaagcgggcatctcatacaaccccagtcactgccttatcataaccccaggatgcctgcataacccttgtcactatctggaattgtttcctgtatctctctgttgactcttcctctcccttcatcagccccgtgagatcaaggatatagtgagtggtgagtaaatactggatgagctcatgggtattggctggggtgaaggacgatagttgagtctccctaatccccctggttctgacctgactggccaaccccacgaggtccagcccatccctgagatgacctcctgcctggattctctttccaggtgaagcaaggcctacgtgggcccaacagttggctgtagccccccacaggaccgcccagcccagcctgactcctagtctccagcctcctgctgacaggctggccagtgccggcccggcccccagatccagcaccctctgctccttctctcctttgttcctcagccccttgtcccctgcccttgactctgtgtggagcagttggggaagggactggtagcttatcctgttaaccacctgggattccccttaacaagaatccagaggccatgcccccatctcagagcagagcttgctcctgagctcagggagggtggatggcaggcagcacttccccagagaccacttctaggcctttccctgaggacggctcagcttcaaatggctgggacttgttttcctagtaaaatgtttttgtcagctcactgagggtgtgttacacagtgaaatctcccagaggacagccttcccaaacctgttaactcttacttccgaagtcaatgctgtctttgtttctcctgattacagccatgtagcctttctaaagcataacatggaccttcatgtctcaggaaatgttttacttgtggtgttttaattgtggcaacccatgcataccccaacttcacattcctctttacatatttctctgtacctttagaaagaaaggggtctgtggtctgcatgctcttcctgccttctcccctggaaagtctcccctccggatgtccagcttggtggccactgcctggactgtccaccacttggccacattcccactggacaaggacactcacatttactctccagtccttgactttaaagttgattttttttcttagggttttaattttgctgtggccactgctactaactgttgagctctgcctcatgagtggcaggaattgcatggggacgggtggtttgggtttttctctgaggagaatgtcagtgccggaactctcagaggcacggtttgcaggacactctgagacaggcaccaggaggcagcatccccacttgcacctggaaatgtaatgtaaaatgcagcctctggatgggcagcggcctgcaaccattgtaggtggggatgtcaccacacagtctgcgagggcaatctctttctgctaacgctgcagctgccgtcggttaagactcgccccacatcaggctctacattggcccttcctgcggggccacttgttacattcccacaacccaagagaggttggcatgatcctcgcttaatagaagccgcctggtcagtggcttgcctggccagcaggcagcagagccaccattcggagcagcatccatgtctctgtggacaaagcacactccaaccacagtaccgccccgtgcctctgcctctcctggctgagtctcaccccctccactaccgcgcagagaccatcatgtaaacaggaatgtattttgagtgtgtccactcatgggcagtgaggatctttattctttccctgcagttttaccgtcagctcttccagtcatgaaaatcagtgagccagacatggcggtgcgtgcctataggcccactacttgggaggccgaggcaggaggatcccttgagcccaggaatttaaggctgcagtgagccgtgatcacaccactacacttcagtcagggcaataaagtgaaaacctgtctctaaaaaccaaaaaaaaaaaaggaaacacacacacacaaggaaaatcaggctggatgcaatggctcacgcctgtaatcctgacactttgggaggtggggtgggaggatcacttgagctcaggaattcgagattagcctgggcaacatattaagaccctgtctctagaaaagattttaaaatagccaggtatggtggcacgcacctgtagtcccagctactctggaggctgggggttggggggattgcttgagccctggagtttgaggcagcagtgagctattatcgcgccacggcactccagcctgggtgacggggtgagaccctgtctcaaaaaaaagaaagaaaagcattgctcccatttcctcctctgatgggagatgagggatgagtcgggccctctgcacggcactcctcccctcagattctgccgcctgccctcctctggcatgcatggcatctgggagcagtaatgctgggattcccacatgcccaagtggtgctagagccgtctggcaggagcatggacagctacctccctgcccaccatccatgtctgcacacatccctgagtcagagcgtggccctcccatcagcaccctctgatggtttccatgttgctcaaacagagaaaagcccctgctgcagccccatttcgggacgtcttgcacaccccttccccttgctgcttctgtccatgctggcccctagctgtttccagaatacgctaggcagccttctgccttggccttcgctgctgatttgtctaccaagaaagctcctctctggcttccctccttgcctcctgcaggtctgcactgaaatgtcactttttttttctttcttcttttttttccattttcttttttctttttcttttttttttttttttttgagatggagtcttgctgtgtcttccaggctggagtgcagtggcatgatcttaactcactgcaacctccgcctcccaggttcaagtgattctccagtctcagcctcctgagtagctgggattacaggcacccaccaccacgcccggctaatttttgtatttttagtagagatggggtttcgccatgttggccaggctggttttgaactgacctcaggtgatccaactgccttggcctcccaaagcgctgggattacaggcgtgagccacctcaccttgagaaggcttccctggccaccctgcctgaaatagtccctcaccagcccccagctccatgagcctatgccacttcatctccatgatgcctgtcctcacactgtgctctgtgatgacttgagtgtctgtggcctgactccctgcaccagagcataagcttcccgtgaaaagagactgggttttgttcactgtgctctccccaggacccggcagcagcaggcgggcagtgggtacccatggaatgaaccagtgcatgcctgcttgtacagggaggctctctgcgggtgctgagtctcccaaggcaggtcagggccatgggaatcccatcgcgctgggctctgaccactctctgccctctccacagatggtatcacggagccatcagcagaggagacgccgagaacctgctgcgactctgcaaggagtgtagctaccttgtccggaacagccagaccagcaagcatgactactccctctccctgaggtgagtgccgccccgagcacccccagccctcctcggcagcctctgcgagcgcagccggccaccgtgtctgtggcagaaaaacccgccagtgtcccctgggaaacttgccagcacacgttattttaggcctgggtttttcaatttgatcctattctcctgggatacagaggagtttttatgttcactgttgctgcccttccagaagatgaggggcctttttctaggattttgtattaactatccaagaaagctttcacatctgctgtgagccggggtggtacgaagttcctagcatgcctcatcctgctctcaaagcccacgacgatggtcctttgatttttttgaggaacatatcgtcgccaatttgcagatgagtaaacaggttcacggaggtgggtgtggctggcccaagtggctgggccaggacttgtgaccagcccatgactctctgccactgtgagcatgacctagctctggcttgcggtttgtgtgggcctgagtttgggtgttgcacaaagtctaggaggagcactgggaagaggtggtgttactgcctatcgcagctttggaaactttcaggtctttctgacctgtgaggcatttctgtcaggatgggcaggcccagaaataagaaaagcatgttttagttgggtgctattgctggacgggacccaaaagaatgcctaaacccattttacagaaaaactgaggtccagaaaaagaagggatttgccaaggacatatagagagctggtgacataactggggtgtaaacccaggctcttcagccagcacagatcccccagaagcagtgaatccctctgcctggcatcctctctgtcccacttaccgctgttagaggccatgggagggagagccggcctgcagggacacggttgtcaggagagctcacacacatgccggccctgtagacagaggcttcagtaaaaccaaggaaggtgaaactggcctgtgttctctgctcacgactgacccctccccccacaacttctgggctttgccctgagagggacagtgacaaactgcagagtcaggagggcggcaggcatgggcagaggcaggtagggcaaggcacacaggctgtgggagtccacctagagaagagagagcatgtggacacggggtggggaccatgcatctctcaaggactgtcagggcagagggagctgatgtacagacaggggacttgtgggcagacaatgcatagacagattccagctctgcaagaggaaaagtttcctaatagccagagcagatcaagaattagagctacccaagctgcctcaaggtagtgagcctgtcatcactaggggaataagaccaaaggctggaccactgcctaaaccagagaggatgcagagggaacttctagcctagcgggtagggcactcaagacaaacaagaaataggtaccttgctcttctctaggctgctggtgcctgcataattcgttgtctgccatcagacctgatggctgaaagaatcgggtcagttatggcagccgaggaaagttcaatatgctaaactgcaactggggccgggcagaaggtggccaaagccagaggagcggaattggactgaggagaggacagcagcaggggggcgtgcacaccaccaggcatgctgatggggccatcaaggtgaatggtgctcttctgggctgtgagaggtaaaggaagcaggtggcatcagcgacaggactcaagtgtcaccagccttccctgcatactgggcttcctcagtgctccagggaccctctggggtgctggtcattgggggttatcactctgtctccctccccatctgtctctgagttcctcagtgaacctcattcctcctggaatccccgtggctgggggcctggcctggaggggcctccacgaaaggatcagggaggacaggacagagcactccatgccaaaccgggccgttcatcctagaggaccagagccccatcagctgctccagcttcctgttcttctaggcagaggtggggaagtactgagcccttgaactaaggtcctgccgggctggcactggggccctgtggtgactccagtgcagacctgccttcgagggaacagcagcctattgagtatccaggatgtgccagggctgaggtcccaaccagggagcacacaaggaacctagacccagtggcagaagtaatagtgccagctgtctcctgcagaatacatttctcagtcccctgtgcattgtaccctcagttataaaagcaggcccagatgtcagctcacagtggggctcagagggccagaagcgtcatttcccctcctcactggggtgtgccattccctagagggtaggaccacccttgacgacacgttgattctgccctcacagcgtaggcatgcagtcccaagggcccagctgtgtttggtggggaaggtagaggacgggcctcgtgcctggcctcctgcactcactggccttgtggccttggccagtcacgccataggggcctcagtgtcctcatctgtgcactgcgtatggcaatgagctgctgacagacagtgttcccagcccagacagtgctgtgtcagtgttatctagtgtgattcccataaccctgcccctgtttcctggggtcagccctgcagtttgattgaagtccatttttaagagccacaggaaggacccattgtccagaattctggataggagtcctgtcctgccactcgctgctccctgtgtgaccaagtttcttcccctacatctgtccagtggggagttgggctttgatgggctctaaggccacctccaccaatgacatcaggggttctctaactctccccatgtccccatctgtgggctggaccacctgcacctcccaggtgaggggaggacgtcgagggagactgggaaggcagcccagcagcctctaccatcaactctgtgtttgccttcccgcacccatcccatggacctcattatcaggaactgtcatttgggtgacccatctgagcccaaaggagctggaggtgaggtctagttttgcatgcagatctagaggcattagatcaccacctccaaaggccggggttgttctcacctgcccagctttcccctgaagaatgccagaattggggaggtgggctgggctgggcatcctatggctgagccaggcaacccactcaggggagatgaacttgcttcccagaggagccccagctcccgatggccagtccagctgctggttggggagcaatgccctggaatgaatcacctcaaccgcaaggggaaccgtcctggtactgcatatcctggctgcctggagcaagcaccatctttgccagccaccaagtgaggggcctgatctctcaaatactcaaggcttgcctggcaggggtgggtggggaatggcattcttgacactgtcaggagcttggtgcaaattgacactggaattccagctatgctggttatccgcctctggccattttcatgtgagtttgtcctgccctgagggtgttctaggatgaagaaaggatctgggggagttcagcctcagaggacaccccgtgcacccttccctcagcagatatttttcagagccctccgtaccagccactgggctgggcatcagagagagtccagaggtgagaacagtcaggcccagcctccaggggctcagcctggccaggccagcctgtgtcttgttgtacacaggtctgcacaggggggtcttgggagcccagagctggcatgtgggtgggcagtccctgccacagagagtcaggagaagctgcagggagaaggctgcacctgaaccttcaagagaaggcaggtgttccccagacagggacggctagcagggcagctcaggtagaggggacagcccaggcagagccatggaggtgcaggagagccttggcgggtctcgggggctcccagaagagttgagatgcagttctcagtgatggggccactgacgtgcaggttgcactcaccaaggtcctgcgaggcattttcttcctcatcttaggctgggggaagccgaatgcctgccagggtccacagcagagccaagactggagtggaggccatgggactcccagccatgtcctcccatctcctccccggcattccttacactcagtcgaaaggtcttctgacgtcagacctagaagtgtttgagacccatttactctagtccctttgcctcatgggggtggggaaactgacacccagaagggatttagggttggtgtaaggctgcccggctggcagctgaccactgaccacagagatggtgacagcttcccactgtggtgaccagacaggtccctggatcagcccaagctgccacctgtcggcatcccaccccccaactttctgcacttgcagtgacccacagtggcgcctgcacacctcatgacatctcagagccccctccatggcaggggcccctacctgtgaatcgtcttcggcgattctgcctgattgcccttgaacactttcctcatcccctcctgcctgcagaactctctcccttggctgcccgccaactcattgacctggcacccaccactggcccctggatactctcactccagcctcagggagcaaagggttgagctgagaaattggcaagaaaatgtcaaactcttaacacagtttcctgtctctggaaaggctggcagtggaggaaagggatgaaaagccttgaaaaaaatctcattaaaaggctcttcaggcactttggcctgcgaatgagtcttggcaagttctggtttggtgagtttttgcaaaggaatgtggacaagatgagggaaggacttcaaagactgggggacttctagctgggggcagacagcagggaggcggggtgagtgctgtggcctccagttctgctgggcaggctctgccctcatggagcagggatcctgtgtgacccatgggaaggggcaccgagtggcacctctgaggcctctgcagtcagcagctttgacaaggacccagcccctgcttggttgaggtggtgagagtcccaaagccagtggggctaatggctgcatacagtccttacggagggacctttggctttctaatccccgaaggcaaattgcctggcatcttgcaaacgtgacctaaggagacacctctggggtctggcctgtttccatcatgctgtggcacttggttgttcacagcctctccagcccagccaatgagctctgccccgtccagtgtcagttactgaatgagctgtagccctgcaggagctcacagcctcacaaggaaaggaagacacttacacctataactcacggagaatgtgttcagggctgcccgaagtagaaagtactctttctatgaaagtttccaggctatgaaagagggaaggaatcaggaaggggaatgtgaaggatgagcaggtcttaaacccatgcacaggggagaaaaggcaggctgcagagagaatgggcccagagacagggcagggcggagcttgcctaagaacaacaaatgacacattcatctgagcccaagagagatgtagccctgatcaccaggtggaggggtcggggctttacctgtgaggcagcagggagttctcaaggtttgaaacaggatgcagtgctattgtcagggctgtattctagaaccatgagtgaactagggggcccatgagtactggcgaggagggatgccagcttctgcctccctgtccccccagtgatcccccccttcccctccatgtccctacacatgccacgtgaactggcacagaccgagagctggggaggggcctgatgtaggagtccagaaggcgaacagcacgtgggcaggcatcccaggagaccgaggcagcccttttcaagatggagagggacaacacaggctctgcagtcagatatctgaatccaagtcctgcttccatctctttccccgcacctgatgctgggcaaggtactgcaccttcctgagcatcacgggatgcttgcctcagcaagaagtaaggcttggcagataagccctacacatagatggtgctcagtatataccagtctctgcttctcccagcttttccagagccttcagaaatcaccacggaagcagcagagtagacagagccctgggtgagtccaggctgtccctgctgcactaggtgacttgggcaggtatctggcaggtatcttctccacttgcatcgataaaatgagggtctggggtctgattagtaaacttgcttccagtttaagggttctatgactagaccactttcctctcagtccaaggatggcaggaaggtcccatctcctccaaggagggaaggaggagcacgacattatcaagaacttgcctcctgtccttcagattgcttgatgacgtctatttgtatccggcttagagcagccgggtttgtgttgactgctgggtactcagtctttagccggcaaatacctcctgtagctccgaaggaggttgggtgggtgtaacagggccaagaagagctgaggggcactgggggtgcgtggcagttagggttgtttttcttttgtctgtcccttcattgattaatatagcaaaggagagagttttcaaacagtaggcatgtctgggtccaggcaggcaagtgattaatcttagtttgttgctgctgacagctaggagaaagaaataataaaggtttaggggccagtgggagtggggatatgaggaaaggctgctctcccctcatctatcagcagggagcaagtctccacttccttctgccgtccaagcatccccttgttgggttaacatctgagactccagacacctagctccgtggtggttgcttgctcccatgtgtgagccaccagggtggtccctgcaaggccacagtgggacctccctggccattgttgagttccccacacagccccagcatacctgaatacctgacagtggacttagtaggtcactgtattccccagccaggcccctgcagggatgatgaagccttttaagagcaaacttcagggaaggcaggtgtgtgcagctcaggtacagtactgcttgcctcaggacccccacactgctcagcagtggttgcaggggccctgagctcctggccatgtgccccatgactcccccaacagagggagctctgcacagcggtgaagacaatggctctgggtcttggcttaggctcttgaaacccagctccgccacatactaacagggtagtgttgggcaaagggactgaacatctctgagccttggttttctcatctataaaatgggtttcacaggtgtattaatgaagacacaatatatgtgaagtgcttagcatatgctccagcatatagtgagtgctctatcagtggtagctcaaatgtctttattatggacctcagagagccacgggttgttggggaaagagctcggtgtgtcccagtgcattgcaaattgtctgggttcaacctggaagtctccatctgtgcccacatccactgtcctttacgatgatgggttctagattttattggctacagctggaaagaatgctagagaatctcacagaactggagtccaatccaggctcccctcttcctggataacctgtcttgaacctctcacctctcttgcactctgtacgttgtgctttggtgtgaccttggatgaatgagtgaacttctctgacctcctagttgctcatcaggagctggagatgatgaccactcaacaggtatcctttttcatcaccatgctgctgcccctccagctctcctgcccatcttccgaacttgtggtctggcctcctcatctcatagggaagcatgttggcagccagtcaaggtagcagctccaggaataccctaagcagaaatcttggggtttagggaacagaaagagactttttcaattttctggtccaatatcttgaacaagtggagatactgaggcccagaaagaggaagaagcttgcctgcctctggctttcccagcaggcaagctgtttgctagcagcatttgagccagcctgagtcagggcagcaggggtggtgggggaagagggggtctgtctctttgctcttatcgcatggaggatttcatgtcctttcagggctcatggaggaaaaatgaactttctgctcaattagcgtgcttcgtgttttctccttctaaaaggtttaaaagaaatgccacaattagaagccgctgctgtaggcaaaacagagactcctcaaacactctttgcagaggactaaatgagaacagtgaactttagaatgtgcagatgccttgcaggataagagagtgcaccattgaggggacactgtgaggaatattagatgacatttccctttattcagaattactgagaaaatgtgccctgctggtggtaaaacattgccaaggacgccaccctcaacattagactggcacctcttctggactctgagcctggtgctttggtgattctggtgcagtgggggtggagagtgtaggaacagccctgggcctatgcccaggagacctgggttcaaatcctagctctgcctctgacaagttacgggatcccaaactagtcaccatgatttgcacccttcctttctgaagggttcagacagaccctagtttgagttctgcatattctctgagccctctgtttactctctagcacagcaagtgtaaatcctgccccgccacctgctctgggctgctgtaacatgtgagtgaggtgatacgggtcagcatgcccagcacagggcctgatatttgggaatagccagctttcacactgtgatagtatgttcaagaagagtagcaaccattgccatcatttttacagataaagaaactggtgttcacattacgtcacagttaatgagtaaagagatgagattgcaacacagctcgaggcctctttctaccttgtggggtctctcggaatagaaacacccccattcctccctagcaggccctgagaagcccagccaatggccaactagttctctggaccaaagctggattttctgacaggacctgtgaccatgagccctgtgcccagcatttctcagacccctttccccaggcagtggtgacatggagaaagcccagagacctgaaaccagaggggctggttctgagccaacagtgtcagcatccatgacccaaatagaagagtctagtttcttctctgggtccagccctcaaggagctgtgaagaaagcgcaactcattgctcctactttacagaagaggaaacagaggctcaaaggggcttaacctgtcttaaggccgtgttgtcagggaggggcagaggctgagcctgcccagctcctggaccactgttctttcctgacccttctcagccatttgctccagctaagcttagaagttctccatttgcactcaggtgctaggctgatgatgctgagactatctggtagcaaactaggaggccaaggccaattcagaggggccagtggcaggcggcctacatacctgatgagagagaagtttaggaagccctatctggccctgggtgtgtgatatagatcaggagagaaggactagggcagtgggagtagaaaggagaggtgtgtggaggtagaattgatgagagggaggaggagtgaggagtcaaggaccacatccagatttcggagcagctgggtggatagtggctctcccggctgcaacgtagacctggaaaagaccaggaaaacagactccctgcagctcagcttcccccttcccaatgctgcctaaaacgcagaggcaagaggtgcctgctctcattctgcctcactctgccagttcacggcccagtgcaccaccccccaacccggcagtgccagacgtgcccgtcaacaggctggggttccctccctggactgctgcgtctcccgtctgagccagggatggagcagtgccctttgttttaccggagctccttggtcttctccagcatctgagcagccgcgattacatttccagccggtttttaattgtctcgtatcagcccacataaatctgcctgtgcggctccgccaccagggaagcattccaactgcccgtctgtctccaggaaacctctcgtgccccgggacagttgccttctgaggcattgggtggtctctccaaatgagaaaaacatttctttccaatcacatttctaacatcttgttaatttgaattatttaacaatatttttgcaaaagccatctgggaatgagttggttggcgacttgggagaaggcatagagggtgctgcagggaaggccacgaggacagctgcagacgtcacatctgctatcagtgaaagggtggctgcatggagaggaaggctgtgatcaggagcccggggattacagcctgaatcccaccattcctaccagccaggaggtcaccagtgagtcacttcccgtctcagcctctgagccctgaggcccagatttgcaatggcagtggaagctcttgtaaactctgagaggctgcacagatgcaggtagggtggtttgcagagcctttgtgctgtaggggcttattttactgatagctgggtaagcgatacaaaggccccacaggaaacatgattggcccttacctagaggcattcggtggggcttgaagcagctaacttcacgtggtaaaatcccagtgttaaggcagggcctgactgttccccagacttttggggagtcagagcccaaagggagttgaatcatccaggtcaagaccctggtggggtcaactgaggcacaggaaggcaagaggaccttcctgaggtcctctggaaggctgctggtagagcccccagaagtcccagctcccaccccagggttatcaccctttggagccccgtaagcactgtatattcttctctcattttctccacagacattgtcagtccttgaggcagatttataaaatcagatgtcaaattttatagcccttgtcttcgctcccgcagttcaaatgctagggctataaaatgaggttttgttgtgtatgcggcacactcgcacgcaggcgcccttgccctctgttggagcagaggctgttccatccgcgggtctatgtctttcacctgctcttctctaggaagctcccctgtgagcagcctccatcctccttccagcacgagtgtttgccacttttaataatgctttgctttttttttttttcttatctttttaaagattatttcacccaagaggaatatcagaaacaattgggtttggcaaagctagcttattccaaatgctttaattaaaaccattttttaattttaattttatttttgccatttcttttggaaaatccacactctgcttatggcctcaggcagcttggagatcaccctgccacgttttaagcacaggctttcagggcggagcttatagacaagtcagcagcatggctttcaccactgagctcttatcgtgccctgggctgtcagctgggtgaggagacaaagacatgtcagcctctgagctcacagtccagacaaggagacaggacagtagggaagtactgtgatgtacagaggtgtggcagaagacaaagcgagggagaaagaaagtaagtctgactaggggcatcttggaagtcttcctggaggaggggccagttgaggaggacttcagatgttaagatgtttgagaggagaaaactggggaagttatggggaagcaacaggacatttaagcaacaaggacatttaagttggagattagaggaaaggccgtatgcagtgtccttcctccctaaggtcccaacttggctagggtagctggctgttcagttttcccttggaagtgacagagcctctctctgttttgtaaaatgtcacccagtttttgtttccagtttgaggtgcataaaatgttacagctcttctagaatttgtctagcagattttccagtttttactagaaaccccccaggaaaaaaatctaggtacataaaccctgggaccttgctttctaaatttgccatctaacatctgattttgaccctcagggttgtagtgtgaaatgatttgtcatctgctaggaacctttcttggctgagcgttctttgggaatgtgtcttttggtctcaacaccccagagggcctggcacatgataggtactcaggaaacgtttggagattatatttgggagaaaagtaatcacaacattcaaaatgagccatgattgtaataaaatcagattgcaaaggtcagcccagtcggtagccgtatatcacatgcatgtacgcatgtgtgtgggaaaaatataggaaggcactatgccaaattgtgattaaccactgtctgtggtgatgaaatggcaggtttttatcttctttttattttagatttgtgttttctggattttccacagtgaatctcttttataatggtgttttgtttggttttgttttgttttttgagacagagtcccgctctgtcgcccaggctggagtgcaatggcgctatctcggctcactgcaacctctgcctcccaagttcaagcaattctcctgcctcggcctccagagtagctgggattacaggtgtgcatcaccacgcccggctaattgttgtattttttttttttttttttagtagagacggggtttcaccatgttggtcaggctggtctcgaactcctgacgtcaggtgatctgcctgccttggcctcctaaagtcgcctggcctataatagagattttttttttctttaatgaggcagagcaggaagctcattggctatggagttaggaaacgcatttctggttccggctctgtcttgagattttctttgtaacttctctgtgcctcagttatttgggggtactttaattggctcagtagagaaaaagcatagagtatcgtggctaagaaggtagaccacctggagccagaatccctccctggttcagatctcgattctgcgtcttactagctgtatggcctccatttctgcatctgtacaatggggagagtaatagttcctacatctcaggatcgttgtgaggcataaatgcaatcgtggtccaggaccacgattttgtacactctgaagccctagtcagctctctctgactccccacagcaactcactttacgctgaaggagacgggctcagagagatgaggggctcacctgtggccatagcagtgctctacatcccagccctccatcccttcaacaactccccaccacttcccagtctgccagagagcaagccgtgtgcccgtcatttcctcctggcactaaaggcgtatgccccaccgaggccgaacacaacctcgcagggagaaatgcatttgcacggtgccgggcaggcttttcttagctcctggtatagcttgaacaggcgtctgcagagtgttctcagaggcaggaagaatgatgccagtaacagtgattagaaactcgaggcagtgtaggattctgacacatcgatggtaagatgactgaggcaacaaacgcaggagatggtgtgacccggacacccacatttcagactcacagtctccaaatattcgcataactccatgttgagttcagattttcaggctaggaaaatacattttcctgttctgaattgttccaaccctaaccaaaatgtcatctctgaagaagctagggttgcctgttttacttctgtgggatctgtgttttcaggaagcaatcagttcctatagtaagtaactttgtggaactcaattacttgcagacgtgcagggggaacaaaaagcagcaataattaatgtggtcaaacccaagccaaataataaaatgaaagctttgttgtctgtcaaggcagaaatcaatttcattagggagcaaagagccagagatttaattttgagaaaattctccaccctgtggaaagaggttgtcaaaaagctgccagaatgagtgtccaacatgagaggatttgccccccagaaccgtgaccacaaagagctgacagtgacctttgaatgttccatttccaaaccttccaagtgtggccaaagccagtgggcttttgcttcttaaaattcttggacccaactgtacacagtggctcacgcctgtaatcctagcactttgggaggccaaggcaggaggatcacttgagcctaggagttcaataccagcctgggcaacatagtgagacgaggtctctacaaaaaaaaaaaattaattagctgggcatggtggctcacacctgtaatcctaaactactcaggaggctgaggcaggaggatcacttaagcccaggagttagaggttacagtgagttatgaatgtgccactgcactccagcctggacaacaaagcaagacccccatcctttcccaccacagaaaagctctcggccccatgcaccttttagggtgctcaagagatgagtgttactatacctgatgacacttgcatgtcaataagaccctgtctcttgggacttgggaggggctgggagagggggggactcaggaggtccgcagaccccaaaaaggagttcaaccgaagctcaggagtgtctgtgttaatgatggagttgtgtccagccagaaggactgatggccaagctggacagaccccacgggaccctgtttagttgctgactcccgctgtgtgagagatggtgactgcctggggaacgggcagcagaagcgaccaggatgggaaaggacaggaaattctgccccaggggcacagctggaaaagagtagcccgggtcttcctgtctctgagggaccttcacagggcagaagcagtggccttggcctgcaggagctagagctcggagctgggctaatctcagcaagctgtagttagccacatttcagctcaggacatggaagaacttaaccacaggcaaagctgtctgtttggaatgggttgtcttggtggggaatgagctctctggtgatggtggtaagtagcaaagctggacagtaaatattgcggatattacagaggagtttccatcattagatggaactagaatgatgattctcaaacttgaacatgcatcagaatctcttagagggcgagtttacaacagattttgcttgcaaagagatccagggggccacaggcttaacaagtaagtctctgggtactggtggacattctaggacacacttgaataaactctattttttaaaaacctccactccacttccagccctggggctccatggtgtctgtaatgaaggcgagtccttttgtttaatatccttccttcccatgtggtatgagcatctcctatgtgccaagcttcaaaggttgtctcttcatcatgtagatggggaaaccaaggcctgagaaggcagaagccaggaccccaacacccagttctgagctctttacttagctttcagtggacttcagggaacattgtaaactattctctatttcacagatgaagaaactgaggcctagattcccaagaactattgggagtttttccaccaggaaccacggtcattcatataatttgcaaaaggtccttggcagggtttctgggtggttcccagtcaacccgatgcctttgaaattccagggaggaaaaaccaccctcaggttagatgcagtggcctttgagcaggcagatctgtcttaatttgcagttttaaaaggcccctctggattttttttcttcttttcaaataaagtttattgtgtataatgaagatatacaccatgatgttatagaatacatacagatagtaagaaggttactaagagctagatgcagtacctcatgcctataatcccagcgctttgggaggccaaggcaggagaattgcttgagcctgggagttcaagactagcctgggcaacgtcgtgagacctcattactataaaaagttttaaaaattagccaggcatggtggcacacccctgttgtcctagctccttgggtggctgaggcaggaggattccatgagcccaggcatttggggttacagagtgagctgtgattttaccactgctctccagcctgggcgacagagcaaaacaaaaaatgttcctatagtgaaacaaattaacatatccctcaccttacatagttacctttttttttttttttttttgtggctagagcagctaacatctactcatttagtatgaatcccatatgaagtacaatttgtttattacctgtggtcctcgtgttgtgcatcagctctctagacttgttcatcctgcatgtctgctcttttgtaccctctgacctacatctccccatctcctccccaccctgccccaaggacccactgtttttttctccatctctacatatttgaatttgttttagattccacatgtaaatgagatcaatcatacaatatttttcttttcttttttttttttttttttttgagatggagtttcgctcttgttacctaggctggagtgcagtggcgcgatcttggctcactgcctcctgggttcaagtgattctctagcctcagcctcccgagtatctgggattacaggcacccgccaccatgcctggctaatttttgtatttttagtagagacggggtttcatcgtgttgaccaggctggtctcgaactcctgacctcaggtgattcacccaccttggcctcccaaagtgctgggactacagacgtgagccaccacaccaggccatatacaatattttatttctgtatctggcttatttcactgcccctaatgtccttcaggcctattcctgtgtggtgaatgacaagatcttttttagggcggaatagtattctgtcatacatacaccacagtttctttatccattcatccttgacagaccttcagttgttttcatatgctgactgttgtgaatggcgctgctgtaaacatggagtgcagatgtctttacaagatggtgattttacttcctttgggtatatgcccagaaaagggatcgctaggtcatactgtagttctacttctaatttccttacaaagctctttactcttttccataatggctgtaccaatctacattcccaccaacagtgtataagagtttccttttttccgcatcctcgccaacatttgttatcttttgactttttgataatagccattctagtgggtatgaagtgatacctcatagtggttttgacttgcatgtccctgatgattgctgatgttgaacaccttttcatatacctgtcagccatttttttatgtcttctttggagaaatgtctattcaggtcttttgcccattttataatcaggttatttgttttttcactatggagttatgtgagtcctttataaattttggatgttaaccctttatcagatgcatggtttgcaaatattttttcccaatctgtaggctgccatttcatcttattgtctcctttactgtgcaggagcttggatgtagtcccatttatttattttgagcttttgatatgatatccaaaaaaatcattgccaaggccagtgtccaggagcttttcccctgggctgtaagagttttatagtttctatttttatatttaggtcttttatccattttgagttgattttttgtgtgtaatagaagatatgggtccagtttcattcttttgcatgtggaaatctagtttattagcaccatttattgaagggattatcttttctccattgtgtcttcttggtaccctcatcaaaaattagttgacccatatgtgtttggatttgtttctggggtctctattctgtttcactggtctatgtgtctgtttgtatgccagtatcatactgttttgattactatagctttgtaatataatttcaaatcaggaagtgtgatgcccccaactttcttttcttcttcagcattgttttggttactcagggtcttttatggttactcagggtcttttatggttccacatgaattttaggattgtttcttcttttgctgtgaagaatgacattggggttttgataaggattgttgagtttctcatctttactttttttcttaaataaaactaagttagataaggtgctttgtggatagtgagtccgcttcattgctgtgctggtgaacacccttggtcagttggtgaggaggcccccaccagggtgggccaggaagagactggtgagggtgagcactgtgctttagcaagagcaaaggtccatggggtgactcgggatgagaaatgaggagcagggggcattgctgcttccttcccctctcccctccctgcatgtcccctccccctgccacatcccccaccccagcttgtcacaccccattactgcagactctagtctgctggtcttgccagagaatcctccgcaatagaggcatggggcaggggctgtattgcggaaagagagcaaacctctgcccttctctgagcctcagtgtcatctgtaaaatgatgacagggaaccaaatgatctcagagtatctggttggtgtcttgtctccctcagaaatgttgcatttagagcagtgcacacagtagacacttaataaatgccattgaccatctatgaccagtttcctgtttagttcgttttctgttttgttttttgagacagggtctcactctgtcgcccaggctggactgcattggtgtgaacacaactcactacagcctcagcctgccaggctcaagcaatcctcccacctcagcctcccaagtagccgggactacaagcgtgtgccaccatgcccggctaatttttaaattttctacagagatgaggtctcacgatgttgcccaggctggtctcacaaactcctaggctcaagaaattctcccgcattggccttccaaagtgctgggagtgcatgagtcaccacgcccagcttccttttctcttttcatgtggatcctgtgtgcaacagtgtgccttagagactgtggtgaaagaacacttgatgtttcaggaaatcgatctcagggcagtaaacgccttgccccgtgtcatccggccacagagctgggccagaacccaggtatcccaccccagccaggcaggctgcccaactggaggagacgctcctgcagccacatccatggcttctgggctgccaatgcagccgtgaatgacagagcagacgtatgggaaacctagctcagtgctcagcccagacagcacagagccagccaggtgcaccagacacaccagacaggcggccactggtgcagtggctcctgcccagcagatgagaacaagacccacgccaggaccctgagtcctgcactggcgtcagtattttctgaaaggcactgttcttcatttaaaaatttaaaaatgcattaagctggaatctagtgccagccccctgtttcacgtcatgcttatccgaggggcctgccaaagagtgcagatttgtacccaggtgaccaggctccaacgacatcctgcatactcggcggcacctccgcacctggcgagccttgcttccctgctgtccagacctcagactacccttgtgggtgaacagtgaaagctctacttcccagatgaggacctgaagctcagaccaggcacagttcagggcagggactcagatacaggtctgggtggccctgagcctgggctgcgtacagcaccatcctcaggcaccccaaggcccacccccctctccagccctgcctgggtcaaccccagggcgctggccccctttgggctataaaagccattgtgcgctccaagtcctcccctcggcagctggggcttcccccgaggctgccttggcccagcctctgcatggtcctgctctggagtctcctcagatgtggtacatctcccaccatgtgctgctcaggtgggactagggggtcctgtccttggaaacagcctggagccctctggaaccaagccatttggcagattccgctctgtgtcttacacctttacataaggggccaggcgagccgggattcgtcagacgttcacacttcatgtggaggttctcatctgcccctcaccacagcagcaagggtggactctggttattcccatgttgtggatgcagaatttgaggcactggccgtctagcgagtggtgtggctttagcctaggcactgtgggaagctgggctacattattctttgttgtgggggctgtgctgtgcgtcgtagggtatttagcagcgtccctggcctcctcttacttagatgccagtagcacctatgtaccaagacattgcgagtattccccagggaagagggagtgcaaaattgccccaggtaggagccactgctttaaggagcctaagggctcagatagccttgtcctcagtaggaagagatcacccttggcctggattctgtccatcctgttggcacaggcatgagaagcctgcttttgtcattttgctgtccccaagcccaggatccactgtggccagtgtacccacctgtctccctccatgaggggagccattctgccctgccttgttcctcctgctgtggtgctcccacccacactggcatgtccgtcactgacttgagaactcagcactgaagggatcccctccagcttttccagagggagacgctgaggcccagggggaggggacttgcccagccaatgatatcagtgggatcagactttgaacttcctccctttggggaagcgcccagggctgaagagtggagaaaaataatttccgacacacaggccttcatgttcctagaaaagtcctcaattagaggtagaaaaaaaaaaaagagagaaagagaaagagaggaaggaaagaaagaagccctagaccctgtttccctttcctgaagctttggcagcatttcaccatccccctccgcttctgcgtccagccctccttgcagtttccacgtgcacttggctgaggctggtgggaaccctgaggggggactacaaaaggcatccagcgggatccacccaccaagtgtcattgccttcccacttacacacccctggtaatgggaggcttactccctcagtctgagcgctcatcatttaaaaacttcttgtctaataatgtgttggttttctcatgagaaaaattgcccaaaatgggttcattttgacatacctactgctttgtgtgctaaaacgagccttatgcctctacatgttcgccaggagaggcatctgccagctctcctgcctagagatggctttttgtcatgatttactgaaggccttcaccctgggccaccaacttagagcttgagaaatgccctggcgtctcgggtaggctaatcgctgctgatgcgtctattgaaagtctaattatttggttgtaaatcacgtcattttgctcagcagcgtttacattgagacgtttgttcacaataacttggtgtgtgtgtctttggcttgtcactgtgaaggctgctttggaagctgtgggcaggatgcaggtgttggccacgtggcctcctaagctcctttatcccagctgccttgactattagaacatctcagctagaaggagcctccatgccccctgccccacgcctcagacagctggagaaaccagtcacacagtgagatgcacttacatcctggtcccctggcttgggaagccctgatagccttgcatcgtgactgggcaagttgcttctccctcagacccttagtcttctcatctgtgcagtgggtatcttgcatataatgccagccctcccagcttccttgggaggccacaggttagtccagtcatggaccaagggagcatttaaggtcttctcagccatgccagaggtaggccaggccctgtgtgagtgggatctgcctgggctctgggtgagtaattggaccacagaggtggactgttgaaatatttgctgtggagaagccacatctctcacagtgttggggcagtgtctgtaaggaggtagcccaggtccaggctacagctctccatgcatttgggattgttggctttctgctaagatagcagggccctctctttgctgaatgctgtactgaaacagtggcctaattctcttcagagatctctaccgcctctttatctaccacacattgagggagaacggggtcgtgtgtctgcctggcaggcgggcacccactctggctctgtgaagattcaatggacttgtgttcagtctcacttctcgcctcagtggctgcatagtcccaggccagtcacttgagccctctgactctgtttccccacctggaatctgtaggcccatctcttggtgttgctgtgaagaggtacatagagctcttggcagcatggccacagtcggtaagatgggtaatgctgtgcttctcgaatcttctagcactagtgttgctgaagtggctgcatcctgctcgcgggtgtgaggaggagagtttctttagaggcatagacctagcaaaatgtcccacttccctggaggtcaaagaggcggcaggaggagagcagaagttgtgagtcataaaggcactgctttcaagaggcagaattgccatcctcagggtgggggtggggttatggcaggaactacccattttgcaggcttgtaggtgaccacggaggtaccttgccatggtcaccctccatgctggctctcacccacatcacagcaggttagcattagagctgggcctgactcccttcaattccgcacaaacttccctgtttgcctccaccctgttggaagcaagtacatgtctgtgggggtggaagggcccttccccatgccaagcatagaggcagtgctcccagggatcagagtgtgagcactcgctgccctgctccccaaggccaagggacctgcgacacctccctcacctgagaattatctggcaactgatggttgagtgcactttaaatgcacaagctcattctgtctctccttccaacaacctggcccaggaatcttcgcacaatgtaagatttaaatgtttaaaatggcccaacagctttgtgccacattctttggggtaatggaaaataaagtcataagaaagagtaggggtaaaaaatagcaaaataaaatagcccaacaagaagaaaagacgcagccacttagagcctgagtagggaggggcagggccagcgctcacattaccccttcaagaagaccatgattttgcaagggaacttgtctcactttcatgttttatttaggcctgggcaggggacactgggcggctgagtggcctcaggaataagtcctttccaaatcctaagggaagagggctctggtgcattcttccctgtggcctccctgggggagactttctgatttgaaaagcgtgtgcctgtgtactcacctcatagggatgaccctccggaagctccccagtccttcccactctgccagttctcactggctcgtcctgggactgttgctgactggagaaagcatccactgtatccagcctcagagtgggcagcttctccctttgctgggctgcagtcagggacaaggtcgaccagccaccagcctgccctgggaagcttacgtctggaggggaggatgcatggggcctcattgccccggctctgggcagaccctggtgggcgggtggatggatggatggatggatagatgggtggatgggtgatgggcacagtgccccagctgtgtgccaggcatgtatgtgtgcccagaggccagagggggctaaggctcagcctgctgagaaacatcacaatgggctgacaggattcttaacctccagttctcaccaagctgcagggaagccagatcttggggcagaaagaggccaacgggtagctgagcagaggaagatgaggctgtggtgggagcttcagggccttgaatgccaggctttggagttcaacaaacataggttcaaatcctagccctaccatgtcccatgagacacaattttcctgagcctcagttttcccatctgtaaacagtgatcattctaacaacttaaagttgtttgctctacagtttaaatgagataatatgtggcaacagctcagctcagagcccagtacccagtaggggctcttgaagtactgggtgttgttatatctgttttggccatggggagccttagatggttttgacctgagggctaatgttctggggacatctgggtcaggacagcagctccccatgcacctttcaagctaaggtaaaccagaaatcccctctgtgtctggagtcctgtaactgggtcccacacattagtcccaaaggccaatttccatccttctcctgcataaatattatatgcaagtatttttaagtcatttcatcatgaaaagaagcgatttaacataactattacccaggattcttcatgaaatatgcatcaagcaattaggtctaaaagcgagaggtgaggcctcgcaccctgctcggcggccggcagctgcaggctgagtaatgttttattaaagcccgtgattgcgctgcaaggtggggcctgttattagccctgcgtgcccggcacatttgataatcctgatgatgaggaggtgctttttgtgatgataatgagcgatctgaacgcctgtgacagctccagcaccccggcctctgccagccttacaagactcattagacaggtcacccaccagagacacctctcattgtgactttgccctcgcaagatgtcctatcaaaggagatgtggctgatgcaggagcttggcaggcatagcagcctgttgaagctccccgggggcaatgccctccctgaacgacgatggtgctgatgacggtgccgaggtgtggaagcccatgctgccttgaagaagggtgggaggagatgtggctcggagcccggctcagctggctcgggatgcggggccggggctctgggttcacctgcagcctgccttgctgtgcgccttgggccagggtagtgtactctctggcctcagtttcctccacggtaccccaggggagtgagaggtgacccccaggctgcttgcagctcagaatacatgctgcctggagcagccatactccttgcctgatgaacccctctgttctccacagaagtgctcatgcttcctttgctcatgctcgcgtctccttttgtgtgaaggtgggagtcactgaagccactcctggcagctgcttttaaatcttcaactgttagatggcatctccctcatggggaccttaaccaatgagaatgtattgtcacagcatgtctcctggctgtgtgtggacaaggcgtcacctgacccttgcattggtcgaggattggcagatagtctcgggacctcggacccctgggggggcggtcaccaccctgcctctcaggctggggggctccaccaatcagaacatgccatttccaatcctcggcacagccccttgtgtgggtgccacacattgtcttttactcccagcccctctgctgtctctgacctgccgtcagccctgcaccatgggcgctgtggaggcggaagatcagcgtggaggggatgtttgctcagagtctgacgcctctcatccgccccctctgcctggcttcacatggaacactgagggttacatgaggccctctctcaggtctggggagtgctgaggtcaggagcactgactctgggcatctgctgctgataatcactgtgtgactttgggccagacacctcccctttctgcacctcggtgcttcaggacatagagcctggcctacaggaaggattgtccctgaaggcaatcctggccaatgccccagtgaaagcaggactggggatgagggcagcggtggagggaaggtgtgaggctgcttgcagaccccttcctgcaggaagccctcagcgggtaggcagcagattatgttttgcacatgtggaatccaggatctagggctggaagtaccccccagggtcatctagtcagcctccctgtggatgcagcaggagaagggacagagcccagcaaggcacaaggatagcctgagggccagggaacccacggggtgcagtgcttgagcccaggagggtcagcatgtgaacgcgcctttctccctctgcctgagaatggtcaggccacagactagaggttcatggagcccaagtgctggtcccagctctgccttggtctctgagcttcatgaccagtctgccccatcggcacagcctggctcagggtggtaaactcgtgggtgcttacacaggcgagataggagtgtgttgggggtgataaacagcaggctcagacaggcaggagggacttcccggggacgtctagactctcttcagcctggcagctgccccacctcgctatctgtcggcagccaaggtacagaggacattgtgtggcttttagtacttggtggccattctaagcccctaacctgggaacagaggagcttagcttctgcttcggactctgtcagagccattgctgctatcactgtccacttcccttgccagatgccgtagaacaaattcatatgaaatgttgccttcacccatgtgagttactctcctaaccttgaaaatgaaactggcttgttcccctgcagcttcatacctgcacactggcagactcagttcccgccagcggctgtgaccctctgcctgacacctcctccactctgtcccccaggtatagatctgtgagaatcacaaagcctgctggtccagcaccccaaaaacgtaaggccactcagtgcatgcacgcagaggggaatgatgtgcccagggtcataccctcctccctgctgagtgtccctggcacctgcagcccctccttaccagccctgctctctcgcccttccacaccccttctccaggcaaagctgggcatgtggctctgagagctcagctttttaactcttctgctgttttctcagccacacagtttcagcgcattacttaagcaatcacagccctttccaaactggcacagatctgtggtctcttcggcgtggtgggtaggtgagtctttgctggaatggagttttacattcttcttgtaacacacatgccgtttcctttctgcagcctaagcgagtgcgccgcctgcttctcagacgtgtctaggcaattctccgatgaaatgacccttcactgaggagcagaacttgccacaggctctgtaattagaacattgccagccttaaaaaaaatcttgatttaaattccagttctttacaggaattagtctctcttgaaatgtaattggctctcccaacgatttcctttaagctaagggtgacatctctaaatacattattatgagcagacatattgcttagtgctcgcacttcattaagcatttgttctgcccatttaaaaatggtcctggagcccaaattaaggtgttaatagagtgggcacttgtaagcttgggaagcccagtcctgactggaagagatgtgttcaagccctgagagcccctgtgggagcgacagcggctaggggcggagctggagcggaaaggctgcaaaccttcaagtctgcttggagctcaggttgggggagtctgctggaggccgtggagatgggggcaggtgatttgtcagaagctccagctttctacctaagggacagacacccgataaagtggactgtgctttggaaaatctaaagcatccacacgtctggtggcagaatcacagtagaatcataaaaggcgtggaactgagtgggcaggcagaggacaggctggtggaggggtgagggatccagtgtggctgcagccctggtgagagctgggagaggtctgctggggctaggcaaatgctggtgggaggactgtggctttggccctcgtgagctgatgcaggcaggctgcaagggctgtgtgctctgatctctgagaaacccacccactgcttttccttgagcagacttcaggtggctcctcccaagcaggtctgaagccaagcatggtggacatagactgggccctgctccatggcatgctcagaggagccgggatggtggctaagtacctacagttcaggaaggcatgcgtgtcctcagtgccaccagatgaaggaaggagctctgcctgtgggagcctggaaaaccacccagcagaggcaacacaggctggaccttgcaggagacagggtttataaagaagggcaggtagtacagactttctgcccaccttccagtggctaagccaagtcacatggctaactgcctgcaagggaggctgggaaatgtagtccctggctgggtggccccttcccagtgacagtttcctactactgaaagggaaggacagatcacttgccatccctgccacacagtttcctcctctggaaactgggggtgatgacccctgccctacccacttgtcatggcattggggacatgaacacactttgcacctgtcaggcaaggcttaaacagggatatgcactggtaatagaaaagagggactaagttttgttttgttttgttttgttttgttttgttttgttttgtttttctgaagaagtccctagaagcgctcagtgttggaatgctctcttgtagcagtggcggctgctgctggttccgggtcagatgccggaattgggggtgcgcttgggtgcagctgcatttcatctggtcctgggcctcggtcctggcttggagaggtgcagctcacagccacttcatggctgggatcccttctgtcccagacagctgaggagacccttggcctcagcctgagtgtcaggggggtagttctgataactctgtgttttgttcacaggagcaaccagggttttatgcacatgaaactggccaaaaccaaagagaaatacgttctgggtcagaacagccctccgttcgacagtgtcccggaagtcatccactactacaccaccagaaagctacccatcaaaggggctgagcacttgtccctcctctatcccgtggctgtgaggaccctgtgagcggaccagacctgccctgctctgtgacagagcctgagacttggaggtgccagaggccccccaccaaccagcccagccactgttgctggctgtgtcgtttgtgttgtgtgtatggtactagcacaccactgcatgtctctagaatgctgttgccacttacgggggctggagaaggcctggataaagacagaagggcggcaacacaccaccccagcccccacccccaccctctccttgagtttctgtgaattaaaatatttgcaaatccaaagagatgccttccaggatgaacaaaggcagaccagctccgaggggcggggtagggtggggcgggagctccctggctgacatctctttgttctccagctgtctcaaattcacacctctgtacagggcaaagttttcccacaggagcccccctactgatgctgggagccaaatgctggtgctttgagagtcccggaggccccggggttcccgccccgctggtgtgtatatgtgtgtctgtgtgagtgtgtgtgtgagtacagatgtgagaaggtggtcacacacagatgggtaagcccactgatctacttgtagtcactcagtgtaatcattaggctatcttcaaggaatcattgtgcagtcaaaaagaggattcaattatttatgaatagggtgtgtaaataaaatagtcatttaatatatagccttatccttttttgatatactgcagagggtctctgagggggcagttctggtttcactcccagagcaaggcgtgtctcctctgggcttgctgctgtggcaggccccagggaggggagggaggccgaggcctcagctccagccctcagcagctctggacacaagagccgtctgctctgacaactgggctgaggcagtcggtagcactctgggagtcaacccagagctcagagttcaggcttcagcagtggacatagtcaggagcctccagtgttgaccaaaaaaccagtctttccctcctgcagtgggacgtctgtgttgacacccccccaacccctggacacagcacccagctggctacaaagggctctctccccactatctgttagcaccacctgggaggtatttggcatgtagggaaagggagacagagaaggaacgtcatttgcccaaagccacacagctcaccagcagcagagcggttctgcagccaatgctctttcgttggttctgcatggccttgctgtcaccctgcccatggaggagggagaatcctgacctcccagggacatagagccctcagtggtccacactgcttccacacacaagaacacctacacacacacacacacacacacacacagccctcagtggtccacactgcttccacacacaagaacacctacacacacacacacacacacacacagccctcagtggtccacactgcttccacacacaagaacacctacacacgcacacgcacacgcgacctctctcttgcttgccatagcagggtcctcccacacaggccaggcagccccgatgaggctaagagtttctcagctctcctgctttttccacccacccagtagcatgaagatgtggctgccctctcctgaatgagatacaagggttccagagccttcgccaggcaccagctggtctgaatgaactagaagtttgacgactgtcatccctggcccacctgggcagagcacaaggggccgagtttgaacgtcatcagcaggttcagacatcagcgctgctcatgtctttagagactgtttggaggtggttccagctcactgttcacatgcagagacacaggcccggagaaggaggactcgccaaggccacgtgtcgagctgggactgagccctgcccctttaggtagctgcgtggacttcagcggtttgtgcaaagccctgcccttggtgacccgcctttagtgaccagtctgcctcttgggtcttcctcccaggccttgtctggcacgtccacgtggcccagccctcatagagaccacgctggctgtggcctgggtttaatctcttaaagaagccaatcctttccttgcctgtttggcatttcctaaaacatccctcaatgagggaggaaggcagggacaccctggaacgattcgtgctttcctttgggggagtgggaaggtaggtgggaaatgacaagatgagtgaggagttggcacttggccaaacagaggagcctggaccc

SEQ ID NO: 15636 - DNA, 46603 bp, Human
ggttctatgccccaatcctgggagaggcgagtccttgcatggttagagaacagggcctcccaaacactagatgagatgatggaaaaattctccatccagggcaggcttttaccatatattttgcctgacagcactgctcagtgattctgactcttatcaatccacagatattggaggtgagcctactctacttgtatattgtaggttgtccaccctctgggcttgccagagccacaggagataatcctactacaggcattgtttactgcagccaatctactgagtcgaggcttctcggtcattaacccaaccccagggagtaactgattagtaccgattttaaaatttaaacctgttcgggagtttcttggaatgctgacctcttacctccgctcccttatacatacgaagtttctgagccacaggagcccaaagctacgttgcattgcccaaaacagggacagaccaaagtggctttttccacttgaaactaaatactaagaatgaagaggtcggctctcgggggtcccggttaagcagtttctctgccaacccacagctgtcacttgtggcttgtctcctggcctcctttcaggtgtcctggcctgaatctgctgttaggacagaaaaaaagtccctggacgggtcatatcctctgtaatctggcaggaaagctaaaatttgcgtgctcccattcctcgttgtgtttgtgtatctgcttccttgttgggaagagcctacatcacagtgtccggtgtaggggattttcaccatgacctcaccctcctgctgccactcgctaattccggcgcggccaagcgtccctgaagtcacatcacagcccaggtggaatgcacgagtgagccattaaatgcccctggtagcacgtctcaagtgaacatcaactccagttctttcccctcacagagagccctggtaggggtctgaaaatgccagaaagagctggaagtgggggtggacgacgtctggttaccgttctgggattcggagactagaaggtcaagggagtcactttaagaaaacacaccaggcctgggcctggtggctctgtctggaatccccgcactgtgggaggccgaggctagaggatcgcttgagctcaggagttcgagaccagcctgggcaacataggggggagcccctgtatctaaaaataaatacaaaaaatttagccgggtatgatggcacacgcctgtactcccagctactcgggaggctgaggcggaaggatggcttgaacctgggaggcggaggttgcagtgagtcgagatcgagccaatgcactccagcctgggcgacagggtgagactccgtctcaaaagagaaaaaataaaatgaaataaagaaaatgcaccaaaggcctgccaggctcacgccggctgttctgttcgaataactttcgagtccgtggcctcgaaatgggtcgggtgggcggtgacagcgggcagcgggcgcgcaacgcgggagaaagggaggctaagtgggagcccaaagaaccgcgtccgggacctggtctccggcctcccggccttggggaaggagcccttctgcccacaagtgggctcaggccatgaaagggaaacagaaagtcgggctccccagcctggcccacgtgaccgcggttcctcagccctccccgcgcgcccggccgcggctgcgggcgcgggcacccgagcgacacatcgagctcgtgactcgccgcccagggcgggaggcggagaagcggccgcggcgtgcgagcgcgcctccgggaggcagcgggagcgcgcacgctccggggccaccgccccctccggggccgggcccgccctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttccccggctgcctgctgacgagtggcgaggccgagcagcaacgcaagtccaaggagatcgacaaatgcctgtctcgggaaaagacctatgtgaagcggctggtgaagatcctgctgctgggcgcgggcgagagcggcaagtccaccttcctgaagcagatgcggatcatccacgggcaggacttcgaccagcgcgcgcgcgaggagttccgccccaccatctacagcaacgtgatcaaaggtgccgggccgggaatgggggccgggggttaagggcaggggggctggggcggcggcgggtgcggggcggggcaccgccctggtccgctgtgtcgctggcgaaggaacgggcccggcgggcgggctggcgggaagggggcgcgccccggcaactggccctgcccgcccggggtgccctcgcgccccagggcgagaggatgctcggggtcgccctgctctcccgcttgtctccccggtgggcgtcacggccattcccccaccccccaccgcgtcctggtctctccccctgcgagagggaagtggggcgagctgggtgctgcctcggggtgtgggcagacctctcctgtcctccccgctgcggatgaggcaggaacaccaacagcagccctagccgcttcacccccatcccctgctcgggcgatgtgggccgaacctcgctaccctggctgggtgacccgagtcacatggggtcgcatgcgctcccaactccctgcttccttggccgtctcctaagcaagcgagttctggaaccgtcgcaataagggaactttttgcccgagacttcttgtcaagggcgtagggtgacagcctccttttgggcgagaatatgaaacttgaggagtgtcaggttgactgtactggaatcaggagagagtggacccatacagttagcatgaaaatgtagcatctgtgctttttcgccccagtgtcacggtcaggtaggatgtttgcgtgtgatttctgtgcaacacgttccactctccttttcgctaagtaactgggggctggcaggaagggagtaccactgcttctatttagatgaaatgtagtagtaagaagactggcctaaaagtcatgtggatcctgtacagatggagacaatgaatgagtgttgagttagataattggctcggctctttattgacagtagttttaaaattaaactttgttcttaagtgaaaaataaacaagttgtttatttctgggcattcaaagaaatcgaaaagatggtttttattttgtcatttgaaagataattaacactcgtttctgcgtgtcaagtatgttctatagaaaaggcattttggcaaaatttaggtgcagcgcctggtaactcaggtgcatctggattttattttatctggggagcagtttaggagtttgctacagattgcaggtctttttaagtgggatttttgttcaggaagtacataagggacttctgcatgtcacccccccgccccctccccgccaaccgcctcccgagcttccagcgtttgggtaaaggaaaactgcctgaagagccaggcattatggagtaatgaattagagagaatcactagaccacagccagctctagccctagtacctctgcagttaaactataaagaacagttgtatttatcctgctgtaatgtttagctcaaaactaattaaggtctctttcaaggctgcagactctgccttgacagtccttaattgaaggtacctttgtaacctgatgcagctgaacttaaggaattatgttaatgaatagcatcaacatgttaactgattgtgagcctggtaaacacctcgttcttaatgtacactgagttgtaagtgtgatctacgttgagcattgattatgagatgatgtaagtcatcaggaatctagttttttcaagttgacatgaaatttgacagtagaacagtttctcaggctgggcgtggtggctcactcctgcaatcccagcactttgggaggccaaagtgggaggatggcttgagcccaggagttccagaccagctgggctacatagccagacctcgtctctattaaaaaacaaaaacaaaaaaaccccacccgtttttcagttattcagatgacttcctaatagccaagtgactgttcagattgatcaaacttaataaaagtaatagatcagtgataggaaaaatgagtttcaactaacctctgtgagttggagtccgactttgtattattttgcagttgatcttcctcccttttagggaaattgaaggccatcctgtaacttaaactggattgaaacttgggctggaagaagtttttaaattttgaatgtgttgctagaagactcaatgttgggttagggtgccgaagcaacaaacagaacatggagctatagtagttggttcttagtgtttcataaatgaacatcttttaggctcataaaaccttggttgtgtctgttttcttctgagcttggacattgttggtctgtgcagcataacttctttttctttcttgagttagattgttttttgactaccttctatcctagaagttattttataaattggaacatgttaaaaatccttcagagagaggaattgtgctaatagtatttgcttttcaaggctctaattttaagacagtgagcaactgttattttttttaacctctgagaagttacatttgttttcgatgttggtcttcatttttgaagaaggtttgtctaggttaattcagaagtataaggaaataatactggaataaaaacttatgataatatgtaatgactcctctccatacattttttttcttctttttaaacaaaggtatgagggtgctggttgatgctcgagagaagcttcatattccctggggagacaactcaaaccaacaacatggagataagatgatgtcgtttgatacccgggcccccatggcagcccaaggaatggtggaaacaagggttttcttacaatatcttcctgctataagagcattatgggcagacagcggcatacagaatgcctatgaccggcgtcgagaatttcaactggtaagagatttgctcttttaaaacgtgtggttttattttaatgatgtttagtaatacaggttgcacatccctaatgcgaaaattcgaaatgttcccaaatctaaaagtatttgagatggaggaacagactgaaaggctaaggcacagacctaatgtgtcctagtctccaatgactacgtgtaaaaatagtgtataaaattacctttaggctacatatcttaaggtatatatgaaacataaatgaatttctagtttagacttgagtcccattcccagcatatctcatatgtatgcagatatttcaaaaatctgaaaaaattcaaaatccaaaacacttctggtcccaggcattcggataagggacactcaacctgtatctgattttagcacacttttttcactgacttccataatttaatgtatctatccaaaattatagcctcagaaatttgtttttttgtttttggggggtttgttttgagacggagtctctgttgcccaggctggagtgcagtggtgtgatcttggcccactgcaacctctgcccccagggttcaagcaactctcctgcctcagcctcctgtgtagctgggtctataggcgcgtgccaccacacctagctaatttttgtctttttagtagaggcagtttcgccatgttggccaggctgatcttgaactcctgacctcaggtaatgtgcccactttgacctcccaaattgctggcattgtgccaggcatttttccccttttttctttaacgagactacccataaaatgctttgtagctgttacacagcattgaagacaggtttggaataaaagtatccaatccaggttaaagatacagaatacagttgaaacaaatttttaatcaagtgttttgtaatttaactgtgaatgctgtgattgggttttatttgccaaagatcagaaagattccagcagtgatagaaatctagactgtgtgcaatttggaggtagttcagatctgaagtgttttactctaatatgattaaaatgaagtgacagttaaaagtaaaactgctggctgggcacggtggctcatgcctgtaatcccagcactttgggagtctgaggcgggtggatcacctgatgtcagaagtttgaaaccagcctggccaacacggtgaaacaccgtctcttctaaaaatacaaaaattagccaggtgtggtggcaggcacctgtaatcccagctactcaggaggctgaggcaggagactcgcttgaactctggaagcggaggctgcggtaagccgagttcgtgccactgcactccagcctgggcaacaagagcagaactccatctccaaaaaaaaaataaataagctgcttaggaagttgtttgatgatgtcaccaacattaatccacattaatgggtgtggctgcaaagcgatgtacaaccagcagtccttgctgttattatttatacttagaagcagtcttgccttttaaaagttccaggaaagtgttcacgatagctttttataaaactgacaccttaattttgactatatctgaattatggcttttatatctgtcattcaactagcatttgattatttaccgtcttgtatagttctcttctatcatgtttgtatcttgtcttttcaagtaatgtgtttatttctgaaaggcagggactgtctcacattattgttaaaattacgtagctgccagtattgcatgttgaaaatgatgaatttaacttgacaaatgacctccatccaattcccagatttctggttagttttgtcccttgatcaatgtttattactttatttttggtagatttgcttgcatgagttcttccatatacccctttccatcgcccatcactctacctcctgttttttgtttttttgcatttttttgagagttttgttcttgttgcccaggctggagtgcagtggcgcgatcttggctcacctccgcctcctgggttcaggcgattctcctgcctcagcctcccaagtagctgagattacaggcatgcgccaccacacctggctaattttgtatttttagtagagacagtgtttctccatgttggtcaagctggtctctaactcctgacctcaggtgatctgcctgccttgccctcccaaagtgctgggattacaggcatgagccactgtgcctggccatctacctcctgtttttaagtgctgcttattctcctttcttcttagttcattttctcaacaaaccacacactttcaactcaattttgtcaggctctattcatccttccaggtcagagaagaaacattcatctgtaataagcatacagtgcatatggattaaatgaataaataaagaactgcatacctgaaagttctctgtggggaagttccgtatttgccctaagtccatttaattaaagttgtgtttcatggacagttttttaatttggaagctgacgtctaactgtctcacatcaggactgtcatgtcctcattgttgagaaagcatccctaagtatatctttgtgattaagaacgaataggtaaaaccactcaggatgaggacctgcttgttgttgacttgagccagttgatccttaaggagcaaagaagtcctcaaagatgaggagagataagttccagaaatacttttttccatgatgaaaagtagagacaagaaaagaggaacagagcaagacctaattttaaacttctggaggacagagattcttttttcctgagtctacgctcagcattgttttttgtttttttgtttttgttttttaagagaaggtctcactgttgcccaggctggagtgccctgttgtgatcatagctcactgtagactcaactcctgggctcaagtgattctccagcttcagtctctcaagtagctaggactacaggtgtgtgccgtcacacccagctaatttaaaaaaaaatttttgtagagacggagtcttgctatgttgccagtgctggtcttggactcctgacctcaagcagtcctcctgccttggcttcccaaaatgttgggattataggcatgaaccactgtgcgtggcttcagcattgttaatagcacctgacacatagagatgctccattattatgttgacttaatgactcttaaactcttggatgtgctgtggtgcttggcatagtgtcaggcactgagaaggcacttggcttacttaaaattttcctcaaagtcatcatcaattccatctactcatctacatgcagcagctccccaagttctgatttttctacctctgtaacgtctcttgcattcattccctcctttcctctattttgtgttctgctacctcttgcttggactccaaggcagtcttgttcaaacacagcattggtttgctcagaaagctttggtggctcaccattgtcttcagaacagagctcagcttttttgtgggagtaaagactctagctagcttacctgtgattccagcaatatatttcattaggccactggacatactctgtaatctcttgattcccacataccctaattttttgcttctatagctctcatcatgcgtagtccctctgccagaattattctttaccctatctgttactaggtcttacccttcacttaatgtagtgataatcacactaaatgtggcccatggaccccatggactggaatgcttgttaaaacaaacaagcagatgctcagactttatacctgaggatctgattctggattctgggatgggacccagtgatctgtgttttcagcaaatagccataggtggtttggatgaatttgctccatgccccctccctttccccaggaacagtgccttaggggctgtgtctctttatttgaagcatctccagtcttcttggctagaatggagatctccatgtcctttgctttccctagcatgcttactcctgtcactcctcacagtacccattatgtgtgttagagtcacagctttcatgtgtggctgtcagtcatgtagaagtcctttggtatgcctagtttgtctttttctctcctactagcatagtgcctgacacttttatttcctcgtttttcagacattcttaattacaaagatgttctaaaaaaataaaatacctgtaatcccagctctttgggaggctgaggcaggcagatcacttgaggtcaggagttggaaaccagcctggctgacatggtgaaaccccatctctaccaaaaaccaaaaccaaaaccaaaaattagccaggcatggtgacatgtacctgtagtcctggctactcaggagactgaggcacgagaatcgcttgaactcaggaggtggaggttgcagtgagtggagatcatgccactgcactccagcttgaacgtcagagtgagaccctgtctcaaaaaaataaaaattaaaaaatatgtaatataatttaattctacattaagttccttctgggaaatatggattatttctataatagtttcctaattttctaggaagtggacagttcttgtgtaattataatttttatttgggggggttgaaatgtgttttgttatgtttagcagcatatttttgaattttggataggaaaggtaaacatcagaagaaatagaggttagcagataaaataactaaaattaaaattaaccttttcgtttcaactaatgatttgattattaaacttattaatgcacattaaaaactgacaggttttaaggccctacatgacttaacattttgcctaagatgaacaactgccctttaatcaattttcgggacaagggatagggtgttgataacacagcttaggtttttagcagactactcatttgttagtaataactttgggtgtaaacatgaatgtttttctttctaagttcccaaaggtaaacatttccttttttggttagttccatcatgggtcagctaaatagcttactgtggaaaagaaaaatacaagattcacattctcgttataacttaaggtacctttctagttattataaattagcatactgaggataatagattgtaagaagtggcctgttttagtactgaattaaatatttgaaatactctactctggctgtacattcaacatagcctgccactgcacttttgagttaccctgtctttagaaaaccttcttatgtgacaatagctagataatttggtaactcagatgaataaagagatgggagtcaggggttggctggatgatacaattggagatatggatgaaaactgacaaaatggctaggagtcatttccaactatttttttttgtttaatttatattcacttattgagaaataaggcaacacttgttacgtaggacaggacagtgtgtgtgacagtgggaggaacatcccacagcttcctactttctgtaaacagtttaacattgtcagcattaatacaacttcctgtaatggccagtctgtctttgcaattcctgaaaccaaagtgtttttgctaatcatggtaccttcagttagacttaattcttttctttttgtgcttgaggttactcttcttgaagccgataagatagtgtattcattaacacagagatttactccctcaatctgtgtaacaaagtaaccatttagctccatgattggcctgtaaaaaggggaggtccaactaagtattctagaaacttcagtttcagctaattttttttatttatttatttgcactgcagcatgtattggaaatataatacaatcaagagtcatttgaagctcctgtagtcccagcttctggggagacaggaggattgcttgacctcaagagttcaagtccaatgtgggcaacatagtgaggacagccccctccctcttaaaaaaaaaaaagaatcagagtcatttattaattaatgctaatttggatttgctttaaatattaaagaattgctactttcagttgtaaaatactatgtttcttttggatgattggtccattttctctataagtatagtcaagcaaggactttgagttgctaaaaacctattggttatcttttgattctaggattagtgttaaatatttcatcccatctaaaataaagattatatataacattagagatagtagaggtttttatcttactttattaatattttttagagacagagtctcactctgttacacaggctggagtgcagtggtgtgatcatagttcactgtaaccttgggactcctgggctcaagtgatcctcctgcttcagcctcctaaagtgctgggattacagtagtgagccacctcacccagccagagatagtagagattttaaagttgagtttaatttccttttgatgaaattgatcagatgtcagagtggttacattttatccaaatcttgtaaacccagagctttatgtttatttacgttaaaaatgaagtttttttctttttaattaatttcttttttaaaatttccgtcagttcctttaagtttacacttatagttttaatacaactttgtgaagtgtgtgtgcatgcacacataggtggtatcacttgtattctattatgttgaaattttcatgttcgcatttttttgggtgaaaacttgactggctgtaggatgtctgggttcttggtgctaaagcttccggaattggaaaatactgtgctgctttctatattaccttttattgctaaacaaagctaggggcacaataatttatgattctctgaaaatgtttattaaacaactaagagatggaacaagtaaatagttttgttatgaaaagtagactttagtttcagaactctttacctagagcgtggacctaacccaggaaaaaggtttgtgagcttactttaaagaaaagcataatggccaaaggactccttggattgaatgttccctgcttatctttcacagatatgcgcagccaaccaagttggggtatccagtcctattagcccaaaacaggtgccagtttctttcttcagaaaattaattcaggctgaggaatgcttgaggccaagaattccagaacggcctggccaacatagcaagatcctgtctctacaaataattttaaaaattagccaagcgcagtggcacgtgcctgtagtcccacctacttgggaggttgagagaaggagattgcttgagcccaggagtttgaggttgcagtgagctatgatagcaccattgcactccagcctggccaacagagtgagatcctgtctcaaaaataaataaaaataaaattaattcatagtattgataattataataattgtttaatttaattataataattgtttaatatcttacgttttataacaacatttgctttgcacttttcaaatccctatcacattcatgatcatatagtgctatatttaaaaaggagaaagaatcctgaagtgtcaggtccacaaaaaagcaaaacaagatatactgttatccgcatttcacagattaaaaaatggagactcagaaagatcccttgagatgcttcagttcacagacctagtaaataataatagaatagacaccgcagtcccaatctgctgactcctagtccacagctctggccaccaaaccattttactagcactcaaacatggcatctgtggagcattcttcttgtctttcattcccaacttcttctgaccaccacccatacatacaaataattaacactcccctattaagttttagcacattattttaagtgcatgtaaggttttatttaagaatgtttggtgttacactgatagtcacgtagttatttttatatcctgaactttcctaatatccttgtaccatttcttctttctttattatagtaacgatataagtgatcttaagcaatgtttaatagtaaatttactaactgtgaatggtacattttatcctaatcactattcagcttggtaaaggttcagtttgaatctttacctccttgaaaactaactgtaatagtgattctcaactgatgtttcatcagtggaaacagtttggtttttttttttttttttttttgagacagagtcttgatctgttgcccaggctggagtgcctgatcccagctcattgcatcttccacttcccaggttcaagccctgacccagcctcccaagttattgggactacaagcgtgcaccgccatacccagctaatttttgtatttttagtagagatggggtttcaccatgttggccaggctggtctcgaactcctgacctcaggtaatctgcatgtcttagcctcccaaagtgctgggatgacaggtgtgagccgccatgcctggctgaacacagtttttaatgtattctgaaaaatagaagtttaatggcaaccagttagctgaaagagattgccaacatttttctaggacagtgccatctttagtgcctgtcttctatgtaattggtcagatttgcttttgttttagagaaggggacaccagaacactttttcttttcttttctttttttttttttttttgagatggagtctcactttgttgcccacgctagagtgcagtggcgtgatcttggctcactgaaacctccacctcccaggctcagccagttctcctgcctcagcctcccgagtacctgggattacaggtatgggccaccatgcctggctaatttttgtatttttagtagagacagggtttcaccatgttggccgggctcgtcttgaactcttgacctcaagtgatctgtccgccttagcctcccaaaatgttgggattacaggcgtgagcccggcctattgttaactttttatgaactcctttgaaatgcttctcatgtaatcatgtcacagttttcatactgcctgtgagcactcgagattgcaatttctcacaaagttttttcttttttttttttccttttttttaagagatggggtttttgctgggttgcccaggctggtcttgaattcctgggttcgattaattctcccaccttggcctcccaaagtgctgggactacaggcgtgagccaccaccgtgcctggcttgtcacaaatttttttccagttaaaagtgacctaattttttttaagtgtgtatttctggaaatgagaagtgatttttatttccctgcttgaaagtatttcgtttttccctagctatatactattcacctttgtctatattgtgaacctatcttgtttacaagatgccttttattcaaaagaacttgttatagccacattagcagagcagtattagaatgagctgatatgaatcaagaaaatagttttgttttgagaactgaactttagtgcacttggccaaagtaccaatctgttgcgttgatggtagctatttatcttaatcttccaaatataatcactcttcctttggcaaaatgaactgaaagtattttttcttttttttactttttgagacagggtcttgctctgttcccgaggccaatgtgcagtggcacagtcatggcttactgtatgtagccttgacctccccagctcaagcaaccttcccacctcaatctcccgagtagctgagattactggctcatactaccacacccggctagtttttttgttattttcagaaatgaggtctcactgtgttgaccagggtggccttgaactcttggcctcaaatgattctcccatcttggcctcctacagtgctgggatttcaggcgtgaccactgtgcccagcctcgaaaggatttttaaatccatgcggtgggtaaactttttcatccccatctactctgcagtagatccagaatactttagtggaactcttcgttgatttttgttttttttgttcttgttttcattttttatcagtcctggcctacagatatttttgttttttaatctaaatagtaaaatctgtgtgcttggttgtgctatctgtgactttttaaaagcttttatcttccatacaaattaaaataaaccacattcagtccaagcgcagtggctcacacctgtaacctcagcactttggaaggctgaggtgagcagattgcttgagtccaggagtttgagaccagcctgggcaacatgctaaaagcctgcctctacagaatacgcaaaaattagttgagcatggtggcgcacacctgtggtcccagctactcgggggtctgaaacaagaggactgcttgaccctgggaggcagagttgcagtgacctgagattgcaccactgcactccagcctgggagacagagcaagaccttgtctcaaaaaaaaaaaaaattaataaacatgttcaaacttaatgattgtatatattgcaaaacatttttacatttggtttcatgtgatggccttaagattggatttggttttgtgccatgctgtgggataaagtggagtaaggcagcagccagagttcgtcttccggctgccactcgctgtgtgagctcaggcaagtccttcggcctctgaatttctagttctgcaactgtaaaatgagaatgatctattattagggacctactgttactattgtgacgaggacatgagataacccatgtaaagccccacagtacctgacttgtattaaccatattattaatattagttattaatattcctaatgggctttatgcacctaagtagctgcatagaaaaataaagcagtataaactttgatttgatttactctctaaacctcattaccaacataaaaaattctgaataatgtagaatatattacttgtgttttcttattagactgtatgttgtctctaggaccacatgttgaagagagatttgaagttttccttgttacattagttctttttttttgagatggagtctcgctctgttgcccaggctggagtgcagtggcgcggtcttggctcactgcagcctccctctcccgggttcaagtgattctccttccttggcctcccaagtagctgggactacaggcccgcaccaccatgcccggctaatttttgtatttttggtagagatggggtttcaccgtgttggccatgctggtctgaaacttctgacctcaattgatccgcccacctcagcctcccaaagtgttgggattataggcttgagccaccgtgcccagccaccgtgttacattcgttcttgttgcctagtgataccgctttgcttgatttttagatcaaaaacttatgatgtggttcttctttttttttttttttttgagacggagtttcactcttgttacccaggctggagtgcaatggctgatctcagctcatggcaacctctgcctcccgggttcaagcaattctcctgcctcaggctcccgagtagctgggattacatgcatgtgccaccacacctggctaattttgtatttttagtagagacaaggtttctccattttggtcaggctggccttgaactcctgacctcaggtgacccacctgccttgacctccctaagtgcggggattacaggtgtgagccaccgcggctggctggttcttcattttttcacagtacctttttaaacaagtgaaaacattttacaaacaatgggtctatatttttatggctagtccttgtgtgtctttgtaaatgtaaaaacttacaactctaaagaatcaaatgtcatttgaaaataatagagtgttatatagatggttggtgaaactaaccagtattgatccttctcatcacgatgacatttgtagccagaattatttgattgtttggagaatgtgttcctgaaatgcctcagatgtaccagagtgagacaagtcatttatcttcctgctggaggcatggggagataacctctggctcaggtgcagagtgctcaccactcccactgaatgtgctgctttcatcccctcttccttcacctttgtctctgaggtgctccccacaccccttccacgtgcacacacagacgtactctttccctttctgtcatttctctgccctgtgacttagcagaggcgttgagagtacttagttaaagagggtgttagagcttcatttccaaggtaaaaaaattcatatgttcacaaaatacatatatatttttttttttagattccatgttttttgtgagatcttaaaacttctgactattttgtataaaaaccaactaaaaagtctagagaatatctactttttctcatggagcaaaattagcaaatttcaaatttgctcccctcaaagaagaaagtattgattttagcatttaaaaacaaaactcttctataccacctcactctccccaaaaaacataaaacaatgtcattgggttctttgagccaaggcagctatatttagcttgtaaataggccatttcttttctctttaaactcttttggaaaggttaaagaaaaagagctggaataatgaataattggggcaagagactttcactttccttttcaacatcttggttactgttttcttagtctctttttaaaaaattatttttctgctaaataggatgaattggctcagaagttatatagaaaatcagatatatcatcatgtgatttttatttaagcatcatgatgtgaaatgtggttgtatcttttcattgatattaaataaaagaaacatttatggaagctactagcaatgagcagctgtcccagaatttccatgttgctagagagttgctcacaagttattgcctggccaactgctacagtaagcctaacacatgagagaatgtacgggggtatactttagacagataaagttgctattcaactaacgggtttttaaaaacctaaattattggctgggcagagtggctcatggctgtaatcccagcactttgggagtccaaggcaggcagatcacaaggtcaggaaagcgagaccatcctggcgaagatggtgaaacccgtctctactaaaaatacaaaaattagctgggcgtggtggcgggcacctgtaatcccagctacttgggaggctgaggcttgaaccagggagttggaggttgcggtgagccaaggtcatgccacggcactccagcctggtgacagagcaagactccgtctcaaaaaaaacaaaacctaaataatactgtatgttcacaaagttgcaaataccgtttatcctaattgcaaattttaaaaagaaaatgtgatttatccaattcagttaaaaatattataatacaaatgatttgctatttttaactgttaccagcttgccacatttactgttaaactatttgccacagcttcaaacatggtagggactttaaactgttgccataaagataatatacatttcaactctagactagaacaaggagaattatacttgcttccattttttctggacttttccaattatggtatgttatgattaaatgttgcaaccaattttaaagttggtgttttgtttaatagtttagtaagagaaccaaggttccccttgttgtacagtattttgcacagttggccttactgtgtcttttttttttgaaaaagtattttattaaaaagcttcattctatagaaatactttttctggtaagaatatgttcatgtgatatttgtatatgtaattatattttattctatatgaaaagtaactagcgaatgcaaaaagtgatgaggagacaagaaagccctaggtagtggattacaggaaatgtgttattctgaaacaggtctggtaacagttcactggtagctttcagcagccatgcagtcacgtgttactgaacacctattaatgagtcagttacctttttgtgggttaggtgtttgctagtgaaccaagtgaaagtaatctctgcgttgacgttagatgctagtcagagtaatctacatgaaatatgcaaacaaatatgtaattacacatgtggtaaatgctgcgaaggaagagaaacaatgagagaccaagaggatggtctgaggaggcaacatttaggttcagatcccatggatgagaaagtcctccaggaaaggagggggaagaatgctccaggcagaatgagcaccatgtgcaaagttggaaaaaaacttactgctggtcagaaaacgtgatccaggccagggtggaggagtgagtgagggagaactgaggtggaagaggcaggcagcagcctgtgactgccaggccttgtagcccatgttgagaagtttggggtttctctgactgccttgggaagccaccaaaggattttaagcaagatcactcaggctgctgtgtggaagttagaggggagtgagggagagcctttgcaccagatactgttcttcgtcctaaccagttccagagtttggagactattgcagagcaagcagcttgtcgtcagttggtggctgtagagataagagaagaaaatggattcaggatatactttgtagggaaaatcattgggatctgctagattggatgtggggtagggaagaaaggcatatattaagagtgattcaagtttctggctttatcaactaggtggatattggtgctatttactcaaatcacaggatcatgggagaatgatatttgagggggatgattaagagtttagtttgggcatacagacagtccctggtttactgtggtttgacttaacgatttttttactttatggtggtgtaaatgcaatacacatttagtagaaactgtacttcaggtacccatatagccgttatgtttttcactttcagtatggtattcagtaaacgttgtgagatattcaacactttattataaaataagctttgtgctagatgattttgcccaactatcaactgatgtaagtgttccaagcatgtttaagggaggctaggctaagctgtgatgcttggtgggttagatgtattaaatgtatttttgggcggggcacggtggctcacgcctgtaatcccaacacattgggaggccaaggtgggcggattgcttgaactcaagagctcgagaccagcctcgccaacatggtgagaaacgcccccccgcaaccccgtctctactaaaaatacagaaaaatagttgggtacgatggtgtatgcctgtggtcccagctactcagagctgaggtgggagcatcccttgagcccaggaggttgaggctgcagtgagccgtgattatgccactgtactcaagcctgagtgacaaagcaagaccctgtctctaaaaataaatggtttttttttttttttgagatggtgtcttgctctgttgcccaggctagagtgcagtggtgcaatcttggctcactgcaacctccgcctccgagcttcaagcgattctcctacctcagcttcccaagtagctgagattacaggcacgtgccaccaggcccggtgaatttttgtatttttagtagagacagggtttcatcatattggccaggctggtctcgaactcctgaccttgtgatctgtctgcctcggcctcccaaagtgctgggattacaggcatgagccactgcacccggccataaatgtgtttttgacttaacgatattttcatcttaagtgatgggtttgttgaggcataaccctgttggaagtcaacgagcttaagtactaggttgagatctctgtgagatgtatgggtggagataccaggttgacagcttgatacatgagtcttgaatccagaacagtttggggctagagatagaaattgaggaggtgtttgtatctaggagatatttaatgtctgtgaaataattactgagtataatttttctgatatgattactcggggaaagggtgtaaaaagaagagatgaaggctcacggtagagtctttttgtcttttttttttttttttttttttccatttttgtagaggctgggtctctctccatgttgcctaggctggtctcgaactcctgggctcaagcagtctgcctctctcggcctcccaatgtgttgggattgcaggtgtgagccactgtgctcagtctgacagtagagtcttgagaaatctctacatcttttgagaatgttcagaggaggggatcctagcagaagtggccagaaaggtaggagaaatgtaggcacatgtcacgtcatggaagccaggaaagtgtttcaagaagaaaaaagtggtcagtggtgtcctgtgccattgagaggtctaggaagaattctaggaagaatcgatgttggcacaggaaagttggatatgctgactatggcagcaggtgccctggtgagggagaggccagcctagaagggcttaagaggagagagaggcgaggaagtggagaagattcagttgaagtcaagctcactgttctcttttcccttttacagtactttcaaccctctggcttagtaagttgtggtttttctgacctttttaaagtttgagaggacattttatttatattaaccaatttatttgaatttcagtctcagaagtattaaatattagttcataagattgttaatctgctgggtcaggcaaatacagaagagtttttcactttattcttgattattttacttatgatcatttccaatttagttggggtaataacctgatcagttatatacattgcactcattcattcttcagcaaacatgtactgaatacctgcccctagtatgttcttggcccagactaggccctagcaacccaagtgaactgcctgtctggctgccttaatgggggctcccaatctagtggggagcaaatgaaatgatcagtgcgatcatttactgcactagcagctgttctgccaagagtgtgcagaatcactctttattaacctagaaatgacctgagagagcatgtagtcgagttctggtcattttgtaagtaaagcatatggccacagaggtgaaggacacatagaggctaaggtcacagctagttttatttatttatatatttatttatttgggacatagtctcactctttcacccaggctggagtgcagtggcacgatgtaggctcactccaacctctgtcttgcagattcaagcgattcttatgcctcaccttcctgagtagctgggactacaggcacgcaccacaacacccacctaatttttgtagttttaatagagacagggttttgccatgttggccaggctgatctcaaactcctggcctcaagcaattcacccaccttggtctcccaaagtgctgggattacaggcgtgagccaccgtgcctggcccagctagttttagtgatagagccaagattcagactccgggttgtaggattccaaagcccgaggctgatactcagctgccttgctttattgcttccttagtaacaaaattgaccaaatcgggacttggaaacaggagctgatgtgccagcatacattttgagctaattttcacattcatcagcttttgaaaatatttacaggttggcttgctttgctgcctgactgtgaaggatgggaaagtatttagtgctccttataggctgtgtggaaattttcttctggagagagtttggttgggataatgattgagctctaaactgggaataaagtcatctgggttttcctttcacctgttttgtgatcataggcgtagaattaccttattaattagtgttgattattgtgtaatatttgagttatagggtattttttagcacatcatcacagcagaattttccacctggagtgcgttcacgaggacttcggggtattatgaagcgctctaataggcgcctctctttagatagtggaggaattgaaactgtatttgggaagtatgtcctgcgttggaaaacagcatatactttttttctttttaacaattgaagtcgttgctttttgggaatccaaaaaaaaaaaaaattaacaacgaagggttctagttctgacaaagctaaatatttcttgatatgctgatgggattatatatgattggcccttttcaaaaaagtattttaaccttgagggatttttcaaggctcagaattcttaagctttctgttgttatcattatgtgaaaactgaagagtaggaaagtggtttgtctgttcatgacttacaggctccagaaccttaattagcttgttttttttaagtttaaaattttaaaacatacatggttcattgtaaaatatcatccagttagccactatcctaccacctcaggacatctctgctgacattttggtgtatttccttccagtatttgaatacgatattggatgttgagataagcttgtttgtactttctgtacaactttatatcctgttcatttaatgttgcatcatgagcatttcctggaggaggtgattttctcagaggagcagcaaggcattttttagaaatagatgtgtattttttatttaaatggaaaattcttcccgctatatatgtatttttttagccaacagaagatagtggtgctaaatggtaacatggaacaaatatggggtaaatattaccatgttgctacctgatcagcaatatatatgatgtcagagctgacccatctctgcagtattaaactcctttctcacatttaaaatttgtacttaattttgttaagtaccgtggctcatgcctgtaatcccaacactttgggaggccaaggcgggtggatcacctgaggtcgggcgttcaagaccagcctgacaaacatggagaaactccatctctactaaaaatacaaaattagccaggcgtggtgttacatgcctgtaatcccaggtgctcaggaggctgaggcaggagaatcgcttgaaccagggaggcggaggtttcagtgagctgagatcgtgccattgcactccagcctgggcaacaagagcaaaactccatctcaaaaaaataaaataaaataaatactaaacatatggctaaaacttttttctctgtttctccacgatgaagcattttagtaaggtcctttttttgtgacttctgtagtaggagaattactaaactgcgttgtacattttgtgttaacatttgataggactacggaaatactcctagaacacttggatcattaagattattagccttgggccaggcacggtggctcacacctttaatcccagcactttgggaggccgaggcaggtggatcacaaggtcaggagatcgagaccatcctggctaacagggtgaaaccccgtctctactaaaaatacaaaaaattagctgggcgtggtggcgggtgtctgtagtcccagctactcgggaggctgaggcaggaaaagacttcatctcaaaaaaaaaaaaaaattattagccttaaattattttggtgataaggccaacacaaaaacttgatataaagaggaatttattaatttgtgagcagcaacaagaaaaaggcaatttctagaataatgtaataagttctttccaaaaaagctcttatttcatgtgcagtagtttatttttgtagcttatatgctagaaaacattgaaataacttatctaagtgagataaaggtagtattctacttatgctattatagactgtcttacattggtctggaaagatacttagtttgaaaaagaaattttcaaatattgaaatggtttatgatgtaactgactaattttggttcttttggattttttttttttttttttttttttttgagacggagtcctgctctgttgcccaggctggagtgtagcagggtgatcttggctcactgcaacctccgcctcctgagttcaagtgattctcctgcctcagcctctcgagtagctgggactacaggcgcccactaccacacccagctaatttttgtatttttagtagagacagggtttcaccatattggccaggctggtctcaaactcctgaccttgtgatccgcccacctcggcctcccaaagtgttgggatcacaggtgtgagccaccaagcccggcctcttttgaaaattttaactgatgtacatagaaattgctggcaagaaatttggaactgtgtattcacttggagtctgcttaatttttatgtatctacacagcaaaggaaaatggcttgtcggctataagttttgttcctcatgaactgaacattttactcctcctgaactaaacagaaaggcatgactggtggtactttgagtatgctgtaatttttttaattttttttttttaattattttttttaaaggcagggtctcattttgtcacccaggctggagtgcagtggtgcaatcatagctcactatggccttgcacatctgggctcaggcaatccttctgcttcagcctcctagtagctggactacaggtctaccacacacccacacccagctgatttcttcttttttttttagagatggggtcttgctttgttgcccaggctggtctcgaactcctgggctcaaacgatcctcccaccttggcctcccaaagcattgggattacaggtgtcagccagtgtgtccagcctaactatgctctaatgataacaatgacagtattaccctcattgaaaacatatcctatacatcacatcaagtactgtgatttttttttttttttaaatggagtctcgctctgttgcccaggctagagtacagtggcacgatcttggctcactgcaacctctgcctcctggtttcaagcaattctcctgcctcagcctcctgagtagctgggattacaggtgccagccaccacgcccggctaatttttgcattttgagtagagacggggtttcaccaagttggccgggctagtgtagaactcctgacctcaggtgatccacccatctcagcctcccaaagtgctgggattacagacatgagccgccgcacccagcctaatactgtgttttttttccagagaaaaatgaagtcatagagaaagccatggggcagaaaaggcaatatcaaagataaagaccaatagaataggtcccgtgtgacaaccaagcaaaatgaaaatgttggaaaggcattaaataaaagaagtgaaactggtccatggtaagctctgagaaccaggaggagagttttgtatgctgtatgtaaagccagcctttggactgggaagaccttctcaagtcattctttatcacacttaatttgaaataaaaattaaagggagaaagacctaggataagaggtagtatatttcaaatgtttgaaataggatggttccaagattttttaactttaaaatcattttcaaagctgtgaataaacttaaaatgtaatcaggcctggttttgtatttactgtctttaaggaattgcatgtaatagatttcagatagtgtgggcagaacaatctcatggtatatttcatatttttatgttaatatgtggagagacgagagagaaaggacagatagggtgggaaattgagtgtaagtactaataaatattaccttctgtctttttactagccatatcctcgggttgaatcgaaaagtcttggttgattaaccagccttaaccccagagttttccattttgtatctatttatgtttggcatttaattgttgctgaaaactttatgtaagtacatgctagatggaatggcttctgaatagacttcattataagcctactgttacaatgaacagctccttatttatatatgactttatcaagatgtttccaggactgaaattattagtgtatacatatgcgaattattgataaaagcctatatctaggtctcttttatacacacacacacacacacacacacacacacacacactctctctctctctctctctctctctctctctttctctctctctctctctctctctctctatgttgtccgggttggtgtagaactcctgggctcaatagtaccccctacctcacctcagcctcctgagtagctggaattagaggcatgcaccaccatgcccaactcttaggtctcttttaaaagcaagttaataagtttgctattgaatagctttccccaagcatatgcttaatgagtcctgcctaataaatatttagaaaacattttgacctggatttgttttgggattataacactgatggaaattaaaagtatattataggtatataaaaaccttacgataataaaagtaactcacagttgtgattaagtatgaataaacttagatttccagttttctctgatatcacttgattctttttcctctttgaaatgttccaaacttgcacaacaaaggacttatatatgcatgggaagtgtgtaaaccatttaaaccattgggcttagctattttagaacacagacatttacagtcgtgtgccaggaagatgttttggtcaaggactgactgcatataaaatggcggccctgtaagatgataagggagctgccctatacaggtgtagcatttttaaaatcttttgtagtatatctttactgtacctttcctatgtttagatacacgaatacttaccattgtattacagctgcctaccctattcagtacagtaacgtgctgtacagctttgtagcctagaagcaataggccatgccatatagccgaggtatgtagtaggctgtgtatgctagtaattaagatgttctgctctttatagcacttggttggttctctataaagaaaaactggatattaactttgaattatactttcatttttggaatcacatgtatacttaggtttcagaagaaactctacttaattatcttggtaatatagattttcttttactttcaatattttttgagttgtttacttttaaaagacacttgcaggtgatgttagcctcataactaaagagatctcaacacataaaaattgggtacttttttaaaaaattgagatggggtcttgctatgttgcccaggctggtcttgaactcctgggctcaaaaagtcctctgatcttggcctcccaaagtgctgagattacaagcatgagcagccatgcccaaccaaaattggaaactttttaattcactttattttgtcctttatagttggcttgtttttttcaaagtgaaatttctgccatttacgtacattcttaattggcctgcaattaaattctggacattttacaagattaagcagtgatgttttattttagtagcaaacaaacttttgaatagcctacttgagtgtgatagtcttctgaccttcattatagtctataaaatccagtaaaatgaagttaattacatgtgtgatgcatattattacctaacattctcattatcagaatttgacctttgtcagatttccggtattaatcattagaacatatactatctatgacaaaaacaaacctttcaaattctgcatgatctgtgattcttcaccagcatctggagatctagtcttggagtagttaatagccctgcttggtcattactttgaatttggatctgctgaaacttcaggattataaatattctgaaagtttctaaatctgctcagagaaaaagcagttaggaagatttgtcatcatctttgctccttccaaattctatctttatattattctcttcgaactaccaggatactttatcacttttatgggatgtctttttgattgatgttaacactgagtggttacttacatggagtaggagcttcccattttgtcttagcatcttcccgtaccactgcctacagtgctcttcaaagcattcagacttactgaaaagagtcacgcactttatgccactgaagatctttgccatgtacatttgagttgatctcttttctgtctttagcatttacatttataaacaagtggaatttagtggcagaaagttgcctttaaaaaaaaaaaccttcccgttcaatgtattatgcttgtgacaactctgacatttgtagaaataataagatggaaacaggatgtcataaaggggaagttataatacaaaaaattcaacagatgtttatgtagctattgctctgtacagggtaaaattgctatcctaggatacagggaggtgtagcaaagagattttgagtctaaatttgacatgtaggactacatataaaaataaagaagtgccatgagtggtataaaccgtaagtgcaaaagatattgagtgaagagtatgattaccgagagttgggaagttgcagtggaggtaggggaaaaataagaatcaggatacattaaattcttggttctgccactgaaacagttttgttggctaagccacctaacttccctgacccttaggcttctcatctgtaaaatggagcataaggttacttgttctccaagctgtcttccaacttaaaatttatctttgctccctgtataatagtaagaaccccagaaggagaggtggaagcagaggcgtgtgggggaaatggtgttaggcagaggaggtaggaatatgcacagaattttccagaagcatggggagatgagcatggagcttgtttcatagggaaaagtaggagataatgttggagatagtcagttgggactagctggagacttcaaacacgagacatgctaactgcatagctaattcagcattttatcagatactattatatttctcctgttttaggtagttcttggtaaatactttttgactcagcagcacaactgaacagtatccttgatccttcagtgttcaccaagtttttcccaacatccttatgtttctcattcaggtgaacttctcagtattatatcagtaactctgcctcctttttttttctttttctttttctttttgtttctacctcctttttaagaaacaaaatccatagtattcctctttaaggaaactgtcacctacttggggaaggctagattctagagactgcatgtagaggctgtagctctctggaaggtgtgtaggtgggggaagtggaggctgcagattggaagaagaaggtggtgtggagctgaagagtaaagtagggaggcaggaattagagatagtttgatctgtattccttgactttcatctttcttggtgacctgaaagttgcttaaggttgtggcgctatcatcctagtgttgaggccaagacaagtgatctgcagtcatacctctcatgacacatgaaacagtcttcttaggctcaagtatttcatgaaatgccctaagtaccagtgagctaattacaagaggcaactgctaccatttaggaaaattataattacagtggttcttgcaagtagatgatgagcaaccttaagaatcacctgtgaagtgggttttttttttccactttcttccttatatggtaggtggtattttttttttttttttttttggagacagcctcactctgtcgctcaggttggagtgcagtggcgtgatctcaactcactgcaacctctgcctcccggattcaagcagttctcctgcctcaacctccctcccaagtagctgagactacaggagcccatcactatgcccgcctaatgtttgtacttttgttttgttttgttttttgagacggagtctcgctctgtcacccaggctggagtgcagtgacgcgatctcagctcactgcaagctccgcctcccgggttcacgccattctcctgcttcagcctcccgagtagctgggactacaggcacccgccaccgcgcccggctgattttttgtatttttagtagagacggggtttcaccgtgagctcgatctcctgacctcgtgatccgcccacctcggcctcccagagtactgggattacaggcgtgagccaccgtgcccagcctaatgtttgtacttttagtagatgggatttcaccatgttggccagactggtcttaaactcctggcctcaagtaatctgcccaccttgacctctcaaagtgctgggattacaggcatgagccaccacgcccagccttgttttcttaactgatagaagttttgaatatttggttttgttttggcctctcccatcattcttaggaaagccttttgttgtaaaggagaaattagcatgtcagtgttcctagtttcaaagagagtccaattctgtgatactcacttttttcaaacatatatattatttaacactatatgcaaatatttagagggatacagtgactaagaaggcaaaaactgtccccaggaacaatacattgtagaaaaggaaataaaacaagtacacagatgattgcatatgaggtagaaaatgactcatgccataggaggtgctgataaaaccactatggaaatttaagcaaaaggttttcttagatttttaaagggcccccagtggctgcttgtggtggtacgcctgtaatcccagctacttggaaggctgaggcaggaggactgcttgagcctaggaatttgagaccagcctgggaaacatagtgaaaacctatctctttaaaaaaaaaaaaaaggcgggggaggggtgtgaggtgggaatttggctttactatataaataaatctggatgatttgagaaagacaggtgcactttggatttctgaggcaagagaaaggacacaaaagtgctagtgttaagatcagaattgtagaaaaattattaggaagtcagtaaactagattttcataaaatggtttctttccttctgcttcagaaagtagtgagccttaagaatatgctgggaaaagaggccgggcgcggtggctcacgcctgtaatcccagcattttgggaggccaaggtgggcggatcacctgaggccgggagttcgagaccagcctgaccaacatagagaaaccctgtctccactaaaaatacaaaattaactggtcatggtggctcatgcttgtaatcccagctacttggaaggctgaggcagaagaatcgcttgaacctgggaggcggaggttgtggtgagccaggatcctgccattgcaccccagcctgggcaacaagagcgaaactccgtctcaaaacaaacaaacaaacaaacaaaaaattgaatgtgcttggaaaaggttcatgtatatgtctttataaccactgttacattttgatgagtttccttgtaatctcattttctatgcaattttcttaaaagggggttcatactatattagatcttgaatgatctagaagttctgtattttaatgaaccccctctgcttcatattttttgatgaatttgtgattctttagtgtaagattcatttggcaaaaaattatttctttaattatacttactttggaaacggctttattttacagcctatataaacttggcttatgatttgtgaaaatgagtactgttttgtttttgtttttaatggaaagtcttacatctaagccatagagtattttctagtcatggcttcctgatataactatagatcatcattccctttggggatcagatgataaagtgataaattgtatttgtcaattatgttggtattgggactctgacctgactcagagggatagtgtagtcttgatttgaaggatttgaggtttgtttaagggttggatgtgatttttgtgttgtcttatggttttttttttttattttggtggagagtagtgatttggtcttattttgggagtataaaatatagaaaattgtatagtttttgggtttttagtgatgattaactaatatataaaatcatagtaatgtttggcagagtaggcctctcattttaactctgaaaattaaaaccttatacattacttataattttttttgttgtgtcttatctgctgttttcatcatagtgcagtttttttacctgtttaccacgtaaaacgatggagagtgctgctgcttagtcgtggctcactgcagtcttgaactcctaggctcaagtgatcctcccacctcagcctcccaaatagctgggaccacaggcgtgcaccaccacacccggctaatttttttttttttttttttgtagagatgggatctctctatgtgttctaggctgggtctcgaactcctgggctcaggcgatccttgctctttagcctcccaaagtgctgggattacaggcattgagccactgaacctggccagggagtgctgcctattaagcatttttaattgcttatttacctatcatgcaatgtttaggtgtctattatagaagcaaattaattttgtaagtttaattgaggtttcaagttccttagagtcctattgctaaaatataagtagcacttaacgataacttttcccatccgcgcttctcagcacgttcagtaatgttacatctggagtatcaggtccattaatttttaaccacaaaatctgagttagcttgaaagctgtggactatggtgaacatttgaaaataggctctaggggtatagacaagtaggcagctagaactgtagtacagtaggaaataaagcttgtcagaattgtcaaataagtttttttaaaagaggaagctatatatagacttaattttattgtttatgattcagatatcccaaaagaaggcctgatagtttcttgtgagacgtggtgaattatgaagaatgcaaatactgcttgaaatccacttttacagctgggtgtagtggctcatgcttgtaatcccagcactcccggaggccgaagtgggtgggttgcttgagtccaggagttcgagaccaccctgggcaacatagtgaaaccccatctctactaaaaatacaaacaattagccaggcatggtagcaagtgcctgtaatcccacctacgctggaggctgaagtgggagaatcacctgagcccgggtggtcaaggctacagtgagcctcgacagtggctacattgtgccactgtactccagcctggataaccagagttgagaccctatctcaagaaaacaaaaaacaagcccacttgtacagtaagataaaactaaactaaatttcttatcttggcatttttagactttaaaaacagattttgtgtaattgatcctaaaagatgaaattaatacgaaatctagttttgagtaaaatatatatccagatttgaagtaatgcgagggctggctacatcagaatcacttctctcggaacttgctaagattttgattgggtggatttgtttggagacctgggaatctgtatttttaataagcacattaggtaattctgatagattaccaggattaagtatcattggtctagaaatgtgtaaagggtcagatagtataatattttaggcactgcgtgccaagggaagaaatcaagggcattatgtaggtatttatataaaaagttttattgatgagattaaaaatataaacttgtgtgcaagtttttgtggctacgaatgtgaaaaaaattggattcttttggaataacattttgtttattgggattcaatgttttagcatttttttgtcagagtcagttgcaaatattcctccattctgatctgtaatgagattttacacatttcatccttgaaaatatattttcacacagatactaccaaatgagcatatgattttttattttttggagaaggtcttgctctgtcgcccaggctggagtgcagtgccatgatcacagctcattgcagcctcaacccccgggctcaggtgatgatcctacctcaccctccctagtagttgggactacaggcacatgccaccacacccagctaattttttaactttttgtagagatgagtctcagtatgttgcctaggtgggttttaaactcctgggctcaagcaatcctcccgctttggcgtcctcccaaagtgctgggattacagtgtgagccaccgtgccagccatagcatatgatttttattgagcatagtcagtgcttgagagatacttacagaatcctgttagattcttctcagtgtttgcctcttagcatgtcattacattgcagattaaccacttgaaggttaggtagaagctcttcatttgcgtagttaaatggattttgaaatatggaaatttcctttgcacttacataggggtctgaaagatgctgttggaactgtagttagagtttagaaatattatgtccactggaaatttgtatgggaatggaagtctcactttttgttttaacttttgacagcaaagaaagtatataaagcagtttgacattgttttgattaaaactatgctagctgtcgaaatgactttaccagagtgtaagtttcaccaacagtgccgttttgccttgtaattttaggttgaattcattcagaaatcaaatcaagtctgccctaaggctaatttccgaaaccattcagcgttcaacaatagtggttaagggtagttcttgttcaggaaaagaaatcagttccatccctgtgctcagaaaaaagtcagtaaaactttagcgctgctaagacatcgaactgtgtcagaattttcactttttgtttctgacagaaactcatgacctgctgatggtcaggttcacaggagcgtgttaaattcatcactgacattactcgttcatgagcacaatagattcatgtgtttcccacaaggtacatgctcatgagtaatgcagtgagtaacccttacacaggttttgcatgtttgaccccctttctgttccacgcatttttaccaccatcagttgtaacacagcctagcatattccagtttaggctgtactcatttagcgttttctcagcttctctgaaaatactctcacacgtagctcttccacatggactgttcatacaggctggttcttcagtcacttcaaacttggcattgattccctaagtaaacaacaactgagcattgtggtaataaactcagcaagagccagggaaaaccactgaaataatttgccatgtttcttaattgacagttgatggttgttccgagtgtcctcaactctgagcaactgctctcactgaaaggctaatagtcttaaacaaggttactttctctggccatatttcttcagctgttacaatcaaacatgagttactcactcacttggtaaatggcattccttgcttgtctaacaaaaactttgaaaacttgaaaatactttggttgcagtctcatttcattttttgttttggtgaagaaattctgcagtgataagctattccattttaaaattttgcatgtgttttgtttttgttttatgaccgttgcttttctgtgggttgggaggattgaagaaagcttagtctgtaaatgttggcatacattgtattcttctagcatagctatagtgtcattgcataataaataatgctttaccatggaatttgatagcaaaattatttacatcctactgtgccttaaaagtgtggtattcagggccttctttttatttggatggatgtgtatttactcccttttttttttttttaatgtcatggtgtggcaatactggtgacacttggaatattttcaagttataactgtgtcactgcagtttgtggtgcaccaagcagtggtgcagagtcatgagagtgcaacacactgcctcagtctccactcctcacctctgctgttgtagcctggaagttcccatagacgatacaccaacaggtgagcgtggctgtgttccagtgcatttttatttatggatgttgaagttcgaatttcatatcatttttacatatcatgaaatagtcttttaagttttttccccaaccatttaaaaatgagccgtacaaaaacaggcattgggttggatttggccttcaggctatatagtttgtggacagacccctggtccagaatctagttaaatataaggagcaatccatttgctctcaaccagctcttccttctgccataatagtaattcactagcactgttgtagttgtatatactttttcagtggtactgtgttgaggatcatttgaaagatcttaatacatattgccaaattgctttctagaatatgtttaccttgctttttattagaaaatctatatttgatacccatctctataaaccttatgttatattcttaaggcatgaatcagactttgaattaaaaaactctactctttacctattttctataagcagagttgcccttttcttattgacataaagccactggtgtttttgagtatgttctaaaacagcagatcagttcttcttgtgtgttctttggctatccagcttaaattccatatccttttaaagaagtgcattctaaatcctttccttttaatattttagctgtgcagaagagagcattgaatacaaatgtcacttgttcagtaactgggtcgataagctgctaagcctctctctgtatgactatgaatttaatagaaattattttctaacttttgttcttagcttttctgttaccttcaagcttaggactccagacccattttgtctttacaagcaaaggatgtttataacaaattattgttgtgaagtgggggcaacattgaagccattcccagcttagacaccattttgtaaaactcgtaagaaatatggttcgtggaacctcatagacttctaatactcaaagggtcactgaagctcacctaatattgtttgttgactttgtcagtaataaagtctatcttggggctggaacccaggtacactggctgctatgccatttaaatggaactgaaatatccacaaggctaaagaaatattggaacacttttcagagtgccatgctacttttactcttcagccttactacagtaacctagaaacttacctgtagtgttctgaacagagaaaaaagagctaagggccgaataaaataatcttaagtttttaaagtgttaactgtgaaatgaaatttctttgaaattttatttttaaaatttccaggccggtcatggtggctcacacctataatcccagcactttgggaggccgagacgggtggatcacctgaggtcaggagttcaagaccagcctggccaacatggggaaaccctgtctctactaaaaatacaaaaattagccaggcgcggaggcacacacctgtaatcccagctaccccagaggctgaggcaggagaatggcttgaacccgggaggtggaggttgtattgagccaagatcgcgccattgcaccccagcctgggcaacagattgagaccctgtctcaaaaaaaaaaaaaattcccttcagtaacataaaatgaactgggaaaaatatgagagcctcaagttacaaccagcaaaaagtgagtcttaaacccataatattcttgcacaatacattaaatcctttatttattagcaaagaacgtggaagcaacaccgcttgaatgagtcacaacaaaagcagatttaggattaacaaacacatggcctatgaggaaaggagaacttaacttgaaatcagtggaactaactgaaattgttgcacagggcagaacttaagcggttggttatccattgaaccactgaacttcttcatgtaactctgggggaaatggagacctggaggagtttagagacttggccagatcactccttgttagagaaaggactgaaattcacatctgttccttaacattaatattagaaaacaagaagactttgatcacttctgaaattgttaagaaaaaaatattgaagggtaacttcctcccagtaattcatattttatctgccagacactttaggaaggtaggaggagaggataccagttgcctcgtactgagctttgtataaaatttgaatgaggacactaaacacaaaaagaagtgatcagaagctgttgagcttattgagtccagagacatcatcatttgtttccatgtcttccgtttttatttttttaatttttctgtttttaatttttgtgggcacataatagattcatatatttctggcgtacatgagctgttttgatagaggcatgcaatgcgtaataatcactcatggaagatagggtatctctcccttcaggcatttatcctttatgttacaaacaatccaattatactcttttggttatttctaaatgtacacttaaattattagtgactatagtcaccctgttgtgctatcaaatactggtccatattcattcactttaactatcttttgtacctattagccgtccccacctcctgccaccccaacccttgctgcccttcccagcctttggtaaccatccttctttctatctccatgggttcaattgctttgatttttagctcctaccaataagtgatagcatgcaatgtttgtctttttgtgtctgtcttacttcacttaacatagtgacctacacttccatatatgttgttgcaaatgactgaatctcattcttttttatagctaaataggacaccattctgtatgtgtatcacattttctttacccattcatctgttgatggacacttaggctgcttccaaatcttggcttttgtgaagagtgcagcagtaaacgtgggggtgcagatatctctctcctccatatactcatttcctttcttttgggtatatacctagcagtgccattgctggatcatattgtgtgatcttgagaccaaaaaattatagaactgctactttcaagctttgtgactcaaagtgtggtcccaggcactccttgaattgcagaaactggggtcccacccagacctactaaaccggagcctgcagtgtgaggagatcttcacatgatgcccaggcatactaaatgaggtgctgcttcaggaacacttggaagtagcttcaggcagggacaatgctgcagctgtagaatcccgcgggaaagtgaaacgcagggggtgaggactaggagactcggacacagaccccttctttcccaaaatagttcccctcttctctgtgtgctctggtcaagcgttttcatgttaggaatgtattctcgtacagtttagatgtttgaaattgcttggaagtttcgtagagaaaactgggctcagaaaggataggccactcgggaaaagacctgttggagatgtgaagctggcagcactatccagggccttcctgagcaaggcacgcctgtccatgcctgtggttgggggattttgtacagtattcttacctcatctctggtttggtttgtctctgaagataactatcgtcactattaagctagaaaatgtagacaaaaagactgtcacttaaattttatatgtagatttatgttttatctcaaaagcagttttcatcttctaattatatgtcttcactgtggatacgtagttatagcaaaaagcatgcgtgtaatcctgtccaagcagatgatcacttgggatattgattctattaagcatttgtgaaatcagcctgcctttgcagatttagcagtctgtgacagagcagacgttttatatgtttttaggaaggttagctgtctgaaattggtgactaaacaaagtctgtttgggttaagtgtacaaccagacagtatgatgtaaactgttgtaacaagatcttccatttctaagccctaataactatttgttttcttcttgtttttagggtgaatctgtaaaatatttcctggataacttggataaacttggagaaccagtaagtgtttaaaccaaatgtttatgtttagtgccatttgaaagcagaagtcaggatatcgatgttaggaaatttagaaaaattatgtattaagctatttgcttctttctctctctctctttttttttttttttttttttttttttttttttttttagtggtggcgttctgattcttctctgctttatttagagtgattggtagctcagaatattgaatgatttttattttttcaaaatgaaagtatttttattgtttaatcacgacacttcttttttctccctctaactgtccaggtctctaccattttcttgaggaatgctttgtctgctatttcttggaagtaaaactgtttagagaaagaagtttgtgtttgaagatgatattgtgcattatctgttatactttagtatctttagaggtttttgtttgtaaacagaaatagaacacagtgggttgactgatttccaaatcttttgacaaatgacattttcgaattcatgccccctttgtgtcgagtcacggagtaggagggctagatttaaaaggctgaagagactccacgaggtagggggagtcgcccttgaaaagagagtctatcattttcctgtaggtattcctcggagccagcagctctaagctggcgctgtggccagcggggcccactgcaggcagagcatctcgcttgtttgacctctgtattgggcgtacacagaagagttcactgggagaaaggtttctgctgcttaggaaaattttgaaagccattgccttagagtcatctgttactctctaaatgtagcacagcttcatttgcctcctcataaggcaggtttcttcttcttcacacagctagtatgtgtgtgtcctcatcaacatactctgctctgccagactgtttagcactcgattgcatgaagttctgtgcttcatgtgaagcagcctttagattgctaactagattattagctttaatagagacaaagacaataatagagaactttttatttttatggaattacattttttaaaagctcagggcccagcgtgtttctgaaggagctggcataggtgtatgttgtaaattggtattgccttctagaaagcagtcgggtgttaagtatccagagtcattaaaatgtttgtaacctttaacgtcataatcgtacccctgattattttaatcttaggaaatagtccaaaggaaaaaaaaaatgtgcatgagaattttaattgcagtatttctgttaattatggctaaaaattggaaacaaccttaatgaccactagtaggggaatgttaatgtaaagtacagcacgttaatgcatttggtgtattttcttgtcttttaaaatgaggtatgattgtatcagcatatggaacagttcacaaaatattaagcaaaaatgcagaggtaggctgaacgctgtgtgcatatgctgattataaataaagcaggcgtgtatctgaacaaagctagaagaaaacatggaaaagctaacacttgagtcctagagttatttaatgaatggctgttggttgccagtaactaagaacccacctacttttaaaaaactctgaattctggccgggtgcagtggctcacgcctataatccgagcacattgggaggctgaggcgggaggatcacttgaggtcaggagttcgagaccagcctggccaaaatggtgaaaccccgtctttactagaaatacaaagaagtagccggccgtggtggtgcacacctgtaatcccagctattcgggaggctgaggagcagaatcgcttgaacctgggaggcgcaggttgcagtgagccgagattccgccactgcactccaatctgggcaacagagcaagactccatctcaaaaaaatatgtatatatatatattcttaattccattgcaccattttgagacaatgagtattcttgtaatgaaatttcaaaatcatatgacactattcagaaaggcataaagtgcagcattgtgaataacagcattgttttaaatcctgccttgatttttaaaatattttgaccttgatgataaatattagctgtcccgttcatgtattaccagaaagttgtgttgtagttttggaaaaatgctagactgacaaggaagaaccagttacattgcataaggaagtgtgccatcacagagtagccagagacttgtgtgaccagcagcttctgtttgttcagggtcttagagttcactgaccaagagtgcagagaagagctcatttgatccttgcaacaaccctccctcccaggtatatagaccaagtgtgatcacctccatttcacagacagaggtgctgacactcagagtaagtgactagtttgagttcttgggtcaataagtaagaaattaattatagtagagaaaggatttttcacacatgtaatatagcagcaatgaaaacatagaagttttaagtcatgagtggggttgcacagtaaaagaacttttagaataggttagagagaggtgggcagaacttggaactgggaagtgatccttgtgaattggcactggaatcagatcccattgccttttttttttttttttttttttttaagacaaagtcttgctctgtcacccaggctggagtgcagtggcatgatctcagctcactgcaagctccacctcctgggttcacaccactctcctgcctcagcctcccaagtagctgggactacaggcgcccgccaccacacctggctaatttttttgtatttttagtagagatggggtttcactgtgttagccaggatggtctcaatctcctgacctcgtgatctgcccgtctcggcctcccaaagtgctggaattacaagcgtgagccatcgcgcccagcccccattgcttttaatagaggagcaaggagcagtgtggagaaggtagatacgcagacaggaagatcactctggctagaaccaagagtggctgatagtggggagtaagattgcaggtggatatatagcagtgagggtgggtaagaacaattgataagacttcagcttaaattttgagtagtattgcagggatgaaaacaagtagattctggccatttgtagtaaattttgaacccgtcctgctaacattttaatgtatcttggcttttgttgtggggagcacaagtgggtcttgctatattgcccaggatattctcaaactcctggcttcgcaagcgatcctcctgcctcagcctcccaaagtgctgggattataggcatgacccaccatgtctgaccagtcttggcattttataataagcataatctatctgaaaatgtcacttaaaagatcattttgtttgcatatctattcactagtccagttagtagtccattaaaaattcgcattacttcgggattaataggtataaaacaagttttttcttttccaggattatattccatcacaacaagatattctgcttgccagaagacccaccaaaggcatccatgaatacgactttgaaataaaaaatgttcctttcaaaatggttgatgtaggtggtcagagatcagaaaggaaacgttggtttgaatgtttcgacagtgtgacatcaatacttttccttgtttcctcaagtgaatttgaccaggtgcttatggaagatcgactgaccaatcgccttacagagtctctgaacatttttgaaacaatcgtcaataaccgggttttcagcaatgtctccataattctgttcttaaacaagacagacttgcttgaggagaaggtgcaaattgtgagcatcaaagactatttcctagaatttgaaggggatccccactgcttaagagacgtccaaaaattcctggtggaatgtttccggaacaaacgccgggaccagcaacagaagcccttataccaccacttcaccactgctatcaacacggagaacatccgccttgttttccgtgacgtgaaggatactattctgcatgacaacctcaagcagcttatgctacagtgatgtacaaaagacttgctgttttaatatctttttgtgtttttgatgttttctgtttgttttgttttttaaaatagcagtttacaaccagaattagaacaatcttaattctacgtttaacttcttgaaaatcttagtactttttctgcggcctttggtttgtggctgaaagctgttgagtgactcatcgccaagatttgctgtaatgcaggctttgatctgtttcaccatggcttctattcaagtccagttaaaacctcccagctgacctcagactaggcatatttcaggctttaaattattctactttccaaactgaattctcctgcagtgccaagtatcaaaggtgtccttaaatacttgtagggatgaggttaggaatattcagttccaaaacaagatatcttctgtccgccttacatatagcagtgacacttgttgcctaactttatggtgacctcctattttgtaagggctgttagaagttctatctaagaaatggcattctgtaggtttatagaaggtttagccttcatattttaattgcttgtatacacaacagctgttttgcttttagatttctgtgtttctgaaggtaatgttcttcctgttttcaagtttacataaggatctttggtctgatgctgatgaagagttcacaggtggtatgggagagcaaaaggcaagctaatgctgtttaccgtgttttggtcaaacgtaacgagtgaaatagaatttgcctttctcatatttaattatcatgtagtttaatgtaccatatgtgaaacattctggccatagcagcaactaaaaactgcaagcaacttggtaacagaactttctaaataaacttaacctgttccagaatgtcatgtatttgacttttaagccctatctcagttggtcagtaaagaccaatccttactgtaggaaatcattgttgtatcatcacaaacatctatcttttgctgtcctgtccagtcccatcaactccacactgtgccatttgtggcatcgttttgtttatttggagtttgctaagggcagtatttttctgtcaagactattcaagaaggcattatttgagattcctgttcattcttggtgtgtctctaacagatacagtatgtatacatttgtataattgttgttgttgaaagtccagcttttttgaggtatattttaaatgttttaaggatgcttctaaggatcagtagtaatttttttagttcgcacctaaagatgattacattgacctcccccgactgcttaccaaattaaaatgtgtccacgaagtagctttgtgatcgcagatacattcatagtgaactcatcagaatggctggtttgcagtactgaaatactatcttctaggctgtatgtagtgctacaattagagaaacagaagtccaaggctggcgacagcttgaaaagtctgacagcttttctacttttcctgaaaattttaagactgtgatatctgtcattttactgtatagctgactgtgtactcaggtattttattggtccttgaaagattggtcgttatggatcacccagcctttccaagtcagtggctgttgttctgtcttgctgtctgatacgagagtggggcttttcagtgaactaaccagggattgttcttgacatacctgacttttctcacatttgaacttccactatcattgtatccatataacttctagcattttcatgccatggtaatccatgagctacacatacgtagcccggcaccgtgatgcaagttcatggtatcgtgcatgttcgtggtatcatggtatcattcatgcgtgtttgaatagttctacatctagtgcttcttgccaaaaagaatacattgtttaaattcacaaaattagcataattgcagtgctaatgaatatcggaatatgtgcacagtaacatttggactattcattggagagtttacccatacatttagcaaattgaatggccaaaacatttgactccagtgagggctcaagttagatccctatagaaagaggacacttcatcttacttaagtcatagttaagatctgtgatacgaaccatagatattgcctgacaaagcagaaatcaccaagtttcccccttttgaattaccaccaagaagtgttgaaacaccaaatagatatcatgttattttgggcatttgcagttttcttccctgctgcatgtaatgtctcagaatcaacattcttttaaaa

SEQ ID NO: 15637 - DNA, 48794 bp, Human
  misc_feature (1)...(48794): n = A,T,C or G
gaacatacatgctgattagaatcatacagagctggaaggggatgggcaaagaaatggcattagctaaatatttactatgttccagacactgtaccagacacattacgtcatttaaggggcccaagacaagtgattcaatcccttttatttataaacggggtaggtactattattatttacattttagagatgaagaagctaatggccagagaaaaacagtcactttctgagatcattcattcattcatacaataaaaatctcattagctcttatcttatgaaagacattgcaaatagagcagcaaaaaggcagtctagggacctcaggtggcacaaagtccaccaaatctccattgaagaaactggaactgagagggcaaattgggactggagcctgccagaagccatctctctggaatccctcagcctgagcaagaggggagtttgctgctgaggctgctggagctgcggtgtagagcaagttgcaggcctctgagcctgttggaggttcagaaaggttagctgacttgcttaagtaagtgtcctagacaggagggagaaagcgcgcgggtctcagatcccagctccaatatccacgccttttcccttttcatctcccggaaggaagccttcacaggtggggaaaatgctcacccagtgactctaaagtagtgcacaaattggcattaatcagaaccattctgattcctgctatcaaggtttatttaattctaagctcaaatgacacagaaaataaaatttcctccttaaaaggttctgcggaaaaatattctctgttctacgtaacagcctccttggctgtgtttgtgtctgaagaaaggactagtctgacaggaagaattacaaatctggagctcattttggcgtcgcagagggaaggtgggtggagcgtctcgcagtaaattaggaattcagaatgaaaacgtagagtttatttgggtttttagtgacacctcaggattattatacagcagtgtcagacacagctcaaagtaatgatgactgctccccctccgccccgcgggagctgggtgctaagaagggggaacccctcctttgaggggttggggtggggatcctccctttccaacctggatcgggaaggggtttgagaggagtgcggcttggatccccatcctggatctgtgctggagggaggcgggaggctatttgggggtgtgtttgggctcaggatctgggtctgacgctgggatctgaggactttctgggtttggaactgggtgggggagctgggtttggggtgaccgctgggagcaggaggaaataggagagtgagtcgcatgtgaagggcactgaggagggatcttcgggggaatgctgaagttgatgcgtggacttggagaggggaagttgaagtggatgcaggggcctggcgctgcagcggatctgggtggcatgtgctgggattgccaatgcggagctgtgaatggggtcagggtggggctgaggcagtaccagatcttccgcgcctagaggaggttagaagaaaagagcgtcgaacggccacagcctttttccgaaagagactcacacagacacacccatcgctctacccggccctccggggctagcggctgagcggtgctggggctggcagaccccgcccccacgcggcctctcggagccgggagccgatcgggccggggctggggtctggcggcccagcccccggggagcgtggggcgtggccagaaaccggcgctcgcggctgcggattggctgcctggcgggcccgcaggcggggctcccggctgggtcccgcttggcagctagcgacggcggggaggcggggccggcgggagcccggcagccaacggacgcgcgtcctccgagcagttacaaagggccggagcgaggccgccgcggcggctagggaggtggggcggannnnnnnnnnnnnnnnnnnnnnnnnnnnnnnnnnnnnnnnnnnnnnnnnnnnnnnnnnnnnnnnnnnnnnnggcggcggtcgctgtttcgcgtccccggctgctcctcctcgcgctggcggcggcggcggcggcggcggcggcgctgctcccgggggcgacgggtgagcggcggcgcggcgggcgggcgactgcggggcgcgcgggccggacccggcctctggctcgctcctgctttttctcaaacatggcgcggggccgggggcgcaggtggcggcgccggggcccgggccgggctctcgtggcgccgcgcggctcggcggctgccgggcgaaccgcaagcggggagcggaggcggggcaggggcgtgtgtccgggcgcgggcggacgtgtccggctgcccgaggccgccccgctcgggactccccggggaggtggagtcgggcggagtcgtccgaggtccggggctgccctctggggtgtgagtgggcgagggccaggggcggagagtgcgaggccggcggggactggcagagccgtggctgcccgccgccgccccctgggcacggcgtgaccttgttctggggacccccgccccaagagggtccgtgccagaggctgccgaacccggggcggggtttgaggttggggtggaaggcggctcccgggcggggtgtgagctccgagcctctagggcttcgtccagtgggagtcgggggcgacgtgtggtgagacccctgggtccgcaggccgccctgactcccgcccggctcgacccgagccgaccctgctggaaggggctgctcctccagccaggggggctttgtgtgagaagaaggaagcgcggagatgcgcggaatgtttcttctttcgtgcgtctggggagtgttgaagtgagtccagtaaccagacggctacggattgttttcatagtggaaacttgaacgtttgctcattctgcgggttttggaaattttgggaacgactgtgaattgattaaacgctttttatttcctcgaaggaacatcactcacgttgttccttttcttgagtgacagttaatagtttgattcagacatctgtatagctggttttcaaggaagactgttggctggatttttcaaaatagtaaatcaggttggggtaggtggttggtatccacaaagggatgagtgaaaaacttcgttagcagctgaactgagacactagaagctaaaatacacagcctcagtgttagcaactaaaatgcagtgaaagtacatttctgtttctgaaactggacaaaagatgttgaaatttttttaaaaaatcaagactgacggtgacgattataatcagtcctaatagctaccgtctatgtattgtgcattactacgatgtaaatgcatacactattgtataattacattatttaatcaccacaagtaaactcccaggagtagtggcatttgccccactttacagatgtgcaaagtggggtacagacacgttaagtacccaataacttaagtgctaaagctaggattttcactcagatctcagtttcccaaacctgtatgtcatatatatatataaatatgtatacatcatactatctggcgtagcccatttttcttcttcagtcgtctgatgagcaattggtctttattatccactttggattctgtcctcatgatttgagtatcagataggcttcattccgactcttagcacattgttgagtcccttcacgtgggcctgcattagaggaaacaatggatttttgacattggcctagggaggaaggcaggataactgtgtggacatttgggagaatcagtatagttaggcatgaaacacaggtaacatttccacaccgctattaacttgaataacacagtgcactcttttccaccagaagtagcacaagaagcgttcatgtattcaagtaacagtagtggacttagttgaagacacagaacattgctcagtccatgtcctggaggagtttacagtctccatggtatgcacaaaatacaaagctgtccaggtgcttattactctaagcccagactgcctcagcttgtctgcctcccctgttggttatgatgatgcctcagtccacccttaaaaaacattctgaaaaaggtcaaatgctttttatttcctctgtaacttggcttcccttttaaagacttgcacctttttatgttctgagtatgttttaatgttctctgcccaacttctgtctccaacataggtttctctagggaaattgattccttatccctagtgcacagtttagtaccactatgtctatatgtatatcccatctgagaatgctatttgcttcctttctgccatttcataactttttttctttgaaaacgtgcccccaatccaactcttctatgaatgcctcttgaatgtctcctcctttcttggtatgcagccttcagcttaatcctgcctgttatcctccaaatctagttgctttcccatgtttttctcatctaggcttttctatggctactgccaaactaatcttcctcagccttccccgtgaaggtttataagatttcccatttgtattcagcacttagaacaacacttagcagcttatgattggggccatctctgagtatcctaccagggatctcatttctcattactgcagaccttcgagcaatttctctttctcactgactcctgactgttcagccttttcactacacatttagttttgcccctttttttgggagtgcgagaagttctcagccctgacttcctgtgctggtttagttcttgaattctttgtcttccagaactctgcaacacttaacagtttgtgttgtccatttctactgcctgtgctgctacttaactctacttgaatgcgttataggtacccagaggacaagattcatgccatttctttcttttgtggcctcagaacttagcactgtgttttatattctattccacataaatgcttgttgatttctatttgagcattcctttaatatttatactgttttatgtaagtccagtttatgcaatattaacttgtaattccgtataaataatcaggaaaagttgtatggcgtgttgaaagcaattggttatttgtcctaccttcaccagcagttatgcagaaaatggggcaatacctacttttgcctaattcatgagattgtgaagatcacatgagaaagtggtatttgagtttgaggttgctattctgtgttgttgctaaagagcaggactgatgttcaataagcagttcccactgggccatgtgtgttttggttaaacatcctttctgattggttggtacccttgtagtgccagttgttaaatatttttaatatcatttctatagggaggcattagtattcaaaaagggaaatgattagtgtaagctggaatgattgggggaggcttcttggacactttaggacttacactgactttgaagggtgggtagaattcagagggggatttgatgagtgtgaaagttcttttgaagttgtgtccccaactgtcctggggcctactccaagggaggaaacaaggcttttactgactgactggcaagttactcttcagagttaggttccttattctgtactgtggaatttggatgtattaacctctatcattttttccccaatcctaaaagctatagtacatagctggaaacaaaacataaaagtaatcaaagtggaatgagtgagggagaataacattatgggatgcccagtaggactaggcattcaaatggtggaagtcctaagtatattatcacttcaatttacagatgaaaaaacgactcaggtgaatttcttagggtggcacaggggcagaacagagacaggaactttgattttctgattccatatcttgtgccctatatggtgctttaaaatgtgaaggacttggaggtgggagtgggacagggttgggataggtggttggcatccacgaagggatgagtgacttccttaagtgaagtaggccttgaacttcacagaatttatgaaaagtgaattctaaaggtggaagggagggggaatgattaaagccttaaagttctcaaggaaaaggtcaatttttttttaattgctgataaaaggacctggtatatacttattgattgagaaaagtaggcctatagtagtttggaagatggtcttgagtaagtacagttaattgaattggggtgtagttagaaggctttggtttagaatattagatgatccgctttgttgttgaaattaagagaggaattgacataaaaataatcaagaggaagataaatcttgttcctgtgaggagggccgctcatgtagggaagacccctgtcaaaaggttctaggccttagttgagcagttacagggactcaacaccattcttgtagtgtcattttattgcaccaaatatgttcatgtgtaataaatggaattttgaaaatgccattatcctatggatggcccttctgatgtgagaacgtgtctcttcaaaccacagagccccttgcaaatgtcgacacacctcttgccttttgcagttcttccttggtcatggcttacgtaacacagagttctctgaacagatggactgtggtttgatatcatgtgattgggtcacatctttgcttcctgcttttggaattgagggcagatgctggcatatttctcagggattttttaatgctttgtcccatagaactagcttgaggaaaagttttggagtcttctcagaatttatggtcagttttgacccagcctaactccaatacttaggattacatttaatgccattcttagctgaattttctcaatgtcaaatccaggcagtctccataaacattaaaattgtttaccactctgaattagatccaattttatgtgttttgtttgctttccaggtaagtttcttatggctacccttcttcatcatgaagaaaattggttggtagacttgtaattattcatctcagacatcactttcttaaatactagtggactaagttcagttggttttatggtccaattttatagatcagatcaagtcttttataaagctgctccctcaaagaacaatttctaatctaacttaaaaaaaattgacttgcaaagtatacacacaggttgctttgaaatttcttgaagggttgcaagaatatgctacatattctatctgtcttgtctcgtttaattctctcttctctctttttttttctttgaccatggctaatacggcatcatttaattctcataaccaaccttgaatggtagttgtatagagtaccaaaacttcttacttatttgctgcttaatttccaaactcttaagcccatttgttcccagatacaggtgaccagtgctcagaagataactgtaggttttgataacatcggctctaccccaagattcttttcaactctaaacattatccaaaggtgttagtattttttcatcgtctaatcgtaaatatatatataaaagaaagacactgctttgaatggcacagatgtagactaacagtagttcagccactgagactcaaatgattttgtattaccataaaccccatctgcctgggcaggcagaattgacacaattttgctcagattggaacctagttcatatctatgaaagaagaccctctttgtttccattttatagaccaggaaactgaagttatgctgttaatgaaaggtggagccttcagttaagcactccagggtatgtactcttttcctatacaaatgctcctctacttatgatggggtcacgtacgtccatgctcctttcatatagagtaaatacattgttagagccacttcagcaggaaagtttcctttcccttttttgcaaaccatgagaatttgcttcagattgccttgattacagttttactatttctttgcaactgcaggccattcagatactaacagtctttctttaacattatatttttaggtaatttgaatcttcctgatgagtccagtgatagttgatcacttactatttgtattgatttatacatatattcatagcaaattcttttcttctaaaagttacataagcacaggactgaaaatttgtattagagaaaggaaaaaaaccatcaccagccattattaacatttggcatatcctgcacccatgcttttttttttttttttttttttgagtataaaaaaccattcttgggctgggcacagtagctcacacctgtaatcccagcactttgggaggccgaagtgggcgaatcacgaggtcaggagttcgagaccagcctggccaacatgatgaaaccctgtctctactaaaaataacaaaaaattagctggacgtagtggcaggcacctgtaatcccagctgcttgggaggctgaggcaggagaatcacttgaactcaggaggtggagtttgcagtgagccgagattgcgccactgcactccagcccgggcgacagagtgaaactccatctcaacaaaaacaaacaaacaaaaaaacagcaacaaaccattctttaatcattctatttcagcagtttatgaaagctaataaaagtgtttaaattgacaaacagcttcagtttacagaggaaagagcttcagtttacagaggaaatagctcatctattcttagcaaatatttagtagtgatcaacatgatgagaaatataggaaaagtaagaggcagtcttgcttttgaaaaaattgatgctgaggaaatatgactacagactcagtactagcaaccacagggactgctttacagaggaggtaggacttgatctctctgccttgcaggaggatagggctttgagtggatgtgtggtggaaaggaggcacttcttggctggagaggatggcatgtgtggagaaagagcattctaagtttcaggatttctaagaggagaaatggaagttcatggtgtaaagggtgggctcagagaattatgggccttgaaaatcaggagagtggttttaatgtggaaaaagaatgtctaattgtgccgcagagggaatggatcagggtggctacccagttggtttgatggcattgagaacggggtgaaatggtgactgtatgacatttgaaacaaagaaatcagaggaattagtagtagggcctgtgtgtggctgttcccttgcttgtgtgctcttccctcacatacctgcatggcttcctccctcacctcctgcaagtctttgctcagatgacacctttttctcagtgaggcttatcctgccaccttttaaaatattgtcatcatcctacagtgctttccttctctgtaacaataccttctaacatactgtatttatttacttatcatatgtacttatttactgtttattgtctccttcctatcattctatgctttgtgaaagtggatgtcttcgttttgttcactaatgtatctcaagtgtatggaaagtgcctggtgcatcctaggcactcagtaaatatttgttgagtggcagtaggtcttagctgtaaagaggtggagtacagaaattcagagtgactccatgaaagaaaaaagaatgactccaagcttttttaggctggataatgcctttaacttaatgagtaatttggcacgaggattaaggggagacgaattctggtttaagcatgttgagtttgaggtgaaggtagccaaataaaattgctcagtagtcagcaaagattaaaaaaaaatggaacctagttggaaatgggagagcaccttaagcaaagaaatggctactagcatctagcattcacctcatatttctctctctctctctgtctttctcttttgggggtaggaggattctagtgtcctaaaacgctaccttaaatggagtttttatttagaccctgaagtcctagcttgtatctggagtcctggtccgtttgctgggatatggttctttcctgttttgcaggttcatgctatttttcccccacctctcttagtaaagatgtatatattcagaattacttgtgatcttctggttgtattgaaattaaccttcagacagtgctgctttctctgcagtaatgcgtttgatcttttgggagtgtggttcttggctgagataaaagagaggaagtttcctgcttgcggcctaggcctcaggtcatggttgctgatgttacaggtgtcagctttactatctcctggagctccctgatggctatccttttaaatgcttttcctgttgtttttctcaatgaaccaaacactggtgcagttgtatccctagaccatctctctttttctatttggattgatctaacttaagtttttctttcagttttgaaggcagattaaattcatgtgacttggttgtcagaaatttaatgaaatatttgtttataggagtagtatataagcaccaacatatctggctgtaattagagtctaatcagtgtatctgtgactcacttttcaaaagaggatagttcctaatttacctgatcgttgtgaagatagtgtacagtagtatttacacttagtacatagcctgacaccagtaggtgttcaataaaggggaattattatatatttaaataagtgaaagaatgtcttctgaaagaagaaatacatgtctgtgtaatgaagaactagaattaattggtagactgaaaggcagaattcagctcaatgtaaggaatgactctctaccatagctgtcaaaatggaacattgtaaggtagtatgttccctgtcaccctggaactattcaggcagaggctagataaccttctgtctgagaaattgtagaaggaatttcttacattaggtaggaggtcggacttgtttatctctaagctctgtttctcctctaaaattctgtacttttgggcataatccaagcttccttgcttactggttttagccaaatatagtctaaatatccctaggattcatggcttcaagatgagcagtatcttgttgctcctgtattatacgagaaaagttagtttatccattgattggcttttattttggtcattttccaaaaaaggattttggaagcttgaaataatagcaaattcagtaagaccaaatctactgaccacaaaagataagaatcagtaagtcaaaaagggaaagaaaaagagaacaattatccgtaagtttagctgaggaaagctttagaagttgaacacaatacttagctctgagttttctggtaaccaaggcaagtaaggaagactgataatttgcatagatctcattgcctatcgagaattcatgaggagactgccaccttccttaataaagtggagccccaaatgccaagattgtcatacagggagaatctccaagtggtaaggggttattgctggatctggcaataatctgattcttgttctgaggcttcccctttaacacgtattgagggttcaatttagtgctgctgcctccatctttcttctccagtttaagtctctgatccaagtatgaacacattagtctttccctaatgccaatggaacagctgatgtaaggctaggacatttaaatcaagctttgctaaaagctggaggataatgaatagagagcaacatgaaactatttagtctggcttacaaagacatttttctcatgcccttatcttttggtgtgtctccatttgatacacttcatcagagtactgctaccaaaggcagagccagacatttaccttcaaacaggtgcaagtcagtaagatccagagtgtctttgcttgggtttcttgtttgaagaactgcttcatttctgagtaatggacgttcggaatgattactttaggagagaccacacttatctgagagtgtggccctactgtactggtctcacagtaatcccagtattcatggaaaagataggcacgtacattagcatgagggcattctgtggttagaagcattctgatttcattgggaaaaacaagcttctctctgttcttgagcagaagcttttatagaagtctttgtacatgggccattgaaaaataaagtgaacaattcgggtttatcactcatgatttgtaaggattcacttttccttttttctgcagttgctgtactacttcaggtctgttccagtgtttccttgttctcaccaccaagactgaacctccttatttttgttcatttgcttcaggaaaaccattccatctagatttcctaggtgtaaacctcactgattacataatagtgtatatttatagttctaggacaccttcttcaggcatcctgttacatttctacattataagattcttaaatatgcattgaattacaaataggtccccagggaaaaggcaaaaacgaatggctttttctgcgagaaactaggactaatatagatatttgggagcactgaacatggaggatagagttaaacttgaaaagacatacagagatagaaaagcagcaactgccctttcatttgtatgcaagcacacgatatatgtatgggttttttattttttgcttgatgtattcatttccaaatcaaactataatgtgctctaattgggtctctttgttcagcacgtggttgttgatttgagtactttctccagttgaaaaactgacattttaattttgttattcaatgtgtgatagatttaaataaaaacacccaagattgtgtattgtagatttccttcaacaataattatatataattattttatcaaaataaacaagttaaagtagttttagttattttgtctcattttacatttgggaaaaaaattacaaatcaggggccagagtctggtcatgtttgtcagtgaggaaagacaatttctgattgccagtcccaccaaagcgttggcagattaacacagcattgtagattactttcctaggaagagatgctccttttttctccctttccattattttgctttccttctttccatggtgcattgtccttttgttttcttccctcttatttcgatgcatgtataaacttgagcctttctgctctcacattctttctccccatgatcataattgtttcttcactttattcttaaaaaaaaaaaaaaggccacataagtattttatgtagatctcatctatcatttaagttttgtcagatccagcctgctcttgccttaccatgggagaagggaaaggagggaggagttttaagggattttaggcatcaggcagaagtcttaagggaaaactctgcaaggaccaacaggctcagaattagctgtgcattgcaaacagatggtgtgtccctgaggaaatagcgtagttgccctaagcaattgggtgcttccatctgatttagcttagtctctgtaactgggaaaaaggaaaatcttatggaagaaatgagtataatcacctgtgaaccattctaaactattatctagagactagtgattattgacttacatatagatttcataattctgcaagatagtcttcggtgttgtatcatcagttatccaaggtataaataacatcaagacccttatgcctctgagcctgatagatccttatcttttaataaccaaccccccactttcttcagtagccatgatgctactgtatcaatgctaccagcaattggaaacccatattcctaatgccaagtctcggcatgtagattttgaggtctgaaaactttattagcttggttacagtacatctcaagcctaagttttcatatacacatagtttagtctcaaagggcaaatgtttccctgaaaggagttcagtcaacactagatgcttatatctttaggctccaagggagtccaaaatttaatgattaaaaatattataaaaatgcaaatatagaaataatacaaaagctccttccttttggtgggcttttctgtccttgcttggttcaattcagctgtgttcttctaggagactgcaaccacaatttaactgctttgctttggtattttgtttgacaagggagatgaatgtttcagatgagacggagtctcactgttgtcacccaggctggaatgcagtggcgcgatcttggctcactgcaacctctgcctcctgggttcaagtgattctcctgtctcagcctcccgtgtagctgggattacaggcatctgccaccacgcctggctatttttttttttttttttgtatttttagtagagatggggtttcaccgtgttggccaggctggtgtcgaattcctgacctcaggtgatctgcctgcctcggcctcccaaagtattgggattacagcgtgagccaccgtgcccggccttcaattttttgctttaagttagaatcctgtttgcttactttttctgacccaaatgttttaaaaatgttttcctgtgttttcatttaaaagattggttttacctctcacattgagatgtatctggagttggttatttattatggtatgagatttttattatttttaaaatacggatatctggttgactcagaaccatttattggtaaaaccttttttcccccagtgtacaatcaccttcatcataaatcaagaggttgtatatgtgagggtctgtttctctgtaatctctgttctgtttgcccatttgtccttgtgccattaccatactgtcttaattattatgatgttaggagtcttgatatcgagtagtgttaagtctttcaaagattgctttggttattcttgcgatgttgtttttccatataaatttcagaatcaacttgtcagttcccactgaataaaaaaaccctgtggggattctgatttgattttattgaatctacagatcactttatggaatattgacctctttacagtattgaatcttccagttaggaacttgtcacttttctccatttataaatacattttaaaattttattttatctcctttgtaatttctatcaataagtaatattttttaagctttctctgcagaggtctttacctgtcttttgttaggtttattcctagtttttagatttttaaaaaacgttttctatttattactggtttaagaatgattttttaatttaattttttttggtatagtgagtaaccttatattagtgaccttgctagattgactaattgattctaatagttgatctgtaggtcacttttggattttccatgtacatagttgtcctctgcaagtaatgatagttctgtgtctttccagtctatcttccttttgtttatttctgacttactacactcagacttctaatacaatgttgagaagtagtgatggatatctctttcttatttgtgatttcaagggaaaatgacagtcatgcaacattaaatgtaatgcctacttttatgccttttatttaatctgattatttcagaattttttttaaattctgcaatttactgaaatttttaaatatcatgaatagctgttgaattttatcagtttactaagatttttaaaaatcatgaatagctgttgaattttatcagtttttttgtttttgtttacatcacctaaactgccaaactcccttactgttttctttctttcttttttttttttttttgagacaggatctcactctgttgcccaggatggagtgctgtggcctgatcatggctcactgcagcctcaaactcctggggctcaagtgatccttgtgccccagcctcccaaatagctgggactacaggtgcgtgccaccacacctggctcaaacttttattttggcatcttttgtacaatgtttttgtatatcctctacctaaaatgactttcctttcttcactagctttccttaagtcttagtttaggtgtcatatttcagagaaatctcccttttctgtcctctgatctgtgcactttgcatcatcatttatcagtggtgtgttctctgcattgtgaatctgagggcaggaatctcatcctaattatctctatcctcctaaaggttttttctttcttcctacacaggttacattcactgttgtgttctgagaaaaggtgttcaggccttgctttctgcttctaaaattactaactgcccaggaccatcagttcatttcttcaactgtggctccaacagatctttcgctgtttgctggcccaggtattgctctcctctgccccgagtcaatggcagctgggagtggttaccacttccttctcttaccacagttccttctctaccacagttctgttttgtatgtcattcccctagcccaggatgatcagccactttcatttacgttcattattacaccttattatctgtgcaaccaagccagtctctcctacagccactcgtgctttccaaagggaaaggttgaaattttcggttttgtcctacgtgaggggttgtggggagtaggggtggaaatcactgtagattatcaagtaatcctttttttctttgtgtacttttggaataaatctagattatgttgatgtaactgttaggacatttctgtttcttcatctctaaaggagctgggatctgatatttctgttcatattccttccagcatgaacattttatggctaattagatattaacttatttattagggatattacatatacacactgggtgtgtccctacactgttaatttgggttggaactgaaaatatactttctgtgtgtgcctactgctactgtagtgaagttcttgagccaggtctgttcagtcatattgttgaaaaactgtatgaatatttatgaaggagaaagagctgataggtaccatgaacattcactgttgtatatgcatatggtttatattgtgttctgtgtcagtattgcctaccagagctgtctcaacattagctctgattctctgtctagcatctagaccagagactggcacgtaataggagctccaaagaaatacttgttgcaaaagtgcataaactaatttttgaacattctattatgtgctagacactccgctaagtattctatgtatgttatttcattaaccctcaaaccttctgagattggtactgtttgttagtatgttataaatttaggaagtaagttgaagaaatttaggttcaaataagttaagtgacttcctcaggattactcagtgcctgactggcaaagataggattttaacttaagtttttctgtctctgagttccatcaacttaactaccatatccttataatacctacccactagtcaaattaaaatctaataagaaactgtgtaaaagcatacttagattgagaggaaataagaaatttggttattgttttagcactcacctttagacatagaagtttctccatttcttttcagggcctggggtaaggcaaagtgtgcacatctgctctgtatattaaaatatcccctcaactcattgaagtggaacaaaaacaaggtcacttgacaggactgtaattgtaatcacactatacagctttacttcctgccctttagtagtaggaccattcccttgtccttaaacatgcttctaaaataccagttttaatggctatatagtctttcatttatgattgtataaggattcattctgtcattgtattgtcattcacataggttgttttcaatcataaaatactgtaatgaacatctgcaagtttagatttttgctctcacctattgtttcctcagacaactctaagtagtagaattgatggattaaaagatactttttaaaggctctgactcttctaaaatgtgttgttaaactcctcagatctgctaaccagatctttatgctgtacttgtgtgatttatttcgaatctaagtgaaagcctttgtattagttaccctgttaaatcccatcttgccatttgggcagcctattcttagtgtgttttctctgatatcagttaacattatattggctaattccatagaaactaggagactggaaaatgaagataatgtggaaaaacaagagcttgtgaatttgggagtgccctgttcttttaagatgtgatgtgggttaaatgataaacaatgcatcttaaattctttaaaagtggcagaagtaaatggaatttatctggaaaaaaatcaggcgtttattctgatgccctaaattcaggggtgaaatattatctggactagaggaaaattttatgtacattatatggtgttctctattttgacaagcttactttgatattactgctgcaaggtagccccaggagggttgaattgagaagaactgagtattttgaggaacaaaacctaggatagtaggctggagggaattggaggtcagggttttagccatgtatacagagataagcaacatatttaataaaaagaaaaggagaatctatatagtatgctttactccaaagctggatgagggagaaaagaggacacgtctccttgagaagggggcatgtgttgagaatggagaaaaggggtaaggcagattactcagaagaactggggtagaagaataggttggatgataaaaggggctgacattagtccctgaaagttttttttaaataacttccaacttttgccttcacctttgccagcagtgatgtgatctgctttcagctgtagtgaagcaaactgcataaaggacattgtgcatgttaggtcttttacttgcctgttggtacatgtttgtaatatttggaaatactctcactgcgaagaaaagtatagttgtgctgtagtgggtagggtgaggaaaataagggtcatcaccagcaaagtcagagtgatgaaaaaactggattacaacactctgcttgactttgcatagataagtaagccaagcagagtgtttcctggatgtagttaaaatacaagcttggagcacaggtaaaaggccaagaggcttggagatgtacatctgagatgtaccaaagggccaagtgcaaagtaagtttgggaagtttagtgtcatataaaaactaataaagaaagggtggtactctgtctcatatcctgaaatgttttgaaaagaatattgaatttgaccagaagggcattgctagtgaatttcaaagagagatttcagttgagctctgaactggaggaagatgggtgatagaaggctggagagggccagtaacaagggttgaaaaaggaaagagtattcaagcgtatgcataaaaagactacgggtaggttgtgtagatgatgacacactaagcctgggaagacaaggtttcggtgctaatttttatttctttaacaagggtgatagaaatatctgttccatatattaatactatacacaactgtttacctctcagcttttctagcaagacatatgggcttgtgaattaaccctgggtagccctggcattagatagaattaatagtgcttccatatgtgacctcgagacgtactgaaatgaggcaaccaaggaaatcctttatattgggaccaagagccaagatctcaacttgggatatgttaccccgagagttgttaccccgatactataataccatgaataataaccccaagggtcctgttgtctctttttcttcatgtcacttcctttggtactaactgtcaccatgctaacatctgcaaactttgaaaattctgatttattctgcaatatttggaaatttcactgctagtaattgtatttcctggcatggttctgatataattttctgtgtacacagtagcttttccttttagtgctgaatcacactgaaatccttgtttaacctaagttatagttgcaagggagctatcaagacaaataattacagtgatggtgaagtgaatacaagtcaaacatcccaatctgaaattcaaaaccttttgagcacaccaacatgatgccacaagtggaaaattctgcacataagtacttaacatgacctttgtttcatgctcaaaattatttcaaatattatattaaattaccttcagactatatatataaagcatatatgaaacatgaatgaattttatacttagacttgggtcccattcccaagatgtctcattatgtatatgcaaatattccaaaatctgaaaaaaatcccaaatccaaaacacttctggtcctgagcattttgcatgagggatactcaacttgtaatcttttctatgtatagccaagtttgcacatacataggttacaacaacccatcatgtcttaacctttcagtctggaggctggagttttctttttactttgattgtaaattgtattcagattttagaaatgtaaagcttagagaaatgtgcatctcaagattaagaaagctatgcccactgttaaagactggggcatggaaacaaagttggacagtgtagtagaaaggtcctaaacaggggatttggttcttatttttgctatcaagcagaagagtcaaaactgtaggagtctaaaccaaatcaggtccacctgggagtctttaaagttcagggttacttagcatggggatagtggtatagcaaatagttgcgtaggtttcactcgtgggctggtgataatatagtgaggattcacatccgcctgtaatctgggtagaatatttgtataaatcattttggttttttggttttctttttaaaatttttaaaattgttttgcttttcttaagttttggtttctacattaataaaatgacagaactgaattgcctagatgatattcaaagtttcatgtggttctgttagtctgggattctacagtggaattttgtcactacttttgggaagaagtttacctttggtggcctacgaataaaaaccacattggcacaatgccatttatcatatgggataattctgtgtgtttatataatcatttatgttcgtttccaaatgtgttaataaagtacagtatctcatttgattagctcagatgatgaaataggtcagagaggtattatgtttattttcctgatgaaataaaacatcgtagttagcatcttgaacaatttaaatttgatcatcttacttggtatgccagccactaaggatgaaatcctgccactgagaaagaaaacccagtcaggaaagctttctcacccttatctatctaacaaattgtacatattctccaagttctgacttgaatgctggtgaagcttttcttgataatctcttctaccgcagcagagtagaaacactttgatcattcttctcaggactcaggattttaattatctgtttaatgcctttcccttccaccctagtgaactactcaagtgcaaataccttgtcttactcatctctgcacctcatagcccacactgtacctggcatatagagatgcttagtgaataattgcagaattaaatgaaagagtcaaggtgatgtgttgcagagtgaggagaacttgggctttgggctggcggaaggaggtgtcttcgtttacgttttttagattgaaattttgccatgtatatgcgtttaaaaatttaaaacctagttgaataaaaggttggggggggcagtatccaggggccaaatctatctattaataaaataaatttgaattttttaaaaaaatggcaattaaaactcatgttcatggaaaaaattaagttcttattttagtttttccctaaacgatcttgccgtatcacataacagcagtcttgtagtcaatcaagactgacttcaagtggtgaaatggaattttttaattccctgaagagagaaatctttacctagttaagctttgtgttatcttgatgtttttatttgtctagtgacctcttctgattgaaagagtagttaagaaaaaccctttagtactgactttttcaaatttaccgtaatgtaatgacctctttgaaaggagaagtacagagtgtatttttcataatgttacttaaattctgtagacatgaaactagatataaaacccttatgttcttggctcatacaccactataaaccaaatctgcaaattaaatacaaagacaactacaaaaaaaaacaaaattcaaatgaatacaattattccatgtgacagatgatgtttaggttttgcagtagaaaaaaatagctttaggtctaattccattttaaatgtgtttctgtattttaacttcagtgataataaaagctgtgagtagtgcctcttctcatcagtaatgttatgcaggagggcattaatgacttcaaggccttgttggtaagttcaggatgagacatcatacctaaccaaaacacttgacagcaagcattcctcaaatacaggcttataagttttactgagatgtcatccattttgttcattggaagataaggttaatatcttgacattattgaaatcttcattaaatgattttctaaaccagttattgctggaaatgagaatggaaaaacattgcatacctacaattatatttactgctaacaaatgtttgcaaattgtactacacatgtaggacccatatagcacttgcatataataaagtacatatatggtattggctgttaggctattggcttttgaatatgcatgccatgcctgtattgccatatggtcgattcaaattccctttattttttactctttcttttacaatgaccatgaaacttatgctgtgtgtagtgtgccacaaggacatttggcctgaaggggatcttcacacagctgaagaagcagcagtgaaagcctagtgccagtgttgagacagtggctactcatgatcttgaatgtttatccttgtttttagattatctttgaagtgaaaatatgttctcaaaccttgtacccaacttatacatcctttttttctcccagcatatttgggagacattgttttagcaaatatttttctgatcactatctaaggagccaggattcagagatgtgaaaaacaaaacaagcttggcccttcctgaggcaatgaaagaccctttaacagcaagctataaatagattgatttgtgctgttctaaaggtatgcaaagagcactatggaacatattgaaaggagataccaattattgtgaaggtaagggcgaggtttagagcacataatggcaaagatcctgttgaaatagggtcttaaaggatgagtcagataagaagataggtttaaactagacagagagatggtatatgtaaagaccaaggtcatgaaagacattattattataatggtgagaggtgtgtggccctagatagcatttgccatgtgagaagtaaattggaaccccaaactaaaagtcttgttaggctaggtgtttagcccttatctcatcagcataggggagccatggtgatctgagaactgggagagtattcagggcaatattttttatgtatagcggttaccacattgtattacagtgttctccttcacttgtcattggagctcttcaagtgctgtgaccattagttattaatctttgtgtgctaagcttttggtagagtaactgataaaagtaatgcttagaaaacatgggttgaatgactaatcatgagtaaagaggatttaggagagaattatgacaatgtccttcggtggtagttttaatgctttgtgggtcacagactccattgtgattgacttggaaagcttttccttgaaaatgtaaatacatataacatttggcttatagttttatgggattcatgtacctctgaagccagtccatgaattcctggttcagaattcctccttaggaaatcatacccagacagccatcaccatcacaccttgtcatgaataattactgtctcttttagcagtctttattacgattgtgtctctttcttgtcatttccttgagtttctttcatacttaggaagcaaatagctgacctgtctatgaataaagaaagcgtttttaataatgattaaggtaaaactttactggtctgtaaagataatagacaagtatgtgaattaagccagcaaccaagaaacagctacttgagggagaacctgacattcctgaatttgagttgagcaagtgagttgggagtctgcagggccatcctcagacttggtttgctagaaggactcacaggactcagaaaagctgttacagtcatggttatagtgtattacagcaaaaccatacagttaacatcagcaaaagcaaaaggcacccggggtgaagtctaggagaaatcagacacaggtttccaggtgtcccattccagtggcatagcatagatggccttaattctctcaacaacaatgtgtgacagcatgcacgaagttgtcaaccagggaagtttgcttgagccttggtgtccagggtttttactgttggtcagtcacttaggcttgcagcatctgcatgacaggcttcagcccctcagacttctcctacccggccccccagcagtaataggtgttcactgtaaatcacattgttagaataagctgtctgacaaaattggtaccatgtgacccaaggcctcaggcatacagaaatattcttatcagggagaatattccaaaggttcagagctcatctaccaggagccagccaaggccagttttgaagacaagtctttcttgggaatatgcagggtttgagcaactcagtcctgctgagttaaccctttcttgtacagcaagttagctcttcagggagttagctctgtctatcctgcccctgtctgcctagccactccttttctaggtagagtggaccttgctgttcacgtcatagatggccattccgtgtacctagactcctttttattcctttgccaacaagtaattggaatgtttggatttaagaacatgtctgtgctttgcaatttcatgtgaccatggtgaaattatgcacacattctatcattgtgattcaacaagtattttttgaatgctgctgtgcatgaggcatggtgttagatggcagattgacagaaatgactaatacaggtatctggcctcaaggagtttacagtttcataggagaaagaaaaacaaaactagcaattctggtaagcagtatgtgttttggagagcacttaacttcatcagagagcatggttgaaggtgtatctgtgtgtatgagaaggtgttggtgataattagaaggcttccctaaagaggtcactcctggggttgagccataaagatcaagtagatacaagtgggcatgaagctagtattttgctgccagtcatttctgtagttaggttgcctatgtggttggagcatgtatgtattgttacaggtgtagtctgcttggcttccctaagagaatgccccagtcctggccagaatatacatgtcttttttagggtttgcaccaaggggaatagagagtgtctggctcagtacaaatctgtttccgttactccattatccagaaagccactgaaatggcattagcctacacttaatgggtggtagtgttttcacacattgcttctcaaaggaggagtatgtgaatgtttagtttgggcctggtaaaaaaaaaaaaaaaaaaaagtataaccattacaaatttaaatgtactttgtttctaatgggaaggcaaatgcttgccttgctttgatgaaattgaacataacaaaatttttctatacttggaagcaaaaaacttcaggaaaaaacctgggtccaaatgttgctacatttccttgggcttccacgtgtatgtggttcttaatataatttgaaacttctaagagcaacaaatagttgttttttgcttctaagagcaacaaacagtgcatagaaattgtgtgataataggatcaagaatgtattattagagtgaatattggataatttcaaactgttaaccttgagattttttctaagaatctttctctttttccagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggtaagttgtataaaatttttttcctagatactacaagaaaaactcttcatactctgtgattttagaactggaagggatcataaaaattgtctaatccagctcattccgtttagaggcaagaagtgacttgtccattgttacagacttataagagtaaccaagatcctgcctcctgggtatgtgttgtttaagaaggtggttccagggtggacttcctctgaggtctgttatacctaaaaggatagataaaagcaaactctgacaaagcccacaacaacatcttcagattgtctctactttgttctcagagtgaatttcttcttccttgtataatgctcctatcttttaaagcaatcacagtcttttaatgagtggggattcagagcagcacttaacagtctagatgttttcattttgtaatttcagcttgttttatgatctttttgcgtaaattaattatacatgatttctagatttttggtccttcacctgtagtttacatttaaaatttcctggggctgggtgcggtggctcatgcctgtaatcccagcactttggaaggcctgaggtgggcagatcacttgaggccagaagttcaagaccagcctggccaacatggcaaaaccctatctctactaaaataacaaaaattagctgggcatggtggcacatgcttgtaatcccacctacttgggtggctgaggcacaacaatctttgaacctgggaggcagaggttgcagtgagccaagattgtgccactgcactccagcctgggtgacagagtgaggctctgtctaaaaaaaaaagataataaataaataaataaaatttcctggcagaaccagcagtttgaagacttcataaactttttaattttaagattccggtttaatatggaagtctgagcacatgtatttaactcttacctctttccccagatcccaaaggaatataaaaatgagggcaacctgtattaatgctagtgggattaatggtagaatgccacccacatgccagcacttgtgaggaacttctgcaatttacagtacagatgacaccagactagtaaagaattgactagccatataagaaaggttagtcatcgaaaagtccagccaataacttagacaaaggatttggggggtgaggttagggtatgggggcaaactctcagttcccttttaggaagcacctggcttcagtgctcagaggagcagacacagttgctcactctccactcaaagttggtccaggccttgtgctaattaaaggaggaagcactgctgtagcgcagaaggaaaaggccagtcctccacctgttcagcatgataatgcagctcccctgtggtaagggttggtcggactacaatatctttgtgactttgatgaaagcatctgcagttataatgtggcaaagaaaaggataattccagaatttcccatttccatcatttgagcttgaaatatctgaatagatatttacaaaaccttgtgaagaagtcaccttatttctcatgtttctaatgaacatatataaacttctcatttccagctctaggataagcaaacagcaaaaaattaccaatgaaaagttaggagttcaaaagaagtagtctgaactagatagattagatgtcatcctgtgaaataggtttaccacatgatagggaagaactttcaaacagtacagggtctattttcagttattcactatgaaatgagaacatttcacagttgttaaaggttgctttcagaagaaaagcccaactgatgaatgtttttaaaaatgcactattgagagcgaacaacagactggatgccataattttatagtcaagtttgggacaagttttaagaaactgtgttacaattcagagaaaagacagttggtgagcatattaagagatatagggaacagatttagatgatccaatatgcttattatcagaattccagaaaaaggcatgaaatcataaagaagacagaataccaggcaaaattaatgaaaaaatattaatccaaacacatataataaaaagtatcaatttcaagaataaaagaattatataagcatttaacacacataaacattggttacctgtaaaaggtgaaaaaaaaaaacaggttcagattttctgcttaaatatcaaagggcaaatggaacatttttacgatcacctaaaattcttgaaataggccaagatttttcatatacaaaggcaacagccttcttgccacaactaagttcagtgtacaagggtgcatggactcttcctgaaagaaattactagaaataggattctgtatgataagagattaatctactgaagatcttaagaatgggaaagatgtgatatgaaagaaatggtggtaagcagtaaaccagtaagactcaggatgaatgtcaaaataattgtaattttctgaaacaaccagaaaatcttaattattaatagaagttacaagaaaatgatctggacttaaaagtccaggaggttaagatagtataaaaagtatatatatgcaaactctgttaaaaaaaaaaagtaaaagatatgttctgcctttaaaaaattggtggacctattggccgggcatggctcatgcctgtaatcccagcactttgggaagccaaggtaggtggatcacttgaggttaggggttcgagaccagcctgagcaacatggtgaaaccccgtctctattaagatacaaaaattagccaggtgtggtggcacatgcctgtaatcccagctacttgggaggctcaggcaggagaatcgcttgaacccgggaggcggaggttgcagtgagccaacatcataccactgtactccagcctgggcaacaagagtgaaaatccatctcaaaaaaaaaaaaaattggtggagagatatatactgaaatgtgagttgtttagaagtgatgaagatgtatgtggttttttttttcgcttgttttgatattttgttgttttttttgttgttgtttttcttgctatgagcatgtactggccttggaacaagaagacaagccaaacattaaaaaaaatatgatttttaaggagatgttaataggtattgttacaggttattggtattagtgacctgatgtgataagtggggaaggtcctatgatattggcggcagttggccttgtaatgatggctgaagaatacaggagtaagtgggtgctgacagagctggtgtgcataaaaggaggcctagtgggagaagactgattcacttgttctgggtttgagccctgtaaactgctgtaatgaggctctttggctaagtggtggcagtggccagctgcaggaattgtgtaggattgggaaaatgggggttgccacctacagtgtttttgtcgttgttgatgtttatttcactcgaggccctttttcagtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtaacataattgtttctcctttttcctaagacatctttttaaaattaagcgatacttattttattagttttctaataagccaacttgctagaatgtgagatagtataaataatattgcaggtttgaacctaataaaaatctttaagcttgatgtatatatgactgtggctggtttaaaatagattggaacttaactttaactgttaaagcgaatcaataagtcagctccatggtggtataaatttcaaagcgttctcacttgtataatctaatttgcttttcatcactgtgaggtagaaaggataagaacaattattctcatatagatgaagctgaaggtcaaagatattcacatgatctgcagctaacccattctattcaggattgtttagcagcttgatgtttacatttgaaaacaggcatgacagaaatgtattcagaattgtgaaggttatttactttttaaacattatatgaaattgtctttcgtataggcctggttttttaaaattaaactaatgaactcttatgtcattttctcacttgagaaaaatgtctaaccaccttcttatttaatgtagttttggcccctaatgacgttttcttttctcagttctatttgttgatatttgtggcatcagaagtagatgagctaattgtcagagtcatcccaaggtggattttggcatagcagtgcttcatgtttaaactgaaagggggttatcttttactttttcttgcatgtggtttggaaaaatattaagagaggaacactcctatcccctgtgtttttagaatttgacacttggtgaagaataaatagatctaggtttcaaggcaagctttgtcattgattggctgtataaccttggttagaacatgtttcctctttgggcttctgtttcctcatcaaaaatatggaacccatactgttgataaaaacacttcaagtggtttgttaagacttttaaatgagatgtactatcctttgaaaagtatgagtcatcttcaaataagggctaaattcatgaataaagtgaaaatttgtaaagcgtatataatgaaaatttcactaattttggtgaaagcccatctctattaaaaatgcaaaaaaattagccgggcgtagtggcatgcgcctgtagtcccagctactcgggaggccgagacaggagaatcacctgaacctggggggtggaggttgcagttagctgagatcgcaccactgcactccagcctgggaaacagactccatctaaaaaaaaaaaaaaaaaaaaattttcactaattttataattgagtgatattaaaggaatgttaaagcagaagttgtgactgggtaagaatataattctgaagcataaaatcacatctaatgttgcagaaagctcatataatgacaaatgtctatttattttaaggaaatgaatatatattggtatgtatgcatatccattcatttaagaatgaagaaactgattttattacctgaattattcttctatagaatttggccatatgtattcaataagagagctctctccttgactactaggacacacacaggctcgcactggagctcacgtcccagaaggcaagcttagggattcctgaaacagttgtgcaaggaagacaatgagagtttggacttagatgaagcagtcttagtactgaaggtgtgatagtctttaggcaggcctggtggacagaggttattttagagctttcctgggacttcccatttattctcagttcagatcttcaaaaagattttgctcattctggaagtcatcctgctcaaaactgtgataatcaaggaccagagtcacagaaaatcaggatggctacagatatttggaattaatccctcaaacctgttctcttgtttctaaacttatactccggaaagacacagcactcatgccacttgccacagtggaataagcccacctaactgattaaaggaattggtgggtgggtggcagttgattactggataagaatatcttcattaaccttttaagatataaacatgagaaacaatggaataattctgtttccattatatatatatatatatatatatatatatatatatatatatatatatatatttctagatccatgagggaccatagctctctgttctctgaaagcttctctccctcctttgatgccttaccctgcaaaaacttgtctgcattgcttgctagctctgtggctttgggcagttaaccaatgtctcatgcttgagttatttcatctttaaaatgaaagtgatggattctgtgcacatcattggattgttgtgagttcaagcaagacaaaatgtttgcatgaaagcacttggtaaattgtagagttatgtccaaatgacaagtgttactcttattgaaaacatacttggaggaaaaatctaacatacagtatcagttgaccacattgtacaaaacttagtttaaggcctcctttgcctgtcatagttcattgtgtactgaattccctccaaacctatccaggcagaagccatcttctggtgaataatagcagaaaatgccatctgtttcccttctattcattataaatccttaatgccaccttaggcatgagactagtgcctgtgaataagtaaactgtgtgtttgtaatactctgtttttagttctttcattaattgaggaaaaggtataagcatttcacattctgaattcatatgtttattacttagtaccgtgaccataattaaggaaaggccctgtctctacctctaaagactgtgcttttaacttgggaacttcagggaatacaatgaagagctgggttctggcagctgtacgccaagtgtgtgagtgtgcacatgtgcatatgtgccagcttttgtaagtgagtcttctaggccagtgtttgttatggcgtgtgcagcttatgagctcttgtaatatatgcatgttgttcgggtcttatttcctgttcactgcatgtaaagctgtggagtccctgtttcccttttgaagttttctctcaaacagttctaaaggtacagaagagtagagcagagaatatagagatctaaattaggcctattcagttttgtctttagaagaaaattgttactttttttttttttttttttggagacggagtttcactctgttgcccaggctggagtgcagtggtgggatctcagctctctgcagccttcacctcccgggttcaagcaattctcctgcctcagcctcctgagtagctgggattacaggtgtgcaccaccatgcccagctaatttttgtatatttattagagaccaggtttcaccatgttggccaggctgatcttgaactcctgatctctagtgatccaaccacgtcggcctcctaaagtgctgggattagaggtgtgagtcactgtgcctggccaattgttaactttttaaaaatgctcaactattcatgtgaagtaatccaatatagataatacagtggatcaagatttgctttttaattttaattgacatctagaatccagtgataaaggggaagacaaaacctttcctcgtcctgttggcctttcttgaccataccatttacacaagtcctgaacctgtcaggtgttttcagaatttgtgtttgtgattcctttttcttttttattacttgtctttgcaatttccagattagtctcctgaaattaactcttaagtgtacttttaagtctgtggtgtggccctctacaaggctttcataaaatgtaataaattagtatctacactaaacaacataattagaattgattatacatagtgcgaaagagctctatgatttaaataaggatttctgacagatctgtttctaactagcagcctccttataaacacaaacagttatttatagttatactgctaactactttacaggaggtggggagggtagagcaagaggaagaaaggacccgtttgagaaacttaagaagaagagcttctgatcgctttaaagatttaacgtttggatttataagcatttcacatcagggaaccaaagagagcagataatttcatttactgtcattgggttaatttgatctagtaagcagctttgagtatagattataaatgacaccaatttatatgtacatagattgtataaataagatatgagtgaggaacatgatgtacactggcattttctttgttagtgtcaatgtaatttaaaatgacacttaccggatggtggataggatattaagtgatggtctcacatatagtgccacttaaatgttgcaggtaagttagtaaacccttttaaatgaagtaagtatggcaatacttaaaaatacatattttggagaaagccaagttccattagtggaaaaacagtgctccattaccaaggtaagttacttagccttgttcttcaagatactagtgttgtctatgtagccagttgtcagcaagtaaattgctttccttgaaatagtttctgtggtgatttttactgacttatcaaaaagccagaatttacttctgtgtttctgcgttcacatccttttttcctcccatcagtgaaactgttacgagattcatctttctaaaataagattttaaaattatcttgcttccagccatggccctttttctcagaaatctttaaaggttcctcttttacctaaagctcttcattggttattttgagcttggtattcagtactcttcatcttctggtgacagcttactttctcttttcactgctttgccacatatatcctctctctgattgcccaagctgcttccctaaaaatgtgtcattcatttccctctacctttgcctgcacattcttcctgcctaaccaccgtacttaagggatagtcaaaattcaacttacttttacaaagcctaccttgaccctctagcaggagtttctggattcttttattatatttattatcttattttccttttttaattagttattttattgcaaatataatatctccccagtgagataaattcctaaagggatagcttaaagtatcagttttctgggtcactcattagtgcctatcatgatgtttgaaacatgtaatattgttgattgtgttgagtactatttatttttacctttaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaaggtctgtaacatttgcttttccttatgttatatataacaagatctctttaagtctttacagatatggtgactaaccatcatcaaagtagatgagacatagatgtctctcatgtagattagacccattaagtcgaatacaatatattagtaacttttagaactaggaacttcttcaagattttcttgactcttgatagcattcctaaaatctcttaatgttttataaaatataaaagagctattttaaaaagccatgtactttgttggtttagtttagggcagttagttattgagagtactcatgatatagaaaagatatataaacttgctcaaaattttgagaatagggctcagatagctgtttccttttaatctcttcctgaccagtaggatgtttcaatatggactattgaccttattaatggggagagtaaaaataacttgtcagtgttctgagttgccaagggctaaatagatgaatcttctggcaaactcaaagagataaattgtttcttcaaccaccctggtaactgtacggacacttttctgcctatcatgctggtgcctgaggcccagcgtcaggtcagatgctgaagaaggaaggaagcctgtcagcagggagtcagaatgagtggggactgcaagcagtgaccttagactgtgctgctgccactttcttagcttccgttaatacctttatgcccatgattcctactttttttttttttgagatggaatctcgctctgtagccaggctggagtacagtggtgcaatctcggctcactgcagcctctgcctcctgggttcaagtggttctcctgcctcagcttctcgagtagctgggactacaggcgtgcaccaccatgcccagctaatgtttgtatttttagtagagatggggtttcaccatgttggccaggttggcctccatctcttgacctcgtgatccacccacctcaccctcccaaagtgctgggattacaggcatgagccactgtgcccagcccccacgcattcctatttttactgcctctgtcagagcacttgtgtttcagctccactcttgtcatccctacccctgaatcaaatgtatttcccagctttcctatttaaaaaaaaaaaaaaatgctgtcattatctcttagcttggccagacctgtagtcatctttttccttctcccaccttccatttacttcagcaatatttatttattcaaatattaacagtgtttaacctcagttggtaattatgggtgatttttattatttttcttttagcttctctgggttttcaaatttatttacaagcatgtactgcttttttttgttattgacttttatttgtagaaaatttccaatatgtagaaaagcagagtagttacagtgatccctcatcgtccagcttcaacagttgtcaggtcactgccaatcataattgatgtctgatcccacctactctgccctaactgtgttatttgaagctggtcccagacaatatgttttcatctgtaaacacttataaaatgtaatttgtatcttcaaatgatgaggaaatgtttttatgaaacaaccacactaccattgtcagttttttaaatgttatcaaatatccagttaggttcaattctataattgtctcctattaaaaaaattatttattcaaattatgattctaagtccacaagttatatttagttgatatttctcttatgtgtcttaaaatttaggtccccccttcatcttttttctcctctcgcagcttatttgttgaagaaattggattgtttatcctgaagggcctatcacattctggattttgctgattgcatttccatagtgtctcttaacttgttcttctatcttttctgaaaactggtagttagatttagaagctaaacctaattggagttttattggttttctcaaaatacatactaaggatattatatacatcctattgcatcatatgtggaggtgtatagtgtttgattaagacggggcagtgaggtatatgatgaatgtaggtagcgattatcagtggcacctgacaatgtaatacctcttaagttaaaaacaaaacaggccgggcacagtggctcacgcctgtaatcccagcactttgggaagccaaggtgggtggatcacgaggtcaagagttcaagaccagcctggctggccaagatgatgaaaccccatctctactaaaaatacaaaaaaattagccaggcatgatggcaggtgcctataatcccagctacttgggaagctaaggcagagaattgcttgaacctgggaggtggaggttgcagtcagagctgagatcgcaccactgcactccagcctgggcgacacagggagactctgtctcaaaaaaaaaacaacaacaaaacaaaacaaaacaaaaaatagtaatcagtctgaccaaatccttagttctcattttcgtttctgcctttaacaccatttatttcctcccccaactcttaaaacaaccttttctttatttactgtgtttgatgaccctagactttccttgttccttcttacttcttcatagttgtctttgttttctcaactcttactcttctcactggttcatatgaaggtactgattttataagtggtaatttcttccttaagaacatagccacattcatggtttcaaactctaccatgttggcaactctcaaatctccatttgaaagcttaaacctcacccagggtctggattttgtcacattccaagttacaaacacagcagcacaaaatgttggtgagtctgtgccctgaacttctaaccaggctgatgctgtcatctggtggtcaccatgggaactagctgaccctactggctcttccctactccccttctttcttctttgtcaggggttaatgtactttctctgagcctagcccctccacctcagttcctttatcttctcctgatttagttaattccacccccggcagccctttatatttatggccccttacatataaccttccttctatcttgtccataacctgtggtttccctttcttccatctgcctgtcttccactttgtttcttgtatttgtgagcttttcaaaattcagtaatggttaagaggcatgcaaataagctagtgatgtgcctatatcaaggaaaagcaagggtgcgagtttggtcagaatcagtttataaagttcatgaagaacaaattaatactaagtccttttaaatgtacccagaaatctcctccagaatcttctgaaaagtttctattcctttcttaatctcttctaatcagagttggttttcttcttcaaccaaataccttcaaaatagaagctgtttcatgtcaatatggattttttcttttggtttacaaccagcagggaaagaaagagcacagtttatgtacttcttacctaaagaatctagcattccgttttttaaatcttaacagtcttacaaagtaagactttattcttgtataaaaggagaaacaggctccttgtcagtaacaggcaggccgtggattccaaccaggttagaatgactctaagcgtccatcttttactggattgtgctgtctcctaatgttgtaatgctttttttcttcatggcttaattaagcatgtggttttccagctacttctaggttaaattagattgtcgtggaccagtctagcttaggagcctagctagtgtctttaccattattcctatgagaaaacatgttttaaactcgtgttttggcttacagaggaaattttggaacccacgttcctcgttgtttgagtttagtcccagcttttccagttttgctcctgacatttcagttcctatttcagcttccccatgtgttagaggtatcactatttctgtttttctaagctagcaaccttggaatcataatcatcttgtcttgcgtctttgtgaactgtgtacacaatctgtcactaaagcttgtcatttcttgttgaaactcactttcagttttgtcccatactcttccattcccactgtggccacactggtctccggagacttctcacctccttgcttccctctctgttccttccttttttttaaccttctctccttccaggaacagccactgagcacccaacccgacccagagatttttctaggcacttaagagtgccagctctgataccaattatctgtgaagactcaaaaaagtcaccatctttgtctcttaaatgggattaattatacttgccttatctcaagaagaggggcttactctgaggaactaaaggatgtgtacataaaagtataaaacaaacaatgtagaagaaaatgtgaaggaaatacagacttaaggtggcattatattgcagtgtgtgactcaggattgagagtaaaaagtaataaccattgaacaaataaatcataaatggtctgcagcccaaccgaaatgttaattctgttttacagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggtaattctataagcagttctattatttaagctttaaattttcatgaataatgtctatgaaaatagaaggtggaggctgggcctggtggctcatgcctataatcccagcactttgggaggctgaggtgggcagatcgcccgatctcaggagttcatggccagcctgggcaacatgacaaaaccgcatctctaccaacatacaaaaaattagtcgggcatggtggcatgcacctgtagtcccagctactcagggggctgaggtaggaggattacctgagcctgggaggtcgaagctgcagtgagcagacatcatgccactgcactcccagctgagtaatagagagagaccctgtctcagaaaaaaaaacaaaaacaaaaacagtaggtggcctaactggagatatttaaaacaaattttttagatgagaacattttatctttcagttcaaaatttcaggtagagctaggaatctggaaatttgtttagagattctctagtcgttgtaacaaaactgtgattttttttgagttcttaaaagtagcattcaatcttatgatttttgaggatctcagtttcagaattcaggtccaactgaatatatttttatgtgtagtatcaaatgaaatgtgaaagtgctttgtaaacatcaacatgctaggtaactgttatctggccatctaataattatatttgaccttgagataaggagactgcatgagatagttttacagttgaaaaattaaatactaagttttagttatgacatttgtatgctgtagtttttgtgcatgtgggatttcagatgccagtatatctctctgctctagcagttgtccacttgcaacccaatggctcccccactccccactttacatacagcataagtgctagttcacatcttagctccatctttgtagttattattattattgattgtaacagttttattgagttataattcacatcataaagttcacccacttaaagtgtaaaattcagtggtttttagaatactcagagttgtacagccagcaaacactacagtcaattttagaatatcttcactccaaagagaaaccctgtagccactagcagtcactcccctttcctcccaaactccttagccctaggcaacaactgctcctttttgtctgtagatttgcttattctgcacattttatataaatgaatcatacaatatgtggtcttttgtgactggcttctttcacttagcatgttttcaaggttcatttatgttgtagcacgtatgagtacttcagtcattttgatggctaagtaatacttcagtgtatggatatggcatatgtcatatatccgttcgttgatggacatttggtttgtttcttttggccattgtagctaatgctgcagtgaacatttgtgtacaagttgtatgtagtttcatgttttcagttatcttgggtatatacctaggagttgaattactgtatcatatgataactctatttaatggtttgaagaactgccatactattttcttaaagtgcctgaaccattttacattcctgccagcagtgtatgaaggttccaggttttccacattataattattattttttaataacattttctagtggttagcatcaaagataatatacttaatactgagtacattgcagttgatagggaagtgatgttctacatgcttggttcctgggctgctggaatatcagtctatggctaagtttcttaaaaagaattcataaggcaccaacagataaactgataactttttttttgccccagtctttgagttgttcatcttttaaagcatgttattgtccacattttctttaaagaaatataaattcagtgacttttggtgtagtgattcacttgagtttaataatgccgtaagtattgtaggtcatgtgggctgaaatgctttgataatttgggttgggagaagagacttttgaacctaaagatgtgagttgtgattggtattaccttttaagcagtcatgtttaatttttgattctttaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtatacttttgaacaactatatttaatatcttctgaaatcaccttttttcccttctctttcatatatacatatcattgctgaaactcagcttaaacttgcactttattagattgccaacaggtaagaagatctcatggtcttgcctgctctgaagccagagttacctgacttaaaaagatgcctgctgatgaaaggttgcccttccagaaaatatcattaggcatgttaattataataacagtagtaactaacgtttatagggcacctactatgtgccaatcgtctaataggtcttttacgtatattacctcatttaatcccttctcaaatactgtgcagtagctagccctgctattttcatatttcagttcctaaaaatatgcctttcttgctttcttagaacttttgcacatgctgtctcctggagcatactttaccctactgtttctcagcctcatacccacctttcccgtaggaagttttttctagtcctcaaaaatcttaggagtccctgccagggactgtcatagcacactgaactgggaccgttgaggcacttatgcgttatgttgtaactgtttatttatttgcctatatattctattaggtgcaagctgcttgagagcagccttgtattcccagcatccatcacagtgcctaatacatggtagatcctcagtagatatttgttgagtccatgagtcttcaaaagaacttaattaggtaggtgttattaccctttaattcacagatgaggaaaccaccttgaggaggttaaataatatggccagcttcatgtggatgataagccgaagagctgagatttgaacctgggcatttctgacccaaaccccttatcacaagctgtcacagcattttttcaaactactgtcttggccttggagacagctggagagccagcagcattagtctattcaaattgcatgtataattttgagatttctggattccctggggactctcaattttcccatccaagtactaagcaggcccgaccctgcttagcttccaagatcagacgagatcgggcgtgtttagggtggtatggccgtagatgactctcaattctcaaccagctaaggggtccttgtcagtggttgctgtaggtctctgtgggtcctgacccataattttggtaggtttttgaagcttcagtatgaggactggcattcttttgtatctattatttttttccctggagtatattcgtgcccttcctttcatcctcagtgagaagacttctaaattaaaatgcatggtttctacctagtacgtgtataggtggtgtacattaggacacctttaacagtcacaattgttatgtatgtctttcattggaaaccaagatcatgaggcagatagtgtgaaactgctattttagcattttgtgggatttagttgacatcattaatgtgcaaaccagtgtggatatttaatatttttcttgagtctaatatttgttatgtaatattgtgtacatatgtctatgtataaagaaatgtctgaaaggaggttcatccaaatatggcagtaaggggatgattttcaaagttctttttgcaaattttttttaggtacatggcccctgaagttctcgatgattccataaatatgaaacattttgaatccttcaaacgtgctgacatctatgcaatgggcttagtattctgggaaattgctcgacgatgttccattggtggtaaattgctctcctctcccccaatagtttgtcatgagcagaagttgttcaagaattgtcttctttttttaattgaatgaaattatgtacagtccattatctgaaacaggatgtcaccgagtgccagagaaaacaaaggcgatgaaacctttgggaggggacagtgccatggtgtgcacatgcacagctctagcctagtgtattctcttcctgtttccatttgaatctggagactcatcagaacccaaccccttgttatattggaatatagttctttagaatggacagctgcttgagaggctcacctaggaagctgtttctagcatgtacctgggtgtcaaacttattttttttctttgagattgtggttattttctccaacttgatagttacaattacatacacagaatacaattatgttaccattgtgttgtattctagagttagtttgttttaacttctagctttttagatggagtatttttaatgtttactcaggaaacagtctcttaggcttggggacctagacttggctgagacctagtgccttaggtttttgaagcagtgagggacagagtatttctctgtattgtagtaaataggatatattattgacagatgcaagtagagaaagggacttggcaccttaaacttgcctcataagattcaagtctcactgatagggtatatatatccctgtgcaagtgagagcctgtgcacttacagaatagaatctcatttgctgcacaatagggttctaggggaaaatgtcaatctggtcatcacagctcatagtttactgtcatttcaaataggctttattgatctcatggcaatacttagtttcaaggtgtgggtggattatcaactcagggaagtggcttgtggatacagatgtggatgagatagagaaagctgtaatctctgttccacatacctactttagtaatgaaacactgtaataggtctctcaggtgatcttttaatgccttggcattagctgaataaattcatcaaaatttaattttttttaaactgatacaggaattcatgaagattaccaactgccttattatgatcttgtaccttctgacccatcagttgaagaaatgagaaaagttgtttgtgaacagaagttaaggccaaatatcccaaacagatggcagagctgtgaagtgagtatttctttttgatattaggcaattttctaaactgcttctgcttagtaagcaaaagtttgctacttttctttaaggaaaactttaagaattttctttttcatagcagtcaaaccaatgtttaaaaacagaataatttggttttcatattcaattgtaagcacattgaaagggccatggaacatttgcagtggcctttagtgtatcagaacatagtttagatctgccgggcgaactaaggcacatatttttaaatgaatgcctcccttcagccggggcaacccagaacactagacagttaccggacatgaatgaggagccctgtattctagaccagcctggctaccatttcaagggtctgactctgaacaaatccctttagttctctggactttaatatccctttgcaaggtgaggaactcagataaggtgattacaaaggtgtttcaaatgattttccgttttattcatctgattgcccagataaccgttaaccaggaatttagggaaaatgcttttttccagcagtatctgagctgctcaacttcagctctaacaaaaagttttagaaacgtttttgtaattgtaaatttaaagattcgtaagatgaattttatttaacctctccttaattgctagctgttactattacaatattggtgaagcagagcatattcctccaggtttgaagatttgtagcttaaaaaggctataaaaagctgttcagttcagtagttgattttacgtcttaaactattgtaggactcagcagaacctctgataagcaagagagcttgctacctccaacaaaatcacatctccaggcccaaataaataaaatgtatttcagcatgcttaaggaatttgcatgtgacatagtttaataaatgagagtgctgctagattttgtcttttagaaatttgatctacttgggaggctgaagtgggaggattgctggagcctgggaggtcaaggctgcagtgagctgagggcatgccattgcattccactttgggcggcagagtgagaccctgtctcaaaaaaaaaaaaaaagaaaaatttgatgtgaatacttcaaagtacaaacttaaaatttcagtgtgaggtcagatttcttctttgctttgcccagctctggtttaggattcggccttttcaggtttgctaaatgagtcactctttgtccacctgctttccagcactggcaccagtaccctattgatggaaatttatgtaatttctactcatttgctattacaaataatgcttaaacaataacaagtgtatatgtcatttaaaaagaaaatttacacgtaaaaattcttatccagaccaatggaaaatggtgcatgcattaatttttttttttatattttcttgtaggccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattgttagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcataga

SEQ ID NO: 15638 - DNA, 69764 bp, Human
  misc_feature (1)...(69764): n = A,T,C or G
tcctgaagcctccccagcatgcagaactgtgagccaattaaacctccttccctatgaattacccagtctcagggttctttacagcagcgtgagaacggtctaatacagacacctttggaatatccaggtggggttgccacatatggctgcaaatcaagagtgtgaaggtcagaaagttaactaagaccaatgacagagacatagcaggcttcagctagaagtggcaggcagtctgcatactgagaaaatagatgaagaaaaactcagcaaatggagaaacatataaagcaagaggagagagtgtagggaaagaccttaaaaaagagggacaaaagagggaagaggtgactcctaagagcggagggctgaaaagccaaaaggaggttaacatttctaggaaaacgaatcgccagtgtcaaataccacagagtagtgagtaaggacaggaacagaggacaggccctgggattcacgatctgcacgtcactggtgacaacgtccaagagcaacagactggggggatgtggaactatttccttcacggttttgaccagcgtgcttactaataaatctcaattcccttcatagctctgatttgattgttttctgcgaaggattctcagttacacggatgttatcattgaacattagatactttgctttccgaatggctgcctcattaagaatcgcaatttagctggatgtgtcctcatcggacttccccagccttctactcactctcaccttgcccctactctccctacctcccaaggggactggagcatgatttttcagggattgtggtgcacctctgccatatggtggacattcaaagaaaatttaattactaatgtgaatggaaaggatttaggaagtgggtgggaaaacagtctcctctcatattggaaatacagttacttcccctttcaaaataaatataagtatttatatttcaaagttaaatataactagacgatagttgtaccctatagtgcagtatgacagggaaggtgtaggctttggtgtcaaaccaacctaaggactgagtctcagctgttgcgcattgcacacctgcaaagacgggtaatattctttacttgtaaggtggttggaagagctgaactgaataacgtggaaagagtcgatcacagggctttgtgcagaataggagggcagtataaagtagcaggggggctattagtactggctattgtttactcatcctataagctgcttattcagaaaactacagtaactttccaaataatttgggcaggaaaacctcaccacctttcatctagaaagatctaatcacttctttgaacgccattcacccaagagggcacaactcctaccaacatgaaaagcagatcttgtgaaagcccacttgctgccatctcccagccatttctccgacttcagaccggtgaacatcgtgcattagaaagtgttgttacatgtccaaggaaatctacatatagaacttttgccacggaaatgctgaagtcctattctgacagcgtgactccgatgtccacttggcaggctttgcgcaaagaattaaggcgagggtggagagggtgggtagggtggggacggacaaagtgagaagggaggcgggccaagtgaccacacgtacatgaagcctctccagttatggccaaatcattttttaaaaataattccatttcttccccaccctttggtcacttcctaacgccggctggggagtcacatgctaagctccaaagtgagcaacagacaccctcgtcccaggtcccatgctggcagaagcggacccgggccgagggatcagccctcccacttccagcggaggagcccttcgcaaccctagcctccagcccggggcgaagtcctccaggcccgcgggggcgcccgcaggctccgccccttcttcggctagctgcccgtccgtcccgcccctgctccgcccttcccgcccctgctccgcccatcgcgcggcggccccgggggcgagagggggcggagcgtggaggcggcagctggaaccgcgcagcgcacgggaacgcgtcccgctgcttgggtcaggttcgccggtcgcgggagccccgccgtgcagtcggaggtgagtaccgacgcggcccgacccacgtccccaggcgggagcgccgtccaccctgtatccctcgagagtcggtgcgggcctttaccgaggtgcccgaggcagtggcggcacgggggacacggaggcgagcttggggaggctgagaggagaatcggggacgtgtttctggcgactgacgtctccaccctgtccccagtctatgtcatgccggggagagaaaccagggattggaagtggctttcctagacccttcttagccttggctgtgcgtgctgtcctgaaagtccttgcctagggtgtgcggccagtcctgggagtcctaaccccgagggtgtgaggcccgcactgggagtcctcgcccaggcccggctggctggatagggaaacccttgctaaagttgtgcgggcagatccgggaatccactccaaggggtaaagggaaaatgggatgagggggaagagacccttcgtgggaggcttgaacacagagcccaccatgatagattcagagatctagaaaggagcttgggctgcagttatgaccaagtcatttttttctagattcagctagcacatcataatggcatcttccttcttgcaacacatgtaactctcttccctgggggacaacctctaggacagaagtccccaaacttttctggtactcagtactcctttacactcttaaaaattagtatcttaaggagcttttatgtgtgttatatctatccatatttataatatgtaagtaagactgagaaatttgtactataataattcatttaaaaagaatagtgaactaattatatcttaacattgcctatttttatgaaaaagaactatatttcccaaaacagaaaatgattgagaagagtggcattgttttacatttttgcaaatctctttgatgtcaagcgtaattgaagacagctggattctgatagctgcttctgcagtctgttgcaatatcacatatcatgtagcctcttgagacctccactgtatactcctgaaaatgtgtgaatgaaaaaaagcaagtaacattttattactaggaaaatggttttgactttggagatccctaggagttctctgcaccacactttgaggatgctagtgtaggaaatgcttcagaggcttcattcattgggcctgcttcttgtttgtgatccttcctctgattgggaacacacaccacctcatgccatggacagtattaacctctggtatctggaaccaagtttgatctcactttggaaaccatgtactaggtccccacgtgaggctgtgatgaaccttgccagcctcctgaaaagtcagcaaggcttcgcacatgcctttggttgtctctgtgcttgcagagctgacctgtctgtgcatcaggattacaacagtgatgtggcaaacaggacctgtaggctcacaaaagtgccagtggggagaccatgccaagtgtgtaggggttcctgtgagagttaccaagtagtcaggaagttatttccaaaagaacaaggaggcatgcttttgccttcccttgcacgtgttcatttctgtttgcagttgcatggttattagccttgagtttattggaataatgatttccagtcttgacgttctttcactttccactttcagagggtgtcactctgagtggtgcttcctcagcccctgtcaaaaagcagtttccaccatcctggagtgtggtaggtgaggtccttcacgggactctttccttagcttcgtgccttgtcagaacaagttcaagacagatgttatgtgtatatatttgggaggaagaaattttctaactccatcctcccttttgttccttcatccatagagcctcttgtgctctgatggatcagtttaaatgctacagccgatacttgagaaatgttgcatgcacatgagcgtgttgtgtgtgttgcacagtccacaggtgaggaggaggagaagtccacaggagaaggaaatgggatctaaactctgagcacctgctgtgttctttgtattaaaaaattccactttgatggtggggtctcattccttcattctttcagtagatttttattggccacctatttctcatgtgtccagttatgtgcgggatgccaggaaagtagtgagcacaaaagatgcagtccctgtctttctggcaattatggtctgatagctttgataactgctggttaattgagatagtctattatatagtcagagtgtgtacatgaaagctggtcctgtgtgaagagcagtaccccctacctaaagtgtgcttcaaaggcatgtgctgaagaaaccagtcccacactgtgaagatgatgataaaaaccaacgtgtatcaccacgtgcctggcaaagaacttcctttgccttctttcccccactcttccttctacataggaagtaatttcctgtgaggcagccagattcacagggaaattacctccaacctggtgccagtcactgggccagcctcgggttaagacactttctctgggtctcagtgtctttgactttaaaatgaggagttaggccattgatagtaagtgtcccaaggagccagtggtttcagagctggtttatactagcatttgtgcatatctcttcctaactccgtgttcagtggcaacacattttttagattgaaataagccatggtgggaataataacaccatggaaattggcaaatgctacatcagagcttttttttcctcttggagttcaagttgttaaacctttgccagctgacactgctattgtctgagccaaggtgcttttggtttgtttttttagtagaaaacagactctttagcctagacaaagatcctagatatagggtgtatgattcaagtcctctaaaatttttgataaggaaaaaaatctgttttcatcatattctaaaatatagatcagcaaactttttgtgtaaagggacaggtagtgacatattttaggctttttgggttatggttatacagtttctagtgcagctactcannnnnnnnnnnnnnnnnnnntttctattgcagctactcagctctggtgttgaagcacgaaagcggcaatagacaacatgcaaacaaacaagcatggctgtgttccagtcaaacttgatttacaaaaacaagggccagccatagtttgcagactcctgacctagactatcagaacaagaaccatgtttcaaagagagagttttatggaaaaggagattcttcaggactttatgcgtgaataccagaaacttgagtctccaagatggacgtagcgggcagtagtaactgtagaggatttggaatcaatcatggaagactccatagtaggttgtttaaaggaaggccaagtgtgttgaagttttgaggacagagccacatatgggtcttattcccaactccctccctggagccatctcagatgttatgctagaatggatgtacctgcagtctaacccgttgtgtgaattttgcatattattatgcaaaaactagtagtgtctctaagagctgtcttgattccaggggcagagacaaaggaaatgttaaaaaggatggaaaggcccaggcaccgtggcttacgcctgtaatcccagcactttgagagtccagatcgcttgagcccaggagttcaagaccaacctgggcaacatgacaaaaccccatctctaccaaaaatacagaaaaaaattaaagccaggtgtgatggcacatatctgtagtcccagctacttgggaggcagaggcaggaagatcacctgggaagtccaggctgcagtgagccatgattgcatcacggcactccagcctgggcaatagagtaagaccctgtctcaaaaaaaaaaaatcctcgttatatatgtatatgatacattgtagagtacactgtgtgtgtatacctgtgtgtatgcatatttgtacatctatgtgtacataagttgtgtgcatgtgtcattacatattccattccatgtatttaaagtagcatcatgaatgtttagaagatagaccagtagccagttctgggcagtggaatgaggtagaaggaagccagagaacttttgttacttttcataataacagatgtgtgcctatcttataagggaggatagcctgtagcattcatatattgcttttacaacatagtaaacctaaaatcccaacaacgtatactttcggaaggaaaatagagttatttctctgataggaatgttgccaccatcctcctcccccaattaaaaaaaactgctttgtcatatcacagctctgaacttgtatatataatattagtataaaaataagagagagactctcaagtcaaaacattttatttaacagtattaatgtttgactcttgtccagggttagtaatactagttcaaagtgttccttagcaagctattgtgcagcctttacactggtgttacaaaatagtgttgtatagtttttaaactaaaaaaagcatgttacacagcagtatttccctgtgattctgtatttctgaggagagaaagcatgtgcatatatgtacgagtgtgcccctgcatgtacaaaggcagcggatatgccaaaacattgagtgcttttctctaggtgatacagcacacttgctttttagattttcttcattttagcttatcggggttttcaagcatgaataaatattacatttgacattaccaaaatcaacccctacagtatgtttacacctggtatgttgaggacagttcttccatctttcttaggctgtcttaccaccagcttacctggtagcagactccagctactgtctcccagtgagaaatgtgaggagtgtgaggcatggcgaaccgaaaaacaggcacacttaccatgtagtcacattgtgctgtgtctgcttcccctgtagagtctgtctgaccttggcctcgccctctcacttcagttgactggcaccatcagctgaccgtctccctagatcgactggccttcatttcttttttttttttttccttttctctatttttaatggaaaatctcagacatacaaagtggggaggagagtataaaccctcagcctcaacgactgtgaacagtgataattggccaattttgtttcctctatactttttttttttttttttttgagacagcgtctcactctgtcacacaggctagagtgcagtggtgcaacctcagctcactccaacctccacctcccgggttcaagcaattcttctgtctcagcctcagaatagctggaattacaggcgtgcgccaccacgcccagccgatttttgtattttcagtagagatggggtttcaccatgttggccaggttggtctcgaattccttacttcaggtgatccgcctgcctcagcctcctgaagtgctgggattacaggcatgagccactgcgcctggctcttcccttatacttttcttcaacatcacctctttttctttctggcaagagttggcatcttcatttgcagctgtataaattaacgagaatcacttattaggtcttttaggaataagcatgtattgactgctgtagcaaaaatcttaaaactgttctgccctaatgtcagccatactgaactgctgagcagcccctgaacacttgctgcgctatcctgtttctctactttggtatttgctctttactctgcctgtgcatctgaattcatcttccacttcgtagttctctgtaaagcctttcttgaatcccacttgtagctgtctctttcctttgacttttcttataaccctcatcctattgtatttgtgtgcttatcttagtctccttgtcagattgcagtcttcaaataagagaaggaatgtgtgcctatcttcttttcctctatggtatttagcaatgcgtaatacaaagaagatactcaagaaatacatgctaaaataatttgaattgattaagttcactggagaaaaattttgagtataaaagaaatccatcacattaaaagaaaaattttcaaatatgacctaggaccaagaacattttctttcatctgtttggattttaaaagattttaaagaatcatggtgaaaagagtcttaaatttgagccatgaaaagagtcttaaattcgagccaatataaaaacgtagctttctaaaaagaaaatgtttttaatgatcttttgtcattttttcacaaatatatctggagcctgtgggtcttctctaatcatacaatgcatcccctcacctccccccaccaggcgaaagacctgaaaaaataaaactgaataatattgggtcacttgtattggataagagtgattcttgactatattttaaatacttgttttagaatgtatatttaaatcttcagtaaaagaaacaggctacatttagagcttaccataggtaagtcaatagcaatctcatgaattatggtagctcacggggatatagttcccagaatatgcagtgctttcgtgtgttacctcatttaattatcctagcagcccttgtcatctgggcagagcagtgcagacagacattgttacctaaaatctgcaaagaagtaaactaaggtttaagaatatagaagaaatcttgtcctcagcagcaagtggcagagactgactttaagaatcaattggaaaccaagagtctttgggattagatgttgcaaatatgtgaagacgcaaaagcatctaagcatgtctttgggagacggaacaggttcttgtgccccttaatgccatagacctattgaaacaatatcacactctctgagccagttgttcctcagattcctcatgttctgctgttatctttggtgtcaaaaattaatccaccttagatgaattagtaaggctgtttgtacatgagtgctggtgtggttctctctcatcctcttgtcttgatctaaggagaaccctgggcaagcccatctttggatagtgtaacttgtctgggccactgctcgcaaaacagacatgtatggaacacttaattattcaacatccttgtcatcctttctataactgctattgtggaattacatggcaagttgcaagttgtggcatagttcatgaagaagaggtgtcagtctaggaaagtatcctcctacatgattagcaggtttgaatttttggttcagaacagataagataaataagccattgccaagaatctgcgatgtacaagagctatgatgggtggacatttgaaaggtacaattttgtattaacggcagaatcaaaagtagcctcaggattggttttaaggatgttatgtttcataaacccttattttcttagataagaaatcagtctaagtgctaataatgcctatattatttacatcaacccattctttaaaagttaccatacaaattttgccaaaatcaaggatgttttagggaacatgaggtttaccatctcgtccccatatatgtgctttagagcttggagattgttttaaaatgagatttattttttttaaatgcatttggttttttggatcttaatatgttaaatgactgtaaaatgatatcacttgtgcagcctgttgggaggagcatggtgcaagagagttggttctgacatcaggagcctgagtttgacttccagtttggtcacttaccagccatgagaccatggcaagatacttagcccgtcagatcctgtcttctctcatgtgaaatgggatggtgatgcccttgtcacaaagttgccaagggtctgcattagaggaattggattagatgcctggcaccccacaggcactcagcacatgtctccaggctgctgagcttctgggtgacctggcactcatgggataatgcctgaacattgctgctgttcttcccagcttctgtcccagtccaacctgctaagctccaggcccatatatgcccctgcccgcaggagatcttatcccagatccaccgtgtctaaaaccagcatctcagttcccatcttgttcattggctctgccagtttgcccaaatgagaaacacagaagctattcgagacctatcttttttccttacctaccccagcccatcctgctttcataactgttgcgggaggtcagggaccccgaacggagggaccggctgaagccatggcagaagaacataaattgtgaagatttcatggacatttattagttccccaaattaatacttttataatttcttatgcctgtctctactgcaatctctgaacataaattgtgaagatttcagggacacttatcacttccccaatgaatacccttgtgatttcctatgcctgtctttactttaatctcttaatcccatcatcttcataaactgaggaggatgtatgtcacctcaggaccctgtgatgattgtgttaactgcacaaattgtttgtagagcatgtgtgtttgaacaatatgaaatctgggctccttgaaaaaagaacaggataacagcaatgttcaaggaacaagagagataaccttaaactctgactgccggtgagccgggggggaaacagagccatatgtctcttctttcaaaagcaaatgggagaaatatcgctgaattgtttttctcagcaaggaacatccctgagaaagagaatgcgtccctgagggtaggcctctaaaatggctgctttgggggtggctgtcttttacggtcactgctgtagggaagaaataagccccagtctcctgtagcgctcccaggcttattaggacgaggaaattccctcctaataaattttggtcagaccggttgtctgctttcaaaccctgtctcctgataagatgttatcagtgacaatgcatgcccgaaacttcattagcaattttaattttgcctcagtcttatggtcctgtgatcttgccctgcctccatttaccttgtgatatcttactaccttgtgaagcatgtgatgtctgtgacccacaccctattcatacactccctccccttttgaaaatcactgataaaaacttgctggttttactgctcagggggcatcacagaacctgccgacatgtgatgtctccagctttaaaatttctcttttgtactctttccctttatttctcagaccggccgacacttagggaaaatagaaaagaacctacgtgaaatatcaggggtgaatttcacccaatacataactctgcctggatttgttccctcctgtacctcctcattgccttgtcttattgactgtaataacaccgtaacctgcctcccagacaccagtctggcagcctttccctgagttagtctatacccctaccggaatgatctctgaaaatcaaatctcatcttaaagattgcagctcagaatcctttaatggtgcctccttacctttggtaaaaattcaaactttgcagcaacctggaccttgctccatcccttgtttcttagctctccccaacatgtaccctgtactttatccacgtgcaacactttatgattcccacaatgtcacacttttgtgcctttaatgtattgtttcatctgccagcttattctttcagtgactctgtacctctgtgtaattctggaaggcttgtgcatggtgtcacctgtccctagagtcctttctctccccctctgatgctctgatgctggattaggtgcttttccctggtggttctttatcagccttcatccaccacacctgtagcatgggctgcatgatgttctgatttctcctacacagtctccattctcagtctgagcatctgaaggaggatggggactttatcccttcatctcaggtctgtaaatgtcgtgtgtatgaatgaatccacaccagtcccttcccatagacaacatagaaaggcccaggtcccagaagtatcaaggtctaatgctgctttagtatttgtcactccttcaacccagtgaaatagagcagctgtgccattgtgggagtcactgggatggaaccagctgcttcagagctgggctctggagtctgatggacttgggtttgcgttccagttccctctctcagcacgcctgcatctggcttcagatttgtagcttctaacatccttctatcctgctgcggggaaggaatgtgctgatcagaaataggagcatcaggtcctcctgacagttgcctttctttggtaaaatcagtaaatatatgggtttgcatattgagctctgagaattttattagcatgagtcataatccccgagttcagtcagccctgatgagaccaggttggtgaggtggctgggtatagttggcctcagacacttggcgaattcacagaggtaaagatggccctataagacctctgacagccagacacccaatctcttgtggtgatggcctttctttctaattcctaattcctaaagtttgagttagaaaagttcattgccacaatctgcgaaatgagttcaggagcctgaggaaatcatgctgctttcttaaagattggatctcaactggacctgctttgtagtacttttttttgaaagtacagctgtcttcacccactacttctcctcctcttaaaacataaatgcaggctgggtgcggtggctcacacctataaccccagcaatttgggaggccgagatgggcggatcacttgaggtcagaagtttgagaccagcctggccaacatggggaaaccccgtctctactaaaaatacaaaaattagccaggcgtggtggtgggcacctgtaatcccagcgactccagaggctgaggccagagaatcacttgaacctgggaggcagaggttgcagtgagccgagattacgccactgcattccagcctgggtgacagagtgagaccctgtctcaaaaaaacaaaccaaaaaaccaaaaaacttagatgcagtagggcttagttgaggtatctgcaggtgtcatgtactacaccacactggtgaccatagggagctgcagggtagggggcccacattctgagaaggggctgaggaagacctcaaggaggagaggatgaggtcaggctcagggccgggtcagatgccgggttctcaggacaatgcccccacttcttcctttactttcttgccaaatgtttcatgacccttggtgactttctttctcagcctgtctctggaatttataaatgtcgaagttcaccaagactttttacgaaactctggttatattggcccacagtgacactaaaaagtaaaagtgaatatttctgtgagtttgtgctgctgcaactaatttaaaacgagcttagaggatgtattaagtctttctctttgagacttgcatgtgatgttctgccccctcttggccagtgagcccagaactaggggagccctcaagaggcaggggctgcctggtcaggcattgctatagcgtggccctggttccccaagtcctgttgtttttggcagtggctgtacacatctgccgagtgagtcatgatcatttttgtgatacatcctgagaatttccagtgttacttaataatgaaattcagggaaatagggttagacttcaggaagtaagtacttttcaagtacaatctaatattttcatatatgagttaatttcttatcaaactgtaaccaatttttgatgttggaagtctacagtctaaaccagatgacagttaaggctttgtagtttgtctttatcaaagtccctactgtggccactttatcactgtctttatcaaagtcctcacagtagggactttgataaactacaaacacctagctgtacacctggcttaaagtgtagatttacaacatcaaaattggctaaagagcctcatgtggtctggccgctactacctcttgccttttctgtcttcccctttttttgccttcacacaccttggtctccttggccttccttagacccaccaggcatgccaccacctcagggcctttgcacgtgaggttacccctccctggattgcacagtggctgaacatcagtgaggccttctttgatcactgacactccccacagcccctgtactttctactgcttttgccctgctttatcaatagaatgggtcaccatctgatactctgtttgtatatttatttatttgtttagtctgtctccttccattaaaatggaagtactatgagggcagggactctgtctctgttgttccctgatgtatcaccaggacctaaaacagttcctggcatgtaatagacagttaacataaatgtgaatgaatgaatcattgaattttttccacttagaaaggactttttagatcgttaaccaaccttatttatagattgggaaactgaggcacagaaaagttatatggctaattcaaaataaaaccatcatttaagctttttttttttaaatcttgacatatatatagcacattctggtcagttatccaggatgagaaaagactgagtgaaaatagaccactaacttaaaatttgagcaagaagagacaagctgctgtgagatgggaaagctttctgatatagaggcagagttttgttcctttctgtagcatatggtgcaccttgcacatacttagtgctcaagaaaaacatgttgacgtaatgtggttatattgttaaatccattctttctgcaccactcttttccccccagtttctctccaaaaaatagataattgctcatatgacttctccttcaaagttcttctagttacaagtatcatatttaataggtttttgttttatgaacagctaaaagaattgaagagatgacctggtttcttggaaaattcagagatatttaatgcagtttcccagatgcatccccatcaaataaaacaaagaattaatgtttctagctctcttatgaaagaacccagttgacaagccttggtgatattgctggccatgatgattctgacctcaatgttgtttatgttcacatagacatccttggaattttacttttgacaaaaatattgtttataagtagcatgatgtttagatacacaaaagttagtttgggagtagggccaattaatttctctttaaacagaaatgaaatatagctaacctttttaatgagctgcagtgaacctcagagatgcagtgatagtactttgactttagagttggaagccatggcagttcaagacaagtatatttcagaaggtgtaggaagagaggaaaacagaagggcaaaccacataaaatacaggagaaatctttttctcttgtttgcatagactttttaaatccactcttaggtgtctttagatagcccaaaaaaaggattgggggatgtgctgccagtactttagaccatagagagatgattctcagttgatcatctgaaggctctttcaagctctacaagctcccctggaaactgatatgtacccccaaaacaaacaaacaaaaaacaaattctcatcctgtccagcccactactgatagttctgctgcctgggtttattcctctcctgtgctcctcctcctgctgtgtggaaatcctgtgattgcttgtagggtccattaatactatgcctctgtctgtatcataaggtaattaattataatatttcactatcataggaaaattaaactttgataacacaagtagcaaattcatagatttatatattccaaagatgagatggagaccctaaaaggtgaatcttattttttctgatccttggcatttagcttaaagtaagtcgactgttccaaacatctctacaaatctagctatgagagataaacatcatcacatggcactcctcttgaatgctactgttgaatcactccctgtcagctgggtgggtgtatgggctgacgtggttttctagcaagagtgatggtttagcatccatccatatgctatgtgcagtctccctcacaaaacctgtttacaaggattgcacccagggttcggaatttctttttttttttcttttttctttttctttctttctttgtttttttttgtttgtttgttttgttttgttttttgagacagagtcttgctctgttacccagactggaatgcagtggcacaatcacagctcactgtagcctcaatcttccaggctccagcgatcctcccacctcagcctctcgagtagctgggactacaggtgtgggacaccatgactggctaattttttcacttttttgtagagacatggtctcgctatgttgcccaggctggtctcaaactcctgggctcaagcagtccacccacgttggcctcccaaattgctgggattacaggcatgagccactgcatcaacccaggttgatatttctaaatgctgaaagaaaatagctgccaacctaatatttaaattttaatgtagagctactcataagcaaagtgtactggcccaaataggattttgtccatgatttaagataatcatcccctttccttgctataattcactaggctcacagtgcacccaagcatggggtcaaattgtcgacagattttagggctgtctgtcattcacgtaaagggaaatgttgtagaccatatctcaagaccaagtagaggccaaaggcagtttcagtctctccagagttacagagctgaggcatccacattaatagctcagttaagtccccttggagatgaaaacatttgatcagcagaggtcatcttagtgttactcagtttgacctgtctggcagacaggcagtttacaaaagaagaagtttagatgcctaacagacagatggaaagttactcaatttaactagctattaaagaagtaccaagattggctttttaatgtctcaacttggcaaaaggtaaatatgaattctattgcctggtttgagtacctccactcactgcctcagagaagggtcgtaaaattggtacagccttttccaggcatcctggtgatatgcaaatcctttcactcggctcttttctaggaactgaaagctagaaatttatttgaaagaaatgatttaaggacctactaacgatgtgagtatacaaggcatcattgtttgaatgctagtacttggaaacaacctaagtattttaataatagggaaattgttatatatctgaaggatagatttttatggtatagtttaaagtgctgtaaaatatcacacgattgtcctattaagatatttgaggtttattgttgagtgaaaaaaagcaattagcaaaacaatgtgaggtctagtgatttttttttttttgaaaaattcaaatgcgtttaaaagtcatggtaaatgaaactgtaaatcatggtattacaaaggattttattttgttctttttgctcacctgcattttctgttgttgctacagtgagcatctatttcttttatttttttctttttctgttttttttttttttttttttttttttgcgatggagtctcgctgtgtcacccaggctggagtgcaatggcacgatcttggttcactgcaccctccgcctgctgggttcaaataattctccttcctcagcctcctgagtagctgggactccaggtgtgtgccaccatgcccggctaatttttgtacttttagtagagatagggtttcaccaccttggccaggctggtctcaaactcctgacctgaggtgatccgcccatctcgacctcctaaagtgctgggattacaggcgtgagccactgcgcctggctgtatctattccttagtgtaatattttttaaagttaccaccacccaagaagatgtggttcagtaacaaatttggtatcctgctgagattggaaagggagctggggatggggtgggaagggagggccccccttggattagtgtgtttgacttgaatgaggtgtggcactgttcatctaaggctaaatttgagccattcagggattctcttcacagctctttctctctgttggtgaatatcaaaggacatattgaggggagcaaagtggactttatctggagttatagtcacaaatttaaatacatcttcaccagtcattattaaagaaagatctgcatttgtagttccaggaactttacggaccattctatctttctttcaaagggtattgctgaagatgtcaagttctcattttatagagatgctaatgtaggtatttatgtacaaagtttaaatgaccgctccagtgttttaagaagtaagtagtaaatgaatgcatgcttatcaaaaatagaatttgaataatacaggagtatgaaacatagaaagctaaagtctcccctttatacaatgtgttattctatttgtaatccatgttaactttatgtctttcttttttgtgcatttgcatatgcaatggtgtgtgtgtatgaatgaatatacactaatggtcttgaagtttttttttttttcacttaaatcagatcctagtatatacatatatatattattttgcaactttaaaattctcatatcatttaacgtgagcctttactaacattttgtatcttgaatctgagtaagggattgtatacgcaatattatatcaggaaaattgatttgcccttactgtggcttttggaaaaaagtggcacccagggcagatcatcagaaacctaaatttaagttgtttttccaaagtttagctgtcagttctctggaattctgaaacacatggaagttttagtaagtgattatagaactaacatcacagaagcaccaaaagactgtgatacacctaggtagtacttttttcaactctacctgtgaaagattttaagggttttttttttccccctgagggaaatttgcatttcactggagggcaaatcagctgtatttttttttttttctggttctcccactaatgagtcctgtgaccctaggcagtcagttgcttttcagggcctctctgtcttcctctggggaatgctacatgattgctaaggttctttactaaaaactcaacattctatgtctcattacctccttagcacctaaggtcaaggtgtccctagggaatggtgacaggttggtgccatgccttagtgccatgctatgtgtgcacaaaaggtgctactccaaggcacctgcaagtgtcctcaattgagccaaaggtcagttggtagcaagactgtggttggggaaaaaccctagctcttcactcctcccacctttttactgggagcatggctcatttgttaaatgtcttaccctagttctgcctgcctttgcataatatttgttattttttagtgacctactttaaaaatctggtgttcagactgtccatgcccacccccgttcttgcatgcagagtgtacctgtgctaatcataaccctgtacaagtcacccagctagtatttcaggatgggttagctttgaaagacactgtttctctaccaaataattatcttgactttcagaatgtgaactacatgtaatgaagggtttcagatacagtagctccgtttttattccttttgtttaagaactgttcatctgtcttccttgattcagtggccagggacaagtgttcagctgtcttcatcattctgacaagcgtcccggagggacaagttctgaataattgctcccaccttgtaccttaaaagataccatttcccattccttccttcttttttttttcttttttcttctcctcttttctcttcttgccaccatgtagtatcatctcattctatagaacaaagaaagcagcaaccccaaatagtgtgatatatgctaactcttccctctttcaaaaaagaaaaacaccatatatatttagatactctgccatctccaaaatgtccacattcattgtcttcgtttgttcattcctatcttttattgttgaatgaagatcagataaaacagaaaagagccaagaacaaagtagcaggaggagagagtgggagataagaaaggaattgaaacagtgggacctgtgctttatgtggatgtgggacatagggagggcttcctggccaatggtggggttcctagatgaaaccccagatcttggaggtatttttagagcctgaaggaccagtgataatactcaaggattagggatgggatgagtgtctggccagggaaaggcaggcttaggaggtatgatgcctggattcttctctatatctggacccattacccagccaaagatctttcttctcacacctctttgaaacatgattgtttttggctttctcttggagttactaaaccaggagatttgagacaagaatgatagtatgggtggaaccttgaagtggctccaaattccggagtcctctaggcttatatggagggcctgttttccaaacaaagctagtctttggttgctgaaatgcagctgctattactttctactgacctgtggctcagcacaaagtggcaggagacaggtgacagtgcctggctcagacctggtcttggggccccctggaaagaagtaaaggcaactccagcattcaaagttgagtctcttgtgagaggatttcccatgactttcccagctttaggggctagtgggtgacctccaacagcagcatcgtcagaacagggtggctgcacctagagaggtggtgttgggtggcagaaagagccagggtttgaaacctagctctgcctcttactggatgtatgccgttacgcaaggtttttcatccctctgagctgcggtatgcttatctgtacaatggaaataatgatagatttcatttacggagatgttgctaggtaaagaagatggtgtaaagcacttggcatgtgctggtataactaactggttcttctcttcccttctgcagatagaatttacttccttcatatagtgaaactagacagttatctagcttccaaggaaaaagggaggcaaatggtagtgcactttaaaacaagccattttctccaagagccaccatattggtcactatatccatcccaaaaataccaactgactttgtagggtggtgggagtagcaggaatcatgtgaggcttcttgtgttatgccccagacatttgtagctacagggaagtaaattgacacatttggtccccactgcataatggcagataataagtacaagttaacaactggtttaatccaaaaattttgggagacttggggcatctggctcctttaggattcgacacagagataaggatgattcagacacttaaggccattgaaagaggtgaatgacccatcttgctcagtcccgtgagcgtttcccaccacttcccctgcctgcagagactctggcctctgttgagatagtcttctgtttttccaggcaggcaaaacagcagttttattgttgcagttgctactgtttgagggtgaaaaaggtaagtctggggagtatagcatgggtgacaaatgaaagggagagtagcactgttgcctttttaaatatattcagaatttcagccagtggaattattagtttcattttctgagcccacagatttgtaaacttctccttctgcagataagctagcaggtttcttatttatagggctttcccctctcctgattggctgctcattgagttagaattagtcacaaatctcttgaatttgtgtggcactttatcctatatgcactctcacctcaaaaactaaagccaccatcttccctccaaaagcagtcctaatagccttcaattctccatgcctggagttaaaccttatttcttctccccatagatttccccccattcacccagcagccattttctctaaattttgcctcttcagcttttaatccctccgccccttttttccatttcagtttctgccatgcacttgcccgcctggttacctgccacctctggtcgaatagggcccacaggtgtgtttggttttgccatcatgccacagatccacacagtttagaaaaaattagttgccaacttttataagccaagaattcatataaaaatctagattaccagtctcacttggaaaattagatgatctctcaacactgggcaagcattccttcatgccctctcggctggagccaggtggcctctgcccccttagatgggcacagatcacccaggctctttagtccctgtacagcctgcctcacatacacaggtctcttcctgagccctggaggcattttgattgtgactcccattttagaatgtgccctccctttttccatatcttctgtgctgcctctctgcttcctgaattaagttttaagtgcctcacctggtggcactccacagtgcccaccaatgattctcaagctgaacgtgtgtcagaatcacctagaagcttgaacaggttcaatgggtggggaggggatactcaggaatctatatttttaacaagaaagaaccctggataattctaatgcagatggcctagggtatatacctttataaacacagttacggtgtattccagtagcctttgctgcccattctttagtttcagtttcagaactcccagagaaggaagttgattgggccagattgggtcagacacctttcctctctcccaacaaatggcagctgctgcatacagcatgtgagactaggtgggagaagtagttcccaggaaagaggcgctgggcaaacagcctggctgtctcctcttcagtgtcttgcgcccgttaccggtacctgtggcgtgtcctgtcgcctcctgcactagcaatccaggaagacacaggctgcttctcaatcaactgcttctccccaaaactacctcgtacctaccagactttggacagaggagttgtgcaaatgtctatttcttttaaatttttaactattttttttaaagttcagtgtgtacatagttaaaaatgcaaacaatactaaaagaaacatagtaaaaactaagccttcctcccagtcctgatttctaggtcccagacctcttaaaaaaagaatttaaatgttctcttttcttttcaggaacacgtggccatcagtaatcatgagcaacccattcgcacaccttgctgagccattggatcctgtacaaccaggaaagaaattcttcaatttgaataaattggaggattcaagatatggtaggtacatggctgtgatagcaattggaatctcatttgcacaatgattaggctatgtaattaattacacttgaggagagtttgaagagggagtagcagagaatgggtgaatgttcttggattaagtgcacaagcactcacatgcctttcctacattagtcatttttaagtaggtgataatgattacatacatttgacatttatataacactttatagagtatacatttgtatcgtatcatttaatctgaataacaaccctatggggtcatgtttataaaatataagaggtcctgaggaagctaaggcccaagagtcaatgacacatgctcagatcacaagtatgtgggttgtagacaagcaggacaagaacacagtcttttttattccaaattccgtcctttttctgcctttgcactgtcttttccagataaatttccagatagtattgcttagtaattttcacatatcaaaatggaatttttataaataaacaaaatcatttttcttatgaattaatattgttttattttaggaactccagttaccactggccatgctgcatagtgtttagggttttgtttcctttgaaagatgtacgtgcatatactttggtcttaattacaataattgtaaaggggttattttctcatttcttgagcatttgtttcataaggactattactctgtgtgtatatatacatgtataaatatatgttacttgtcaacatttaacataggctgcgtgtgttggctcatgcctgtaatccctgcacttcgggaggccaaagcaggcaattgattgagtccaggagtttaagactagcctgggcaacatagcaaaaccctgtctctacaaaaaatagaaaaaaattagctgggtgtggtgatgcttacctatagtccctggtatttaggaggctgaggtgggagaatcacttgagccagggagtttaaggctgcaatgaactgtgatcacaccactacactccagtctgggtaacagagtgagaccctgtctcgaaaacaaacaaaacacataatacaataaaaatctagactgatggtgagatgtgatgacttaagggaaactgtctgttgttggaatccaggacaagacaaccatttaataccaaagaataatattttattttggccttgtgtgtagtgttttctaccactgaatatctctttcttttttgaaacagagtcttgctctgtcgccaggctggagtgcagtggcatggatcttggctcactgcaacctctgcctcctaggttcaagcaattctcttgcctcagcctccccagtagctgggactacaggcacacgccacaatgcccagctaagttttttatttttagtagagatggagtttcaccatgttggtcaggatggtctcgatctcttgacctcgtgatccgcccgcctcagcctcccaaagtgctgggattacaggcatgagccactgtgcccagccctgaatatctcttaaacccattaaatatccatgtattttaaactgttggtcactttaccctctttccttgtggaagaatagtctgatgcctcatatcaactttatatagagattggccttaaagagcgctcttaagttgtctcacaggttttgtttattttgtcatccttaactcttagggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgtgagcctaatgtcacttcactctcctttgcctccctcattagcctttcaagaaagttttcttttaaacaaatgaaaacactctgcaatgactatatactttattaatttatgactatataatattatatacccatatccagacacttttgaaagctaagggtgtcattgcccccagcagcaagaggaaaccaggattgtgtccagcaaactgaaacacgccactttttctaataggaagggtcattatccttgctcttaaagatcctagtcctgagtatcttagggaaaggtcaaagaaatagcatggaatagagccatcttggaatcttttctttcccacattgtattgcccaggaaaccaggtgtgtcaaacacttgtacttgaaacactgatgtgctgtctgcagaggggagatgatgtagctcacatcacaagtcttgaccataactgttaagcctcagttctcatcttgctatttttagatatccttgctccccattgcagcatctttgttgagatactatatttccatttttaattgatgttattttattccttctagagacccagtttcatttttctagaggaagatcaccaaaatgttatacttttaagcgaaaaagagagattcatttaacatgaatttgattcacagccaacttttctgaattatatccattccttgaaatctggtcaaaactgaaaaggtgtgatctgaaagtcttctccaggtctttgtcaagccaccatgtgaatgggaagcactcacagcagtaagagttccagagttgttaagtgccagctttcccatcattgctgtatttagaacatagccgttattaaatttaatacggtgataacattgtacatagagataccacccagtcatggtacttactacctatgtgatttctgcctgaggaaatacgcttagaaactttcacttttctaagtctcacccattgttagctcctctgatgaggtagggccttgtcaatattatcaatggaggcaaaagctgaaaaatccagttacacacatttaaggcttattttctgcattattctctttcttctcttaggggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaaggtgagagattaaaacgaatacctgagtgttctgctttgtgcaaaatctttgaacacgaatctttttaaaatgtgtatatgtagttaaagaagaaaatctttcaaagatatcttctgaaaaacttaaacttcatatacatttcgcagtaaagatgttttagggggaagagtgggtggatttttcttttaatctttttttatttgtttttacttcttgggtgggagcagcctgcatttgaatctgacttgaagtctaggtgaaaacacacacacatgaagttctgccatgagagcttgtcaacacaagtatatgtcagtgcaagtatatgtttgagctttttcatccactggaagcttactcctttttttgatcccaagtaactgttgcatatctagcgatctctgcctcttcacgtgggtttccataatgcctatccctttctttccctgtgtttcttcttttgtttgggacatcctctcctctgttcctgccaaatcttacctgtccttcaaggccagcttaaatcttattctgttaggaatcctttactttccagcctacgaagctccctgttcttcagtttgccagatgatttagtgtcctgagtgggcctgtagcccttgaagggaagttgtcacttgagttgacttggtaagtagactctcagctccctgaatgcaagagctgagcagataaataggcatttaatatcctaaattgagtgaccttgaaattattcttcgattaagtgagaatcttggtaagcctgaatatagacacctaatggtctataacacctttaggtggggaaaaactaaacagctctgaggataggttttttgttgctgtttttgtttttttaaatccatccccacatccttagcatccaaaggtgtgcatattaaaatgtcttcgttggccccgtgcagtggctcatgcctgtaatcccagcactttggaaggctgaggcaggaggatcgcttgagcccaggagtttgataccagcctgggcaacacaggaagaccatatctctacaaataactttttaaaaattagccatgtgtggtggtgtgtgcctatggtcccagctacttaggaggctgaggcaggaggatcacctgagcccagaaggttaggccatgcataccagttgggtgacagagcgagaccttgtctttaaaaaaaaaaaaatcttaataaaacgtgttacaaagaagagaactgaacatgtgaatatgcagttgtgaactagcaacttaggcctgacctcttaacaaactttgaaagtgaatacttcttaatcaaaatatgtgtaccatttgtaatcctagcccattgaagagagactaagttttgtgannnnnnnnnnnnnnnnnnnnttaggagccaagtagtaatggtcaattttcctgactcagtttattttaatgagcttttatccctaaatctcactctctaaaagcctttggtttacgttggaagtattgggagtgagtctttgggttaaaatggcatcaggatattaaacattgttataaagccccagtcttttgtaagatacacaaaaaggcatagaaaatagtagaatctaagagaagcacttagtgatttgataaggcctataagagtagagtacctgatggccgggcgtggtggctcacgcctgtaatcccagcactttgggaggctgaggtgggcggatcacaaggtcaggagatcaagaccatcctggcaaacatgttgaaaccccatctctactaaaaatacaaaaaaaaatagctgggtgtggtggtgggcacctgtagtcccagctacttgggaggctaaggcaggagaatggcgtgaactggggaggcagagcttgccatgagcagagatagtgccactgcactccagcctgggcgacagagcaagactccgtctcaaaaaaaaaagagtacctgatgaagttaaacttgaaaaaaaaagaatctagtcatctttgccctttggctcaaaatggtaatcaacagatgggaatgaagtcagaagaaactctaccatttgtccttttctccaaaaggcagaatttgtaccagccaaaaccgtgaagatttcaatgtagagatgggtgtaaaaaaaaatcagctattgctgtataacagtcccagaatctcaacagcagtcaacagtaagaatttatttcttacacatcttctagttgtttgggaggtcagccgacctaggtgagcacagtcaggaagctctgctttgcactgcagtagccaggttgggagcttacactgaaccatacatctgcagggcagccgggacaactctgttccatgtgtgtttcttttggggtccaagctaaaggagaaagcagctgtcttgtgaccacagagactcaagggggcaagtgaaaacacacagtatctctaaggcctagctaaggaccagcacagcatcacttctgttcacggtgccattgatcaaagcaaatcacatggttgagcccaaagctggaatggggaaatacagtccacccgtcttcggtggaagtaacttcaagattacaccacaagggttttgatacagggagggcaatcaggtatttttaagaggctattatcttaacctagaagtatgactacctaaagttgtcaaaacaactatcagtgggagaaataacttttccatatacagtgctggaaattgattagtggagggagcagttcttatgaatgtttaaaagttttagaaggaaatgtatgcgtgtcagatgtcttgatgagactaaatttagaagcaacgaatgaaacacgggaaaaaaggtatagatttagttactgcaaagttaagagaaaataacttgaaaaatatggcaaagtgttaatatacttaatatatggagtgtctataatccatttagaaaaataataggtccctgaagataaatgggcaaaggaaagtggacatttcataataaaaggaaatgcaaatggtagtaaacagtatataaaggtttttcaatctcacaaggaataaaaaagtaaatatttgagatgtcattttcttatcaatatagttgagattagaaaatattaattatgaaggtgttataagggagacacttttatacactgctgatagcactataaattagaaatgaggattaaagcaatatgtgttaagaccttagaaatttctatatcctttgtcctggaattcctacttccaagcataccctttatatcatttatttatttatttatttattttttgagacaggttctcactctgttccctagaccggggtggcgtgatcacagtccactgcagccttgacctcctgggcttaagcaatcctcccacctcagccttccgagtagctgtgatcacaggcatgcaccattacatctagctaatctggatagctgacttcagaaaaagcttaatggccaataatgtttattaaagtattatttataaatgaagcctagaaacattctaaatgtccaacaaaaaatgctttattaaattacggtatacccctgaagtgaatcattaggtaacctttagagtttaatttatgaagtctttaataacacttggaacatgatcacattgtagctcaacgagcgagatgctacattgcatatgtagagtgacataagctacatggaaaatgatgcaggaattaaaagattggaaagggtgccaagttgctaagcagttatctcagggattgcaactgtcttcattttcctaataagaagctattatttttataattaagtcacttaagaatatgaaaccactcaacgggaaacaaaaacacctttatttgcttccttggggatgtaactgagttcctggcagcctcaaaagaaatttagaaaatgatctttctccagttaatattgctaacatccaaaccagataaattcaggataaagagaaatctactttgtcccctgaattgatggtacttggaacagaccatgtactcgccaactcttccctttcctttggactctgaacctgtcctaaggcaatatgtcttccccaaccttccttttttcctaaatcacgtgaactcagtttaatgttttggtttcaaatggaagagtttaaaatatatgcgtaaaatgttatcctgtttgagataggataaagacccacttcagaagttaggaaagtagccataaattcatgcccagtttcatctttcttggagtctttcattaatgttgatgggtttaccttcattttgcttgcctagaaggtgaaagtacaggtagagacagaattgtaatatagttttcatgtctaaactctattgactcaaaattcaaagagctcatggctgttaatgcatcttgaacttgggtcatcaccaagttcactgtaattttttttttttagaccttgactctaatcaattgtggtttcagttttttatagacctttttcatttacaccatgtactgaaaacatgaaaaacagcaaaatccaagggtgaactttgacctagattgataaccaaatctagcaaacccacatgtatatataaaatcagagtgaacactagccggggcggtggctcgcccctgtaatcttagcactttgggaggccaaggcaggtggatcacgaggtcaggagatcaagaccatcctggccaacatggtaaaaccatgtctctactaaaatacaaaaaattagccgggcatggtggtgcatgcctgtagtcccagctactcaggcggctgagacaggggaatcgcttgaatctgcaaggtggaggttgcagtgagctgagattgtgccactgcactccagcctggcaacagaatgagactctatctcaaaaaaaaaaaaaaaaaatcttttagaagtgtttttattggtggtattttgtttttatttcttgagttgtggttttgcaatttaacctcatgatctctctcctcatttttgtaaggaattaaatgtgatgtctcaactctgtgaaactgtgtgctgtgggctaatttccagctctttctggaaatgagtgagaaaaactgggtaaggggtggtagagtggtaaatgtctcagttaaatgtttgtaagctctttgcctagtttgaataatactaattagcttcacaccatctttagaagttgaagttctaatacattattgtgatattttacaaagttacctcaccttttttttttgttcctccaacaagaatttcataacagtgactgggcacggtggctcatgcctgtaatcccagcactttgggaggctgaggcagggggatcatgaggtcaggagatcaagaccatcctggctaacacggtgaaaccccatctctactaaaaatacaaaaaattaactgggtgtggtggcaggcgcctgtagtcccagctacttgggaggctgagtgaggcccgggaatggcgtgaacccaggaggcggagcttgcagtgagccgagattgcgccactgcactccagcctgggcgacagagtgagactccgtctcaaaaaaaaagaatttcataacatttctgaccagatttcattaatgtgaaaactatctccatgttaatactgtccgtgaatttctggagctccattaaatgtaattctcagaaactgaactacattcaattctgaattcaaatgaactaagaaatttcctctttagtccgtgaggccattcacatttagagaccttattaaaagctcactagattagactaatttagggaagttctgagtggtagaaaattctgaatgctaggtctattcattccagtaactagaactaggctaattgagccaagctccatataatagatgttttgttttcctgagtaaatagggttttacctggaattactgtatcatgaaacagtctaagcatttctggcttctgcacgtcctatgaacatgtcacttccatcaaactgatacccccagcattttctggggtaaacattcctccgtcaatcatcagtcatgcttctgctgtgagaagctctgccatcctcctggtgctggagggtggaagatcagggacaatgactaggagtccataagtgctcacagtatagcaaaatagatggggaggagaggcaggggccacatgtggttataatcttacctgtagtggtagaaatcaaggtcagagatgctttccttttttaaaaaaattaaatccatttagcagatctattatgtgccagtatttattccagaaacagattatagtttagaaggggagagaaattagtgaacacacagctttcatgcagttgataagtgtagtcaccacagagaaggggcaaatcatcctgacctggggagtctgtgggtttttcaaggagcgtcacctgatctggatcctgagcctgtttaccaaggagagaagagctgaaaaagaccttccactcagagcaaatagagcatgcaaaggcacgaggaaagtgggggtgggaagagcatgctggctacagtgtagctgaagctgagagcttggactggaggctaggagagggcttataaaggatggctgaggtcaggttgaaggacttaggtttttaagacaaggaatttttactttataagaaaatgggaagccattggtagattcagactggtgcatgatgatttatattttagaaatgattgaggtgaccataccaaaggtagattgaatggcctcacagggcagctggttgggaggctatttctggaataaatatcttgatagctataggtactaagtggtgggaaaagagctcattagatatggacagacagggaagaggaacagatttaggaaagaaagcccagcatcagggtttgacccattgagttgatggtgcctgaagtattcttggtgcgcatgcccgaaacacactggaaacatagatctggacgtagagacaggtgggaactggagtgatggagccctcagcatactattaagaaggtcgagatgagtaccttgaggagcagctgtgtctcgtccagagggtccacagagtctgctgatgccggtgtcggtgcaggtgtcctgccttgttctgctatcccggggtccctcctttctctccctcttttgctcttctcgaacatgtacacacacaaatagacactcattcactcaggcagggatcagcagactttttctagaaagggccaatagcaaatactttaggctttgctggccacatgctgtctctgtcacatattcttccccccaacaccccagcctttaaaaatgtaaaaatcatccttcatttgagggccaagcatatatgggcattgggtcacatttggcccatgggctgggttgtagaccccagcccatgttaggcagtctcaggaattgatcctacctattaaagcaaccaacacttgtcttggagaatattcatatcaagagaaaaaaaatctgtgtggtaaccaaatatgttttctttttttttttttttgagatggcgtcttgctttgtcgcccaagttggagtgcagtggcgcgatcttggctcactgcaacctccacctcccaggttcaagtgattctcctgcctcagcctctcgagtagctgggattacaggcgcctgccaccatgcccggctaatttttatatttttagcagagatggggtttcaccatgttggccagtctggtcttgaactcctgacctcgtgatctgcccgcctcagcctcccaaagtgctgggattacaggtgcgagctactgtgcccggctccagatgtgttttctatgaggtaaataacacatgcttccggtcccttttttcccaaggagtgtctgcccatcttgctcgggctgactcactgtcatccttcagaccacattgataccatgtccttctggaaagcattccaatccccccaacccccacccccaggtgggttcatggcccattccaagtgctcccgtaccaggcagtgatgattgcattcttttgccattgccctttcaccagactcagagtgccagtgggcagtgagcacacagcttttgcaccattgcattttcagcatgtagcatgtggcaggctctgggggaggggaggatcagagtgagtgagaagcagagtatcatggtcaaggtagaaacccccagggccagtcagacctaggctcagataacagcactgtgttatcgtctaactttggacaaatttaacctttctgtgcctcagctgctgcttctggatattgaggatgacagtagtatttacatgaggggttgtgatgataagttcacatgtgtaaagctctgagcgcccacaacgtaatgttgtcctttagctcttgctgttactgtggtggtgttaactaccactgccaccattactgccacagtcgctgttaactatgacgggaagtccatgtggtatagggattaaaggatagtgtcaactcgggagtcagactgcctgggtttcaatcccagttccaccactgactagtgtctgtggtcctgagcaagtttcttaacctctctgtgtctcagtttccccacttgaaaaatgtggctattagttgcacctaactcaaagggatattatggagactagatgagaaaattaacataaagcatttagaatagttgctggttcctagtagtgtcaaaaagtgttaactactgggtactaggaagtagttatccagtacttcatttattaatgaagtctgactttggtcttagctattaattttactagcctttcctgtgttcactcaatcctatgatacatgctttatgagcacattctgtgtgctgaatctgcgatcttgtgactatgacttattctaccttgactcaaaacaatgcagtttgatttttaaaatcctagaaaatcttggtgccctgtgttgtcctgatggactgaatgacgttgagtaaatcttagcgtataatctgtggttcacagatgttatcaagtgacaccatcttcctcataaacctgggtcctacacacaggagattgtgattctataaggtactgatcctctaagcattgctagttttctgtctcccaacataaagagatgaaaataccagcccagacacattccaggtcagagagatgttataatgaggtcatggatgaggagtatagaaacaagagttctttaaatgtccaggctgctgttgtcatatgaatgtcttgagtctgttcctaagagtcagactttatgattagattagttttaacttcaattcagttcatgttttctgcctaccatagttaaaggcattgtaggaatcacttgaaccaaacaataattactctctttactttcactagttacctctcctattctgcattgtaaatagtcatgaatgaaattcatattatcactcagcaagcaaggagatgcaattccattttgtttcttcatcaccaataaatttgaccactaatatgttaagtctcaaattgtatacatttaatttttctctctgacagggcagacagtttacagaagaatcaagacctggaatttgaaagaaatagagagcgatttgaatttttaaaggtatgggcagggtctggttccattgtttggttttctttgtatgcagggtacgagggagagatgccaaggagatgggctgagtagaagtacttcacgcgttcatagtgttctttccatttgtcaatcccagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgagtgttcttccatatatgctgttttggggcatgcactttaattcactgtgattctattacatctcagtaacatgaatttacatgaccacaagtttccgagaggtatgtttgtcagttttgtcactgctgtttttccagtgcctagagaatcactttgcacctagcaggcactcaataattatgcttggaagaatgaacagaagcaaggggttaggtacatttagcatacacaaaaatcacctggggtgttaaaaatagagactcccaaagcttactcttctttgcatgtggcatcaaggggattttgatacaggtgtttgggggaccatgctttgagaaacatttgttaaaaaattctataaaggaaaatggagaaaaaataactgctctttatagaaacatgactctgcaccaattaaacgttgtaactgggtttattacctgttaatgtcactaaatttatacctgagagatagagtaaggggtaatgaaggcattcttccggtcatgccgttcattgcaggtgtcggtggtattgaagcagaagctgtcatgctgggtcagccaatcagtatggtgcttcctcaggtgattggctacaggctgatggggaagccccaccctctggtaacatccactgacatcgtgctcaccattaccaaggtaacaatgtgcatcctcttctgtggtcttggaaagccacaatgatagctttccaatggagggaatacataatggaatcttgtttggtttccaagtgctctagcaatgcaaggaaacaaggttgatgattttaaaaggagatgaggtaagggaagtgttctatgttaagtttagatcattatgtttgttttcttctagtattgctgcatcgatctttttcttaaaggaaattttttaaactgaaatagttcaatgatacagaaattaagatggcattcatatgcccaccacctagatttaacagatgataccattttgtcatagttgcttcagagctctctgtgtttttaaagaaataatatgtaatatctgtggctaaagccacattccccatttctagaaataatcactatcctgaggttgtaagaatcattcccatgcatgtgtttatgctttcactacatgttttccacatggttcttccttttatgtaaatagcaaggtagttccatgaatagagttttactttttaaattctcttctctgtattataagttacattattgtaacatatatgtcaccaagctggaaagtattaggctttttctgtagctgttagaggagaccatctttttctgtgatttgcttgttttgtaaaaaggccatttcgttttggaagactcttgcaaaagcaatggtttttaatgatcacaaacataattttttttgcttttatagtttggaggctggggtcctttgcatggacatgctatcgttaaagtgcaaaacacatttctctctgatttaatttttgtgaaattttgaattggatttatttgaataccatagcttatcacaaatgtctgtgcactgttcttaagatgtggaatactacaggacttcctcacaaaatttggcagaattccatattaccaaaagagcccatctgtgtggttgtagctagaaactggctttatgcagagctaagtcagtcactgtggcctcactcctggctggtgccttgtgtggaaaagatatgggaatcttttggttacatttgacttatacttgtagcatgaattttgctcattacgcctttgaaaagttattttcttaactagtgcaagtagttatttaggttgaaagaatttaatatgtagcacttccagacgcttccaatgatctcattagagaaagagaatgtttctcatcttgaaatatttttcttaatatcatttgtattttgggcacactttgtctttctttttataaataaaaactatttgacatcatcttagatttatgggagagttagtataaagagtacagagaattcctgttatctttctcccagcttcccataatgttaacatcttaaataaccatggcacatttatcgaaactaagaagttaacattggtgtggtactcttaactacagactttaccagttttttcagtaatgtcccagaattctgctccagaatccaatccaggataccatgttgcatttagttggcattgttttttaagttttgaaagtgatcacaaatgtgttgggctgatttactatttgggtttactgacaagactagtttataagaagtgcaagatggtagttctgcattttgaatgtgggccatcagatctcaaacttttctgttgtttctgctgcttagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtaagtgaagggccctgaaagcatcgggctttttgtaaaagttccatgaaacaccaagaatctgagcactgccttctgcctctacccaacagaaggcactgggttacagttacacaattatttttttctccatggagtcaaaatgggtttttgggatttaaggagttaatatgagatagagatggtatggccaatagaaagagctcagagattacagaagcctggatatttatactggtcctctactactagttttttgacattaaacaagtgatcttagtaatggttactgctgcctatggggtacttgctgtgtaccaggtacctagtatgtatttgctgtcaacctctttacagatctgtagggtagattgattgactagttaattaacattagagaaaactgaggagcagagaagtgttcatacccaaggctaataaacagcagagtcagaatccaaccctgcaactgcctggccccatacaggaacagcactctgcaacacccctctcagggatgtctaaaaaatgaaatgagtccaggcatggtggctcactcctgtaatcccaccactttcagaggccaaggcaggcagatctgacctgaggtcaggagttcgagaccagcctggccaacatggcgaaactcccaggaggtggaggttatggtgggccgatctcgcaccactgcgctccagcctagccaacagagagactgtctcaaaaaaaagaaaaaagaaaagaaatgagagtgtgatgtgataatgagaaagaaaggggaggtggctgaagtaccccagaggtgcttgcacagatctctggatgaagtgaagggacagccatgggaagggtttcatgagaatcttacagactccaaataaatcttagtcttctgctgtagcctgaggaaattcctctagaaatagtaaagattgtcatgaaaaagtttatttaaaaaagtttttattaaatataaacacattgaaattgattaatacatctttgttctcccaaaggattttaagtgaaaaagataactaaaagaacagaataaataattgagggaatcaacctaaagaaagagagggatagtgtgctgggtagagggataaaagctgtgagatggatctagagggaaggttagttggttagttcccgtggtgctgcaggtggccattatacttcttggtaatccagtgccaaatttgtaacatctattaaattgaaacaaacatattgcttcagaatagtgtagccctttctcatagtaaaccctaagaaagatttctcctgttcatcttcatgaagagcatggcatgggttgtagtgaacagcgggctcaacaacaggtcaggacaaatacattagtgaagctcatacagctgtcttttatgaggtctgtgctgagagctaatgacgtttacagttcagctaaaacaaatagacaaacaaaagttctgatcagtggtaggatcagccaaaggatcaaaccttctgtttctaaccatcagagaaattgtggactgcatgtccgttgggcatacttcatgagtattatctcctaccccgggatcttgataaaagttaaatagcagagggttcaaggtcatattcctggtgatgcagcatcgtgagttaagactttgaacttttgggtcaagctcaggtttggattttggttctaccgtttactggctgtgttacatgagaaagttacttagtcttcttgagccgccatttccttatccataaatgagaataataattgtacttgtatcttaagactatgataaaggattagagattgaggtaatacatttaaaatgtttaggacacagtgcccagaaagtgctcagtagccagtggtttcaggtggggttgggatgcgttttaattttaacggtaatcatgtggaatgctgaatctttgtggccagttgaaggcaaatgcataggtgtgctttcacaattagctcaggtgtaagattctcctaattaaaggctataccccaaaagaggcgggttatctatagatagaaccagaatctttttcagaaaacagtcactttgataggaacagcacattcattaatggcccctaataaaaagcagcatcagtgggagagtcaaaccattagcctggaagcctaaaaattgacagagctgttggtgtgtgtgtaagtgcagcgtatgttgcgtacttacataattgctaatggaagtatcagtttataaacttcaaccaggaaatactaacctatgttacttgttactccttaaaatgccttttaggtcgtgatgaagaaaaattaaagtatattaaaaaatatcttcaggctgtaggaatgtttcgagatttcaatgacccttctcaagacccagacttcacccaggtatgagagtgccttccactgtgcatgtatttcctcttcctcaaggctgcgattttagtggtggtttttcttgggggaatgcgctagtaggaaattagtcactgccaaggcattacaagagaacggagttttagaaggttgaaaaaccaaaaggataaggcaattgtaaacataacagaataatataacttcttacattcctactggcttaataattgtaggttaagtgtgcttccctatttgaactactgattcacacctcttaatgtggaagaccactgaaagactttgctaaaggaataagaatgatacaatggactttggggactcagggcaaagggtgggagggaggtgaaggataaaagattacaaatttgggtacagtgtacactgctcaggtgatggatgcaccaaaacctcagaaatcacggctaaagaacttattcatgtaaccaaacaccacctgttccccaaaaatctattgaaatataaagaaaaataaagagacttcactagtggaacaagagctgtttaaaggctaaaccatcattattacagacctagaaagaagtgaaggtacaaacatgtcagtaaactgaatccacgtttttctagacaacaaggtaaactagccctgcgacccatgtttggtttcttaatacattgaggaggggaaatgttcagttagactaaggcccgtttcctggtgttgataacttaacggctgcatccctccgaaatcaccttagaagtgtaatggtttatgtatgatttcaatagaaaacccaccttcggcctaacttagccatataaaacgcgatgagctgcctccaaggatgggcgagtggaggacactgagcatctgcagcacccaccctgttctttctgagaggtggcaaggctgcctgcctgtctcctgctacttaagtgcccatcatgatcttaggaaattaatcacttaagattaattaagaggattaagagaaacactggcttccttgttttggaatgtggtagtttatttgcttatttttatggttgtcatgttttaaattctctgacatgctttgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttaatgacttcctccattagtcacgacccaagcggcaagagccatcatagacacaactcaacccacctttttaagcatgtctgcttttcgcaggacgctcaccacactgtttactcacccgaggttttctagctgttgcacctttgtgcatgcccctccctgcctgaaagtctcttctccaactcatattactctgttctgtgaactccataagacttggttcagataccagctactctgcattgggttctcagaatctcatagcagaaagtcccctttcccttattggacacttcatggtgcttgggctgaaatacttcgatagcattccatattctttaacttacattgttggtactttatttgcatgtatgatttctgttgctagactgtacgtgtgagaataggatttgtgtctgaatcaccttgggagcccgcaaggtacctagcacagtatcttacatgcagtagattttcaatgaacatttcccaaaagaatgattaagatgtatgatggattttatctgtgagacaccagtattatgccaaatattcagctgtactttgtttgcgttgttgatcatgattaattgagtctggtcaaaatagcgcctttttctaaatttccataaggttagaatccatagtcttaatcagtccatatccattaaactgtacaataatgtcattgagttcaatttagactaactttaaatttgtagttttagcatttacatttttgaggtgggaaggaagtaattgttactaatttcagtgcagagtaagactcagatatcatgactgctttttgtaaagatttcaaacgagtaatttttctgtagcatttcagagtttacttgcagagatacttaggcttttgttaagaattggcctttaaaattatagttaccaaagtattccttcttctcaagtgagaactgttgactatatgtatgtattttcctctagccagatacatgtatatcttatataaatatattcctatataatatacattttttcttcctttagcaaggatttaaaggattccaagttgctcctgaacatcataatgaccataagacctttatctatgataacactgagttcacccttgctcatggttctgtggtcattgctgccattactagctgcacaaacaccagtaatccgtctgtgatgttaggggcaggtaagtgcatttgactccatcctcatggtcatacatgtgtgtaggtggaaatagcccgagacagggcccagggccttggcggagttgtacatgtagttccctgaacctcgtcttttccagatacagatatttattggcccataaatatctacacaataaatagtatccaaagcaaagtttttaaaatcgaatgcacactgcataatagtctctcttgagaattaacacagaaaataagtagaggaaagcaaaggaagctggatttctgggaaagcctacattcttgtgtcagactttggaagaaaaataaagtgttaccacagactttgttctccgtgaaacccctgagcagcaggattgagttctgacgtgaatgctgggaggtgtttctcagtgagggcacagggcactggctgataaaacctggggccactggcctgtttcgcaattctggttgagttgttaatatttacatatgtggtttccctactataaggtctctttagtttccaagtttttagtcatccccaaagctcctcttatatccatccacagaccagacagtgtcagcagttcctttctatgaagcagacacgggcattaggaaagccttctttgcctgagtccgtgtattgccacctaagctttccttgtctggtctggagcaaaccagtcttctgtagacaagttaccagcttgtctgtggctttttgtcccctcatgtccccacccccactgctcatgtttttgctacttctgtgatacttcctaagacagagcacccagtgttccagtagcagtctctgtatctgccaaagtccagcagatcctccacttcaagatatatctgaacactcgatttttacttcttggctgaccgttccttgccagccagcacacagctgatatagtttcagaaagggctccttcaatgatgattttcatccaaataaaacataattagaaagatgattttccctctaaaaaaaaattaaaaactcattttgtaatatattcctaaatggttttacatttatctctttaaaaaaaaagtaagcaaatctctttcttcatttccttgcctagctttgagtttactgcatatatctaaatgaccgttggccagggagcctttagatttctgtttggcagcagaaacagcagatagcgccaacatgaagggagcgtggtcaggtggtggcaggaaatgcagactgaagaaaatcaggctcttttctgaagtgtgcctggcacctagagcaggcagcctcccacactgcatctgtgtttaccatttcacaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtgagggagagttttcttttgcaccattgcttttgttgaattgtatccctcatgtatcttgctgtgtcaccttgtaacagatgtgagattatctgatgatatctaattgcatagtcgtttatcagttggtagttagacttaaacccttacattccatctaaagagggccctcttgccctctagggcacctaccatgaatggagtttgcaggactggaagttgctttggttgagtcagtgaatgagtggagagtgaatgtgaaggcctaggacattaccacacactactgttgactttataaacactggacacttaggccacactaacttaataaaaaaaagtttctttcttcaataatgtaaaccgtagcttacttttattttacaaacttttaagtttattgaaactcttgactcttaaaacacttagcttaaaacaaacatattgtatagctgttccaaaatattttctttatatctttatttcataagttttttcctatttttgaagtttttatttttttactttttaaacttttttgttaaaaaccaagacaggctggacccagtagctcacacctgtaatatcagtgctttgggaggccagggcaagaggattgcttcaagccaggagtttgaaactagccagggcaacatagtgggacccctgtttctacaaaaaaaaaaaatgtaaaacaattagccaggcatggtggtgcatgcctgtagtcccagcttctcgggaggctgaggctgcaggatggcttgagcccaggagtttgaggttgcagtgagctatgatcacgccactgtactccagtttgggtgacagcaagaccctgtctcaaaaaaaaaaaaaaaaaaacctaagagataaacacacactttaggcctacaccgggtcaggattgtcagtattactgtcttctacctccacatctgtcccactggaaggtcttcaggggcaataacatccatggagctgtcatctcctgtgataataatgccttctggaatacttcctgaagaaccttcctgaggctgttctacacttaactggtttgcttttttttttaataaacaaaaagagtacactctaaaagaacaataaaaagtcagcatggctgggcgcggtggctcatgcctgtaatcccagcactttgggaggctgaggcaggcagatcacgagatcatgagatcgagaccatcctggctaacacggtgaaaccccgtctctactgaaaatacaaaaaaacaaaattagccgggcgtggtggcgggcacctgtaatcccagctacttggggggctgaggcaggagaatggcatgaacctgggaggtggagcttgcagtgagcagagatagcgccactgcactccagcctgggcaacagagcgagactccgtctcaaaaaaaaaaaagtcagcgtgagtttgtttataccagcatcatcataaacaagaaatgccttgcactgtgacatcacgatggctacaacatcactaggtgataggaatttttcagctatataccacatatacatttgggtatatgtggtctatcactaacagaaacattgtgcagtgcatgaatgtattcgttgccaaatacgctttctccaatttccatattattcctgacttatgacatatattttattcatgtgcctcataaaattcaaatctccttaggattatacaataatagtagttaatgaagatatggcatatatgatttcaacttttttaaattgttgctcattcaatttgattcctttttataagttaaaaatatgaatagtattcttatgttatatatcagaatgctctcaagaatgaaacttttagaaatagcactatactgaacttagttcatgcactgcaattcctttttgaacagtggtctctggaaactgtggccagcagaagggctcactgaaagttattctttttttgtgtgtgtgtgcttctctcttggtgtctaggtttgacgtggtgggctatggctgcatgacctgcattggcaacagtgggcctttacctgaacctgtggtagaagccatcacacaggtaattgcagaggtccctgcaggtcttcagagcagttgtttcttttcatgtaatgtgacaaaaatgctgatattttcaagaaggtccatggaagcaggggatgtggtttagagtatgatcttttgagtttagttaaaattactagctgggtaaccttgggcaagttaattaacctatctgtgcctgggttttcacaactgtatattggagatgataatagtatctattttatagagttgtgagaattaagatgatgataaacataagtcacttagtgcagtgtctggcactcaagtgctcagtactggctggttttcactacaaagggctctacagttgtttgttataggtattgggttagtgcaaaagtaactgtgatttttgccatttcagtgatgaagaccacaattacttttgcaccaacccaaataatttgaaaattggttcaaagtgagacaagtctccacacaaacgaatctaaactaaattgctttggcttgatttttatccccaaaatgctgaaccttgaaagatattatttggtttgctttgcattaattatagaatctacgtattctataattgtgcattgtgacttcctttaacgatcaactgttaggtctttcccacctgttcttgggccccaggcagcaataactagtatgttgccttctaactacctgatattttctcgtgagcagaaatcactaaacatgtctctgcttcctttgacccagagtatctcccatggggacaccccagtgtacccttctcccctctagtgggagagaaccaagtgaaagggcagcttaaaggactgtatccttgcgatgtggaaactcttgccaatggtctgagacaagaagcctagtcagtatcttttagtgacctgatttttctcttgccttactcagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggtaagattttgtttgtgcagccataatttttttccagtgaattcagaaatattactagaagaaactgctttccttaataagaaatgaagcatagagcctccagggataagacaaagaagagaataatttctttattccccaatatacagctaagacttaactgcagtagttaaaacaagaatctactgagggtaaaggataacgaaaggaaaacaggtgccaaaaggaatagacatcttgctattctggtttcttctgtagttcctccctttctagctctcactttaatgataggcattgtttcaatatatactctgtagaaacatactgcagatatttcaacttctcagaattccaaagaaatgatacatcatttcctttccccagatcagcttgcttgctctgcctgcctcaatctattctaagccgaatagataatatgaaaacaatgcctctgaaatttacttttaggaaatcataactttagacgtacagttgatcctcgttatttgtgagttctatgtttgcagatttgcgtagtcactaaaatgtattttaacccccaaatcagtatttgtagtatgttcacggtcattcacagatcagcacaaaggggtgaaaactttatatcattcaacacacacgttctatgctgagatctgataaggcgtcactctgacttcttgtttcagctctcctgcgatatataaggatccttttcttggtctacgtagtgccatgctttttgcatttttgtgctttttgtggtgattttgctgttcaaaatggtccttgagcatagtcctgaagtgcttctggtgttcttgagcacaagccgactgtgatgcgtactgtgtttagataggcttcgctggaagttcaatgtcagtgagtcaacaattgctattaaataaggtgaataataaacctcacatgaagcaaggttatgtattgatgggtgaccagaggcttgcaggaacctaaccctgtatttcctccagtggcagtgattccgtatccagtcattcagtgttcacacgggctttatagaacataactaccgaggagaacgaggcttgactctgtataatcatgaaaattgcatattagaaagttttctcattaataaacattttttccccaggagtaaatgcaaagggacagcaggtatttctgaaagatatctggccgactagagacgagatccaggcagtggagcgtcagtatgtcatcccggggatgtttaaggaagtctatcagaaaatagaggtgaggtcccacactgccctccccgccccagaggatctaagggaaagctgctccctttgtgtcctgtctgcagacctcaaggctaacggaagtataaactatataaagtaacatttatttcttcagatgactggggaggtggttctccgtcatttttctcctgtgactcgcatttttacaaaccccacctcccccagatgttcccagatttggacaagttggtgacagcctagagaagaaaggcctcctcaggttcagctctccaaaaccccacgcctttctcggacacccaggggtgtgtgtcagctgtggcgaggacccctggtggtcactatattgtgtcactaagtggagtccattggtcgaatgcacctctcagaatgcatttttgcacacttaaaaataaagaaattaaggccactcagtaggaagtgccaaactactgaaataaaactttccgtgcattttacaaataggaggaaatgtgtggggctcagcattatattctgagactcttggatattattcctttccccgccttctgcattcagctgacccaagggcttctgactgcggctgatggtttaaatgagggtagaactgtctaggggaaggggtgatgtaggtgtgatgttcacacgctgcactcttcacaaggtgctccttgggagatggtgttagggagcttggcaggcattatgttaaatgccttcctccaaaggctgagttaatggacctgtggacagaattcaaaccaattttaatgcatagcagctgtcatttgctacccagtgtttgtgtgacccggaaggccacttcccaaaacactcagagagtaagttcccctttggtacaatctggattattatttcataagttattgataagcatatgcattagttatctattgctgtgatatagcaatagatatagtgagttgaaacaacaaacatatattgtctcccattttctgtgggtcaagaatccaggcacagcttcactgtgtactttcacagggttccagtaagatgtcatctggggctgcagtctctggaggagggtccacttaggctcactcatgtggctattggcaggatcaagttcctcaagggctgttgcactgaggtcctccgtttctcactggctgttcgctagaagcctccctcagcaccttgctatgagggtctcttcatgactcacacatggtagctggcttccatcagagcaagagagcaagagagtcagaaggcaggtctcaataatctaatctaggagatagtcactagcttcagcccacactcaacaggagggggtcaactaaggatgtgaatcccaggaggcaggatccctcctgccatcctagaagctgcctatcacggtgcatatgtatgttgttgtttgtttttcagagaccaggtcttgctttgtcacccaggctggagtgcagtagtgtcatcatagctcactgccacctcaaattcctgagctcaagcaatcctcccatctcagcctctcgagtagctcggactacaggcacatgccaccacacccagacaattttttttttatttttgtagagacatggttttgccatcttgcccaggctggtcttgagctgctgggctcaagccatcctcccacctcagcctccctaagtaatgggattaatagatgtgagctaccatgcccagcccacagtgtctctggatttttaagttacttagcatgacccactattagtataaaggaactcttgtatgtggctattgagaataaaaatggttcttagtgtaccttttagcttgaatgtatgttttgtgtttgcatattaaattttctctggaatgggatgtgattagatctgcctttcttttcttttttaagactgtgaatgaaagctggaatgccttagcaaccccatcagataagctgtttttctggaattccaaatctacgtatatcaaatcaccaccattctttgaaaacctggtatggctttttattttttaacaaaatgaattctttgaagggtttctttcctaataatatctactttattaccccatgctcttgctttgactacccattttattaaaccctttgcaaacccaagcagatactgccggggaaagttttgggaggctgggatatttggctgccgtgggtctatagtttctctatgcaggggttctgcgtggatgtacacagccaccctagtaatcacctggacttaaacctagtagagtctgagggactgtcccaggagaccatccccagagcccaccatagtgaaccttatacccataaaaaccagggacattgtccctgaaactgatgatctagaagttggtgctctcctgggtgggtcactgtgggaagggatgcagtagaagtgaggattccagttgtccttagcatctgaggagttctagggatgtgaagagagagaatgtcatttgcagctgcgttactgttgcttttgaggggatattgccagtattttaccttttcttcaagagtaagatatgaatgttttgagtaaattcaccttacttttcttggcctctttgataaaaactagaacactagaattttctgtgcattggtgtggaactgtcctctgattcaggtccatgggccaccatcgtagagactgatctggtaacttgtttgggaaaacctgggccaatgctgactttttgtattctttgctagactttggatcttcagccccctaaatctatagtggatgcctatgtgctgctaaatttgggagattcggtaacaactgaccacatctccccagctggaaatattgcaagaaacagtcctgctgctcgctacttaactaacagagggtaagtatgaatgaggcaggaaggactaaaggcaaaaatggaggaatggagttaatgaggccagcatttctcttttcacctggccctttggaatgagactctttggttgtgcactgaggcttaaccctggggtaaaaaccaattgcattttctgtttgctgcttaacagcttccatgggagaaacgatcaacatgtgaatcctaacaaggggaaggggagagggaccttcatttgagcaagtgtatatattaggcccaactgtcatccctgcccccggcttggctgatctttaaagtacaaggctctgctcttaacctggggcagaggcagaacctgacacgcattgccaggtcctggttgagaaacctaacgtttacagagcactgcttggaggatttgcagcttactcatctgtttatcagttcttcagtagtgtgctgatattcataggtatgccagtattatcaactactgtctcatatattaatcgaggtcagtggttccccaatctgagtttccacgagaatcacgtgaggacataaaaattcctggtttctatccccatctgctgaatcagttctttcagtgattccccagagcgaatttgaggaacagaatccaaatgccttttttctattgattgttgagcccttttgaggcatgaacacgtcagagaattgaatgaaagcaaatctaatgccttcccagaaaaatgcacatacccacaacattttggatagtttcagggattccaagacatactcacctgctcctgtaacccattaaactctctcagtccttaaattctatctaaccattgattaaataatattaacacacccaccccctagtattttaaggaacagctcagtgaactggtcacggtgttaattgtaaggtatgtttcctgacactgcaaagtttcctttcactgaggccccacagacaagatttcctctggtttggggaccagaagtagctgttctgcctctttagcactgcctcgatttttctctcatgaaagttgtaagttatgttgccagctgtgtgtctttcctttgcattgagttcctgataattcagggacaaatttgaaactatttctggttactttgtggaacgtattttgtgtttccccctgtttgtggctccatctgatttgcctaccctaattcttccctttgcttccattttctcacttatttttaatttagctctttatcttatatgaagctttataggctaccctactaacaaataaaacattcttttttagatttccttcttatttttctaaccagatttgaaagacagttaacccaggagaatactgacttatgcctctcaccaccccttctcacctctctctcttctccgttgaagctttggggacagcttttctgccatggagaacaatgcttaggagacttagagaaatagccaggtctatgttttgttttgttttgtttttttcttttcttggtgtaagctaaggttaatctttgcttgcttcactaagccagctcctttcttgcttgccttcttagcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatcgtgagtattgtcttctgcttcctgcagacactagcatttgtcagccttggtggaggttggatatttacagttactcgccttttggttttagtttttcttcacagctccatcctaccctaactacagtcctccttgccaggtgtccatatgcatagaatgtatcattgacaaattcaaaccttttcttcttgcttagagattctagaccgtggtttcactgagtctcttttcttaggaattgagctttgagtgacatttcatttaaagtattcgaaggggaaataccacgttaaattaaaggatatttatcaagaagtgctattgtatgactttattggcatgtaatttaattcatctaatccacatgaaaagaaggagtagagaggtgcttggaggcatgttttggttctaatgggagcactgtggtcagtatgttgcagcagggactgtttgttcccagctccacgttatactagctgtggagccttaaagttatttccatctctgagccttgcttttctcacctgtgaagtaaaaatactacttaccttggaagaacgctctgaggcttaaaatgaaatggaatgaaatataaaacctagcatagagtctggtacatgtcataggtccttagtgtcacttcccttcccagtgagtgctgtgaaattgcctgtaaactgtttaacttacttgagaaataaccctgccgacttattttaaaataataatcgctaatatgtctatggcacttaactacattccaggtgttctcctaagctcttggcatatattgatttatgtaatgctcataacaaccccttgaggtaggtaccatgattatctgtgctttaaactgagaagtgaagcataaagaggtcatattactcctttaggtcacacagtggaaaagctgaaattaaaacccagaaagtctggctctgaagtcagtgccctttaccaccacacatactgcctcactcgtaactgattatatttttgtaacacaaactcgttctttagaaataaccagtacctagcccagcagacgcctgttcaatggatagcagaggttacagaatattaaatgtaaaaagatacatgtcgaatgatggaataccttagagaccaaggggaaagacttgtagttatagacattgggggacccctaataaacatcacagtgtaccacacgcatttacaagccctgcatgacatagaacttctagtcagatgtctagaacctcatcttaaatgagacagaatcaaggatgaacagacatttgagtcaagacttgaacagggtgatggggagtgcaaaaagtaaaagaaaaaaattatatacttagagaagagttcattttctgttgctatgaaataacaatcagaagacaagaaagaatgttttaaatttaaaaagaaaattcaaaggagaaggtgattagttgagaacatttcctagaatatgtaacagaaagataagagaaaaaaatgtaagaactgaactcaggaggccctaacaacctgcctaaatagaagtgttaaaaagagaacagaaaaaatgcaagagaggaaattatttcaaaacaaaacaaaaaactacaagcaaaatttctctgagaatccagattgaaaaggcccactgaaggcccatctaaataattttaaaacactccaagttatatcactgtgaaattaagagcaacaaaaggagaaatctcaacatttccagagaaaaacagctcacatgaaacaacaggaaataagacatgttccagacttcttgatgctagaaacttagactgaggaaaatgatttgcatcctaaaatctacacccatcagaccatcagtcaagtgcacttaaagtaatgacacattcagatattcaaaagcttaaaaaagccctcaataccttccttaggaagctacttggcaatgtgttccaccaaaatgagggagtaaatcaaaagggaagacataggatccagatgaagggaatccccaggatgctagtgaaggaagagtcctctgtaacaggaatgcaccaagcccagagagcaagcagtcagcccaagttggaacgggactgagagctccaggaatgatagctccatgacagagattttaaaatggtaaattgcctgatgtgtctgaatatctttaaaggtgatttgtactgtagggtttaattaatgggtaaggacatagaaacaggaaaaacatagaaaaaatgaaaattagtaattttcaaaaaaattcattcaaaacaaatgaaaattactgactccagtgaaacatgtcttaaatcaccaagaaaaggaaatcacagcacattacctggctcagctgtaaatagtatttatgtagtcataatcatgcaaacaccaaatgctgacttaccaaaataactatattgggaggttgggaagaagggagatgtgtggaagaggagagattgttaagagaagtaaatcctcaaagtagaatattgacagataattttaaaaagtggagaaatcaagaactagtagtttaaacataatacctagagatacacaggcacagtaacagaagaaatagctaaatgctatgttctctttagaagagcgtaagagtgcagggagctgttgctttctaagctgtcagtggctctcagcatggcgtgtttaatagaaaagtcaggagacgtgagttctagacctgcttagtccctctgatcttgggtaacatgacgtgctttgccatgagattgtcaactttgcagtactttttaaagcacacactctcacattgttaatacccaaagctacagtctctgaaaatatcagataagttgtttctttctggtctttgaaaggatccagacaattcagttagaagaaggttttcactgtttctatgacagtttctatatttacgagttctgtctagctgaagacatacagaatcctatccgggtttaggtaatgcatgcgaaattaaccacaggttccatcagtacaccaaaatacaaatttgtgaaagtctgtttgagagttttctttagctcctgtctctcttttgaggaattttatcttctgacttacatagcctggaaaaataatggtactgctcaaccaccagagatgatatcatgtctttgtaaagtctcagttcagtgagatattcagattccctgtgagaaacaaatctgtttgtataagatgtttctcatgtactaaaatattaatctttttctaccttttattgggcttccatttgcatttctagcatctcttcccttgacctccatgaagaaaggggactgataaaagtttgcactttatataatttcagaacatgttaccttctttgtgttttgctaattttacaactgacatcaccgagtttctgatattgagccaaaatgtttaggtcacattctgttttttgagttttaaaataatttagtcaatggaaaagaaaaaatctgatctagtttccttttctcccctgatgccttaggattctaatgtttttataaaaccaacaacaattaggcatttctgtcaaaagaatataaaatggtttttaagaatacaaaatttaaggccggatgcagtggcttacgcctgtaatcccagcactttgggaggccgaggtgggaggatcacttgaggtcaggagttcaataccagtttggccaacatggtgaaaccccatctctactaaaaatacaaaaattagctgggtatggtggtgtgcgcctgtaatcccagctacttgggagactggagcaggagaatcaattgaaacccgggaggtggaggttgcagtgagctgagatcgtgccactgcactccagcctagacaatagagtgaaactctatctcaaaaaaaaaaaaaagaatacaaaatttaatttggtagaagtaaaaagatcaagataattgggaatttgtagacaagatgattggacggatttggccatctgcaaacccatccagccccgccctcaccagggctcaggggacctgtgtccattctttgcctctcctgcatctgtaaaacttccttttctcttcctcagcttgatgtgtttgatgctgctgagcggtaccagcaggcaggccttcccctgatcgttctggctggcaaagagtacggtgcaggcagctcccgagactgggcagctaagggccctttcctgctggtgagtatgaagtagacatcctaggaggcagctcccctctgaactgggagggtccccaggcacaaatcctgttgctttactttccaagaagatgtcaaggaagagcaagctcaaaaaagcaggtagtgtttattcctggcctgcttcttggtgcctctggatttattttatttggtgaagggcaatgcagagttgaactggatctatcattcattaatggaccttgggggcatgtctatagaacagttttggggtagggtctgtgaagtctctgaaaacatatccagaagtatacatgtatgtctttcatggggagaggtgtcatggcttttataacattctcagaggctgaggaccccaaatttattcaggtcccttgttccaggtgaatgtcaggaataagccagggccattgtattatctgtcagtttcacagaagagaaaaggagcctggactttttcaggagttactttggcaagaatgggttctaagtctcctggaaaattgggagaatcactttttataattgcacttcactgcctatgaatatctgcttatgggctctcgatgagagtgaaactcactctgcacatacccaggcagctctttagaaccttccgccatctcggggctctacctcttgaggtgtccccatagaaggggccatgcagggagcagagagcttttgcctcttgagcatttgcttgccctaaaagcagagaagaatcatgccacccagcctgaatcttcagggtggggtacacatggcttacctgatgtcaatttaaatcatttgtggctcgcaaattaatgcacctcggaaacactaagttcatatccacaagtacagtaaaaaaatgtggctgtctggcaggcagttctccagacatttaggcttctgataatgtctttgaacatcacacctattattttaattggttattttgctctgaggaaaatagaaatgttctctgattagttgatagtaggtcaaaggcctgtcttttctggaaactattgaaaagaaccagataattgcagaagaaaaggattttaggaagggggttgggagctgtagccaaaatgcaacccaggcagtcagcactcaggtagggaactctaagatctgatagaggataagaagagaactggcccccaggggttctctagagtccagacttttctatagaaccgcttgagttctggctgcccaggaagccatacagtcttctgttctgtagctgtccaggctgggccacgtagccgtgctggactgtacttacagagagcagtggacagctatgatttacagcttctgaagcaaagcagcatggcctttacacagagctagtgacatgaatagggtgtgtttagaaagctttctacctccctagaatacatccatctatccctaaaaccctagaaaagatctaccgccccaaagaatctgccctctctctgtagcagtgcgtctcaagtttggaaacacttatgggattttttttttttaatactttaatacctgtgtttggatctcatctccagagattctggtttaattggtaaggagaaaggcctggacattgggattttaaaagcctcccctgctgattctggtatgcagcagtggttgagaaccattgcgctatagttcacggttctcaaaattataagaatcactagccccctcccaccccacgctccctgcaagacattctgatgcagcagatctggggtagtacgcaagtatctatgttttcaacaagctcctaaagtgaccctggtgttgggcatcttaaaagtgtgccctagataccaagagacctcttagggtattttaatattatatgacagttattaattattaataataaactaatggggagttctagttaatggagtaccgtcctttattgctgtatattgccaattatagattcccaataaaacatactttaagcttaatatcaagactatattcaacacaatttcatctttgaagcaggaagtgtaaaagcagtacacaagaggtaatcatttactttatctgtggtatgttctgaaagttgcttttttgattgaactttctgtgcctgctgatacacctaaaatagtagaaaaaaatcaagggaaaaattttatgttgttttgtgatgtggattccagatacaatgtaactttgctaaaacatgttatatcatttgtcagacttcatgggtccaattaccagataccagcactgactccctgggtaaagggggacaataagggcatctacatccccgggttagtggatggtggaatgagaggaattatttaagtgcttacatagtgcctctacattatgagcaatcagtgaagactagctattgtgttatttatcactagaggataacattttatgtaaaatattaatatgtacttacaaataatttaggtgtgagaacagttctaacttacaaagtcttttgtttatttttgtttttttaacaatcaccggctcaagaagcttataatttggggtagggcacagaccagtaaatagacaattacaaagcaatataacagaagaaagcacggtgttatgaggcaaaaataaggaccactaactgaaaatttattaagccattttctgtcatcctagatgtattcaagatgtaattcccttagagtacaaagttaatgtaaaaaaaacgcttcattgtgaccttcagtctagaagatgtatggcaaaattaggctgaagcatctttttctcctgtgacattagacatctgatttcactgaaatatagcacacaattactggaaatgagggcctataaaagtccacaaaaccaagtgacttttcaagatataacagaggtaaaaggttactgtcatcactgtctatgaatcatctcattatcgatattctagactttgaagtaaaataataaaaagtttacttaaagcaacagcatcagataattaaacaattctttggtatttaatactaatatttcagaaatagaactccagagtatttccagatgtgcatatgctgatcgatttttaggtttatcatccttcgctttataacggaagtcatttcttatacattgatagaatgtagtatgagtgtagtgatatttttcactctgacattaactaaaaacatggtgtaaatggagaattatagaggtagcaaggcaaaggttacaaaatatatgcaaacatttttgtttatttgtatgctgtatttcattgttgtgtttttattatactttaagttctggggtacatgtgcagaatgtgcaggtatacatgtgccgtggtggtttgctgcacccatcaacccatcatctacattaggtattcctcctaatgctatccctcccctagcccccgacccgccaacaggccccagtgtgtgatgttcccctccctgtgttcatgggttctcattgttcaactcccacttatgggtggagaacatgcagtgtttggttttctgttcttgtgttagtttgctgaggatgatggtttccagcttcatccatgtccctgcaaaggacatgaactcatccttttttatggctgcatagtattccatggtgtatatgtgccacgttttcttaatccagtctatcaatcattgatgggcatttgggttggttccaggtctttgctattgtgaacaatgccacaataaacatacgtgtgcatgcgtctttatagtacaatgatttataatcctttgggtatatacccaggaatgggattgctgggtcaaatggtatttctggttctacatccttaaggaatcgccacaccatcttccacaatggttgaactaatttacactcccaccaacagtgtaaaagcattcctatttctccccatcctctccagcatctgttgttccctgactttttaatgatcgccattctaactggtgtgagatggtatctcattgtggttttgatttgcatttctctaatgaccagtgaggatgagcattttttcatatgtttgttggctgcataaatgtcttttgagaagtgtctgttcatatccttcacccactttttgatggggtgagagagggcatccttctcttgtgccggttttcaaatggaatgcttccagtttttgcccattcagtatgatattgactgtgggtttgtcataatagctcttactattttgagatatgttccatcaatacctggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttggtaggctattaattactgccctcaatttcagaacttgttattggtctattcagggatttgatttcttcctggtttagtcttgggagggtgtatgtgtccaggaatttatccatttcttctagattttctagtttatttgcgtagaggtgtttatagtattatctgatggtattttgtatttccgggggatcactggtgatattccctttatcattttttattgcctctatttgattcttctctcttcccttctttattagtctggctagcagtctgttttgttgatcttttcaaaaaaccagctcctggattcattgatttgattttttgaacagtttctggtgtctctgtctccttcagttctgctttgatcttagttatttcttgccttctgctagcttttgagtttgtttgctcttgcttctctagttcttttaactgtgatgttaggatgtcgattttagaactttcctgctttctcttgtgggcatttagtgctgtaaatttccctctacacactgctttaagtgtgtcccagagattctggtacgttgtgtctttgttctcattggtttcaaagaacatctttatttctgccttcatttcattttttaccagtcattcaggagcaggttgttcagtttccatgtagttgtgtggttttgagtgagtttcttaatcctgagttctaatttgattgcactgtggtctgagagacaggttgttatgatttccattcttttgtgtatgctgaggagtgttttacttccaattatgtggtcagtgttagaaaaagtgcagtgtggtgctgagaagaatgtatattctactgatttggggtagagagttctgtagatgtctattaggtcagctttgtccagaggtgagttcaagtcctggatatccttgttaactttctgtcttgttgatctaatattgacagtggggtgttaaagtctcccactattattgtgtgggagtctaagtctctttgtaggtctctaagaacttgctttatgtattgggtgcatatatatttaggatagttagctcttcttgttgcattgatccctttaccattatgtaatggccttgtctcttttgatctttgttggtttaaagtctgttttatcagagactaggattgcaacccctgctttttttttgctttccatttagttggtaaatcttcctccatccctttattttgagcctatgtgtgtctttgcacctgagatgggtcttctgaatgcagcacactgatgggtcttgactctatccaatttgccagtctgtgtcttttaattggggcatttagcccatttacatttaaggttaatactgttatgtgtgaattggatcctgtcattatgctgttagctggttattttgcccattagttgatgcagtttttcatagcatcgatggtctttacaatttggtatgtttctgcagtgactggtatcggtttttcctttccatgttcattgctttcctcaggagctcttgtaaggcagacctggtggtgacagaatctctcagcatttgcttgtctgtaaaggattttatgtctccttaacatatgaagcttagttcggctggatatgaaattttcggttgaaaattctttaagaatgttgaatattggcccccattctcctctggcttgtagggtgtctgtagagagatccattgttagtctgatgggcttccctttgtgggtaacccgacctttctctctggctgcccttaacatttttttcttttgtttcagccttggtgaatctgacaattatgggtcttgttgagtatctttgtggtgttccatgtatttcctgaatttgaatgttggcctgccttgctaggttggggaagttctcctggataatatcctgaagaatgttttccaacttggtttcattctccctgtcactttcaagtacaccattcaaacgtaatttggtcttttcacatagtctcatgtttcttggaggctttctctgtttcttttcactcttttttctctaatcttttcttattgctttatttcattgagttgatcttcaatctctgatatcttttcttccacttgatcaattcagctattgatacttgtatatactcacgaagttctcgtgctgtgtttttcagctctatcaggtcatttatgttcttctctaaattggttattctagttagcaattcgcctaaccttttttcaaggttcttggcttccttacattgggttaaaacatgctcctttagcttgcaggagtttattaccacccaccttctgaagcctgcttctgtcaatttgtcaatctcattcaccgtctagttttgttcccttgatggtgaggagttgtgatcctttggaggagaagagccattctggttttcggaatgttcagcgtttttgtgctggtttctccccatctttgtggatttatttacctttggtctttgacattggtgaccttcggatggggtctctgagtggatgtccttttggttgatgttgatactattactttgtttgttagttttccttctaacaagcagactcctctgctgcaggtctgctggagtttgctagaggcctacttcagaccctgtttgcctgggtatcaccagcggaagctgcagaacagcaacgattgctgcctcttccttcctctggaagctttgtcccagaggcggacccaccagctgccagccagagctctcctgtatgagatgtcttccagtcaggatacatgggggtcggggacccacttgaggaggcaatctggctttatcagagctcaaatgctgtgctgggaggaccactactctattcagagctgtcaagcagggacatttaagtgtgctgaagctgcacctacagccaccccttcccctaggtgctctgtcccagggagatgggggtgttatctataagtacctgactggggctgctgcctttttttcagagatgccctgcccagagaggaggaatctagagaggcagtaggccttgctgagctgcggtgggctccacccagtttaagactttgtttacactgtgagggtaaaaccacctactcaagcctcagcaatggccgatgcccctctgcccaccaagctcgagcatcccaggtcaacctcagactgctgtgctagcagcaagaatttcaagccagtggatcttagctttctgggctccttgtgggtgggacccaccaagccaggcactggagggaatctcctggtctgctggttgtgaaggccatgggaaaagcgcagtatctgggccagagtgcactgttcctcctggtacagtctctcatggcttcccttggctaggagaggaagtttcctgaccctttgtgcttcccaggtgaggtgacgccccaccccacttgagcgcatcctccatgggctgcacccactgtccaaccagtcccaatgagatgaaccgggtacctcagttggaaatgcagaaatcacccgccttctgtgtcagtctcactgggagctgcagactggagctgttcctattcggccatcatgccagctctctcacaaagtcttttgtaaacctgtgtatccaaagaaaagattggaagtatgtctaaactactgtctttattcatcagggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaaggtaagctggagcctctctatgccaggccctgtcgaaaggggccccctcgtttgtaaccagtcttgttagaaggaaattagtgaggtttagaaggcaaaaaatatcactcaggaggactgcattagacttaggaggcctactagcatcttttctacctgccttcacagcataggatgatgcctatggatttaatttctctgtttattcacagagttatcctcagttccattcttacctcccaccccctactgtaccctgttcccggtctctcgtgatgagagctcagggatgtgacatttcacattacctaaaacatttcactataaaaacgtgagcaacagatatactcacccctccctaagcctgcccataggcaccaggctttgattagcccaagagtgaaaatgatagatccctaggcaaggtaaagataaagtgcccagcaccaggtcccaggggtcattcggtgccccagacagaggcagtgcaaaagtctgtgtctcagataagcagatgggccagctgcctaagggacaaccttaatgaaatctctgctgattgaatacttctgtccacagggagcccccagaggtttagaaaataccaccctgatgtcattaatagctactgccctgagaagctatttctagttcttagatggctctcacccccatcatttacagtctgcagtgattctcaaactgtaatgggcaaagcagcctcccagagatcttgctgaaatgcatcttctgatttagtgggtctgggctggggccagcagccttgcatgtcctcatgtgctgctggtgttactgaagtgtggaccacacctgaggggcaggctgggcagaatttcctccgagcagagctgtctcgccacctccctcaatgatgcttctgtttctttgtgccacagctggatactggcaagaccttccaggctgtcatgaggtttgacactgatgtggagctcacttatttcctcaacgggggcatcctcaactacatgatccgcaagatggccaagtaggagacgtgcacttggtgctgcgcccagggaggaagccgcaccaccagccagcgcaggccctggtggagaggcctccccggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtgaaaacttgttgactttgagttttgctgtgtttgtggctagagttttgggatatttagtacagagtgaatctcacaccatatcattgggaagcctgaataaccttcatattctcccatttttacaactctatcagaactgtacgggtataacggaaatgtttaggaaccattatgctcgctcttccctgtttgggagcagacaagaaggaagagtagcctggtggcagtggcaacgatataagtacataaggaaaagcagataaacttcaggacactaaaaaccaattatctgctcatttttacccctgtagtcgtttctgggcatgccttagtttgcttgggttgctataatgtaatgccatagactggctgaaagaacagaaatgtattttctcacagttatggaggctggaattctgagatcaaagttgaagccacttcattttctggtgaggacactcttcctggtttacagatggccaccttcttgcttgttctcacatggcatttctttggtatgtgcctggtgggggagagagaaaataggctctcatgtctcttcttacagcaacactaattgtattggatcagggtcccactcttatggagacccaggaaagctggtggtataacaacttggttcaagtccaaatgcctaagaacctggggaggggcatggggaatgctggtataagtcccagagtctgaatgcccaggaacaagcaggagctgtgatgtccaaggacaggagggcaggatctttgtaatgaatttttaatgtcaaccttagcactcaggggatatggcctggtcatcagaacatctggaatctaatcctctttctacttctcaccagatgagggatcaagacaggttatttagcatccctgcacttgcggtcctggggatcttatttatattcatttaaaaaataaattacaaacaaacagccaggcgcagtggctcatgcctataattccatcactttgggaggccgaggtgggtagatcacctgaggtcaggagttctagaccagcctggccaacatggtgaaaccccgtctctactaaaaatacaaaaaattagccaggtgtggtattgtgtgcctgtaatcccagctacacaggaggctgaggcaggagaattgcttaaacccgggatgcagaggctgcagtgagccgagatcgtgccattgcacgcccgcctgggctacaagagcaaagctccgtctcaaaaaaaaaaaaaaattacaaacaaacagaactccattgtacaaaaaaacctgtgatcctcaagttaagatcagtcctagaataaaaacactaagaatggctgagaaaacagacctccaccctctcagctctccattactgagcagctggggagctgtctcgctccccgcattcagtggctcctgtggtctgtatttttgtatcctccccaaaattcaggtggtgaaaccttaaccccccaggtaatggtaatagaagctggggcctttggaaggtgattagatcatgagggtagtgccttttaaaagagactcaagataagatagagaccccctcatttcttctgccatgggagaacacagcaagaagtcaccatccgtgaaccagaaagtgggttctcaccagatactgaatctgccagtgccttgaacctagactttccagccagaactgtgagaaatttctattgtttataagccacccagttgatatttagttacagcagcccaaccaagactgtggttatgagg

SEQ ID NO: 15639 - DNA, 112112 bp, Human
gctgaggcaggagaatgctgtgaacccgggaggcagagcttgcagtgagccgagatcgcgccactgcactccagcatgagtgacagagtgagactccgtctcaaaaaaaaaaaaagaacctctgtcctagagcatttataattcactacagaaatgtattctatgaaggactttaataccatcagtcagccttatccagacgatctcaattctaatcctgtcaccaccactttctgactgagggctattggagaattttctcaacttctctgtgcctcccttacctcatcaattattattatgtatgtgtatgtgtgtgtgtgtatatatatatatatgtgtgtgtgtgtatatatatgtgtgtgtgtgtgtatatatatatatatgtatatttttttttttttttttttttttttttctgagacagagtctcactctgtcacccaggctggagtgcagtggcacaatcttagctcactgcaacctccaccttttgtgttcatgcgattctcctgcctcagcctcccgtatagctgggaacacaggcgtccgccaccacacccggctaattgttgtatttttagcagagacggggtttcaccatgttggccaggctggtctcgagctcctgacctcaggtgttccacccacctcggcctcccaaagtactgtggttacaggcgtgagccactgctcccagcctatttttatttacttttttttttttttttttttttgagacggagtctcgctctttcgcccaggccagactgcagtggcgctgtctctgctcactgcaacctccgcctcccgggttcacgccattctcctgcctcagcctcccgagtagctgggactacaggtgcccgccaccgcgcccggctaattttttgtatttttagtagagtcggggtttcaccgtgttagccaggatggtctccatctcctgacctcgtgatccgcccgcctcggcctcgcaaagtgctgggattacaggcgtgagccaccgcgcccggccttttatttactttttgagacagggcctggctctgtcacccaggctggagtgcaatggtgcaatcacagctccctgtagcctcaacctcctgggctcaggcaattctcccacctcagcctcccgagtagctgagactacatacgcatgccatcactgctggctaatttttgtggttttgttttgttttttatagagacggggtctcgccatgttgccgaggctggtctcaaactcctggtctcaagcaatcctcctgtctccgcctcccaagtgctgggattataggcatgagccacccgcgtctcatcaattaaataaataacccctaggacgactaagatgtcttcaagattacatgagatcccacatctgaaggtttttgcaaaggacttggcacaaactcgtgcgactagacatggatatggctcttgctctggaaaggatcaccttgataggagcaaacaaagctggtcttcggtgccctttaatctcccctcccagccttccaccttccacactttaagagtcgtccctgccgaccccccgaccccgtttttctgaacctcccttcctccccttgcatagtccaaagcctctctctaaagcagccccccgaaaacatctgtcaagttccaaacttatctgaatcggaagctaccaatagccaacctacatctaaggggaactgtaagatttcagaagaacaagaagcataggtcgcttaggcgtgggccacccaagaagagagacttaacactaggtaagcccgcgctggctgcgaaggcgggagcggcaccaggaccatccagggcgcaggcgcagggacctcacggccacgccactactcagcccgagctggccaatggggagcggcggccggaagaacgcgcggcttcgctaggttccgcggcttcctctgaccaagcttgacgtcaccaaagcgcgccggaaatgcgaggtcaactgcgcgccgctggcgctgaggggaggaagtttgctgtcgagcggcctgggttccgtgggcaaggccgtgggaggcagcgttggctgcttcgacacactgagggcggcgcgatgggagacgagatggatgccatgattcccgagcgggagatgaaggtcagagactaaccggggcctccctcccttctttagtcctggcgttgccttggagcccagctgaaaggcgaagcgcggtgctggctgtcccgcctcctgcttgaacagtttaccgcgttcacagctctcaccagcgcgtctgccgcgccgctggcgtgatagccccaccgaatgcagtttcccagtcccatcctggtctcgtgcacggctgttgagttaccctagctacttcctggggcggtcacaatagtggcaataactgctgtttattgagtgttgactgtgtgccaggcactgtggtagtcatcgcggcagccctacgaagtagtcgttaacgtagaggagtaagttgaggctcggaaagtaatttccctaaagtcacatttgacgcggggctgaaagccagcatcatttaagacctttgctctcccagtacttctgtaaggtgatacgggcttgcctaacgtagagtcagggaaggtcatccatcctgcagaacctttagttgattggactaggaagactattttgacctcggtatatcagcctaaagtcaggaacctaaagggagggccaagtggtcccagtgatagcaacgtgggagtcccccagggataacttcaggatggtgtgtttaatagttcttatatgggttctgacagaatgaggctacaacagacgggctacatctgttttaaatagtgaaaagaagtaagttgcaggaagattttaggcatctgtgtgaacaataaatcactaaaatgcatttagggcatagtaataccatgtttagaatagtgatttttttttttttttgagacagagtcttgctctgtcacccaagctggagtgcagtggcatgatctcggctccctgcaacctccacctccccggctcaagcgattctcctgcttcaacctccctagtagctggtattacaggcgcctgccaccacgccccactaattttttatatcatttggtagagactgggtttcacgatgttggccaggctggtctcgaactcctgacctaacgtgatccgccctcctctggctcccaaagtgctgggattataggcgtgagctaccgtgctgtcctagaatagtgattattttttgagaatcaccacctgtggtgagccacctaatggggttgtgtcatattcctcagatatgctggggtagaagaaaaaaaggttttattaatagaaccacagacttagaagatggtaatctcgcactccctttggcagcacatataaaattgggatcatgcagagaagactattatggcccctttacatggatgacagacaaattcatgaagtgttccatatcagaaaaaaatgagggccgagtgtggtggctcatgcctgtgagcttgcactttgggaggctgaggtggatggatcacttgaggtccggagttcgagactagcctggccaacataatgaaaccctgtgtctactaaaaatacaaaaattagatggccatggtggcgggtgcctgtaatcccagctacttgggagtctgaagcaggagaatcgcttgaacctgggaggcagaggttgcagtgagccaagatcgctgcactgcactccagcctggacgacagagcgagactccatctcaaaaaagaaaaaaagacaattgagacagaccttggtctcagtaatacatatttttgttgtactgaaattgggtctactgaatataacatgttttaatttctttctttattgaattgatctcgttttgattcttcacaacaggattttcagtttagagcgctaaagaaggtgagaatctttgactcccctgaggaattgcccaaggaacgctcgagtctgcttgctgtgtccaacaaatatggtctggtcttcgctggtggagccagtggcttgcagatttttcctactaaaaatcttcttattcaaaataaacccggagatgatcccaacaaaataggtaagttccctggtttatgttgcaaagtagagagaggagtatggtggcatgctcttgtgtttccttcccaagaagtcattctaatactaaaatgaacactgctgtcagtttgaaggttgactcccaagaagattaatggaagcctttctaggttttttccttggtcctttgtatttctccttacatgagttgttcctctcagctcaacagggaagaacttaaccattatgccatgcttttatttttgctcagttgaacttgggctctggctctctgggtgaagggttttattggcatgggttttcagttggcacaacagtatgatccaaactattggcaaggtgtactatttagagcattgttgcaaaaatattttcaacaagggcagcagccacagttagtttccccagattgtatgaggaagaattccagggatacttaatccatcattatatatctttaagaaagttaagatttatctgtataactaggtattggggtgtatgtgtgtttatgtagatgcaaaaattttttcacatcgaactggatagaggttgtggctttatgcttagaacataccgttttctgctttgtatttttttgttttcatagttgataaagtccaaggcttgctagttcctatgaaattcccaatccatcacctggccttgagctgtgataacctcacactctctgcgtgcatgatgtccagtgaatatggttccattattgctttttttgatgttcgcacattctcaaatgaggtaagctactgttatactgtgatgtcaacatgagaaccctaagcagatttccttgtattgaattacaacttggaagcttcataggttaacccttgaagtttctctctagattaaaatatgggttaaaaaaaaatccttaattatagaatcatagatctttgagacagaagggacttcaagaaattctttcataacgccatctgccctaagttgttatcaggaggcttaggtgacttgcccaaagtcatagatgaatacataatgtcaaaagttcctacattttggatgttcttccattccaagcagtttaagaatgataataatagtgagtgtttatactgactgtgtgtgttagactctgtactaagtgctttatatgccttgtccctcgttcatgcctaccacagccttatgtagtaggtactattatcttcattttataggtagagaaacaggctcagagtttaagtaactgtccaaggtcccaacattattaagaagcagagccaagattttaatctattgtctgctatttattggttattttgcaattgtgcattccccttctgagagtccccctaagcatgttagaataattgattgccattttcaaagttgtgttgaaattgtctatagcaaatagattgatgcataaaacaatctttttttatggttatggagaaaaataaactgatttgagataccttgtgtattcagtaatttccattgaatattaaatgtttctgcatttactatttgttaacttatttcacttttgcatatttgttttaaaaggctaaacagcaaaaacgcccatttgcctatcataagcttttgaaagatgcaggaggcatggtgattgatatgaagtggaaccccactgtcccctccatggtggcagtttgtctggctgatggtagtattgctgtcctgcaagtcacggaaacagtgaaagtatgtgcaactcttccttccacggtagcagtaacctctggtgagtaataaaggctttcacactgtagcatacaatcatggtcatctacttaagaattgatttctagaagtgaaagtggatagctttttgtgttttggttttttttttcatgacgagggaggttaaggatggaaggtattcttttttgagacagtctcactgtgtcgcccaggctggagtacagtggcatcatctcagccactgcaacctccacctcctgggttcaagcaattctcgtgcctcggccacccaaatagctgggattatagacatgcgccaccatgcccagctaatttttgtattttttgtagagacaaggtttcaccatgttggccaggctggtcttgaactcctgacctcaagtgatctgccctcctccaccccgcatatgctaggattacaggtgtgaggcactgtgcccggctgagagtattctttatacccatagttaatgtccttgaagccaaacagcatacataatttaacctgaatgtacttgggatttctggagaaatattttggtacagctggtttagaagtgttttttgggaataattgtttctggatctgtaacggtggtactctgaaagtcatttgtacctttgggcggaaaagcattttaaatattaaatgggagcaggagaatgatttctggttttgtttttttttttttttttttttttttgagacagagtcttgctctgtcgcccaggctggagtgcagtggcgcgatctcagctcactgcaacctccacctgctgggttcaagcaattctcttgcctcagactccagagtagttgggattacaggtgcctgccaccatgcccagctaatttttgtatattttagtagagacggggtttcaccatgttggccaggctggtcttgaacttctgacctcaagtgatccgtccgtctcatcctcccaaagtgctgggattacaggcatgagccactgtgcccggccagtgatttcttggtatttggaaaccttctctgttctccttgtcttatgtaaagactacagagttttctgtattttgcagctttctgggcagtaatctattgaaaaagcatttttagctttcaattcaatagcccagtgataaatcaattggcttatatcgttaaaatgattttacttttttccactttgcctgatagagatgatcctacaatcttccatggactgacagaggaatgagaattgataattagctgtgtgtgatagatcttattggtttgctccattttcttgttttcatttggtaatactgtctttgctcagtgtgctggagccccaaaggaaagcagctggcagtgggaaaacagaatggaactgtggtccagtatcttcctgtaagttcttatcttgaacttcagaatttttcttaagttgcccacttttttgggggtggtttgggagtatctttcttgtttttcctattaaaaagtaatttatactcattgtaacaaatccatcagtgaatgaagagtggaactcttccctttcccatagtccttcttccagaggcacccactatgttgtgttgagtagatagccttccatacttttctggatgttatacaaatagtctatgggtagctgctttttttttgttgttgtttttatgtaaaatgtgatcatacgctatgcgctgttccccacctttttcagtccattccataaaaacagctcaagggaaaagagttagtgaaaaaactatgatgataatgcagaatcactctgggttaaagcacagtatttgtcttttaactgagtctgtctttaaaggtctgtttgtctaactatgggcaccaaagaaaatggatactcttgttgcatgtgcactctgtcatcctccctgtgaatttcttgaaataatgttcacaaatatccttcaatatcaattgagttgcaaggaacccccatatgtctattgagcctggacacgaaggagggattcacaggtggtgctaaggcctttcttgtgccttcctcctcaagactgttctctggcgaggaggggagcagagtggtgaatgtaggtggtataggtttaaggttaaggttatgtttcttatttgttattaccaaaagttacctgaaatttggtacataatcttttaggacactaacctgtaaaaagataatgcaattttttaaattttcttgctttgctgtttgccttaattttttatttatttattattatttttttttgagagatggtcttgctctgttgcccaggctggggtgcaatggtgtgataacgtaatggttcactgcagcctcagcctcctgggctcaggtgatccttccacttcagcctcccgggtagctgagactacaggcacttgccaccatgcacagctaatttttgtattttttgtagagatagggttttgccatgttgcccaggctggtctcaaactcctgggctcaagcagtgtgcccaccttggccttccaaagtgctgggattacagacatgagccacctcgcccagccttattccactattgatgattgtctgcatcagtgctagtggcgttgctgctgcaaatggtgttgcattgactactctcattacctatatctgaacatgttcatgcgttcatgcgtttcttttcttttctttttttttttttttttttttggagaccaagttttgcttttgtcacccaggctggagtgcaatgacgtgatttcagctcaccgcaacctatgcctcctgggttcaagcagttctcctgcctcagcctcccgagtagctgggattacggcacccgccaccacacccagctatgtatttttagtagagacggggtttcgccatgttggccaggctagtctcgaactcctgacctcaggtgatccacctgcctcggcctcccaaagtgttgagattacaggcatgagtcaccacacccagccacgttcatgggtttctgtaggatgaagtcctggaagtagatagcactattctgtttcttcagtctctcccggccaaggagatggaacaggtagcatctaaggaatagattagatttgacagtttgattggtttaggatttgtttcatttgatactttattttcccctccaaatctctttcagactttgcaggaaaaaaaagtcattccttgtcctccgttttatgagtcagatcatcctgtcagaggtaacaactgcttttcttattgggctgacctctaatgacatgttatgtatattacagaaattcaaaatcatgtaatgtacctgctcagtgaggtattggtgtttgctttatgaataatgtcactatttcaaacagctaattaagtcagtgtaaattatggccctctgggtgacatctgtgtttcacgataaatgacatgaaatggatcccgactttttattacaattcttcataatttgccctgattataatccagcagaaaaattaccatttggggatgagtttgggcttcttgggtcattgtacctgtgcattatatttagtcaatgaaatcagggcctttgattttttttttatccatagtggctattccaaacataagctgctttttcttgtatctggttgctgtcatttttatgagctactgattaagatgtgtctttcagttctggatgtgctgtggattggtacctacgtcttcgccatagtgtatgctgctgcagatgggaccctggaaacgtctccagatgtggtgatggctctactaccggtatgcctgtggaagaaatttcattgtttgagaattagagaagtcttctaataaagctggaggctttgatttcaaggggtttttttgtgtttgtgttttttttttttttttttgagacaagatctcactctgtcgcccaggctagagtgcagtgatgcgatctcgcctcactgaagcctggacctcctggactcaagtgatcctcccaccttagccttctgagtagctggtactacaggtgcacaccactatgcctggctaattttttttttttggtagagatggagtttcaccatgttgcccaggctggtcttgaactcctgagctcaagtgatctgcccacctaggcttctcaaagtgctgggattacaggtgtgcgtcaccgcacctggcctgatttcaggttcttttacttactggcagtgattatgcaacttcaggtataaggtttccatgctgcaccatgggccaggggtctaaaattggagtgtccacagcatgttctactgttatgaggttaaaaaaaaaatgattttgcttaagctataaactatgagtcttggttaactcgataaattttagaaaagcaagacagtatcttgatttttaaaattatttcatttgctctcgaatatttaatgccaacagtgtgctaggcactgctttaaagctgagtatatagcagtgatcaaggtgatgggcttgcttttatggttttaagtttgttgttgttgttaatttttatttattttttagagacagaatctcactctgttgcccaggctggcatgtagtggtgcgatcacagctcactacagcctcaaattcttgggcttaagccatcctcctgcctcagcctcccgagtagttgggaccacaggcatgcaccaacacagccagctgtttttaaatttttcgcagaggtagggtcttgctttgttgcccacgctggtctcggactcctggctttaagcagttctcccgcctcatctctcagagcactaggattacaggtttgagccaccacacctggctggtcttacattttaatgggatagtcaatactaaatgtgagatcaaggactgataagagtgatggagaaaataaagccgtgttagggatagatgatgactggtatgtgtttgagattgtgtgtcaagggaggccaatttgatacttgaaaaagatgtcttgtttttaactcttttggatttctaataaggttgagtttttgaaatatgtttatctagatgccttattttaagattagaggttttttctattctaggggataatattaacactagtatttattaactgctacttatgtttcatgtactgggctggaagttttgtatgtatcatttcattttacactttacagtagcctctgaagtaggcttagtaggtctagtatacacatgagaacactaagtatcaggaaggttgaaaaatctgcatgtctcgtgggcagaaagtggcagaacagagtttaaatgcagttcggttgatggccaatgtttgtactccttgtactaagtgctgcctttataccatgtccgtatatctggactttgagtaaatattctcatataactttaaatgatttattatttgagattcttttgctgtgggatctgagaaaaattgcacatgagaattttttttcttgctttgttcattgtagaaaaaagaagaaaagcacccagagatatttgtgaactttatggagccctgttatggcagctgcacggagagacagcatcattactacctcagttacattgaggaatggtgagcagagagtctggacagggcattcctgctctcactggaagatcacacctgagtcaccttgtcccatgttgaaatcttttctgattgattgattgatggattggcagggtctcactccattacccaggctggagtgcagtggcacgattgtagctcacagaagcctggaactcccaggctcaagtgatccttccacctcagcctcccagatgggactacaagcacatgccaccacacctggcttatttttaaataagttttttggtttttgttttttgtttttagagatgggatcttgctatgttgctcagactggcttcccaaagtactgagattacaggtgtgagctaccgcacccagcctgaaatcttttccattacagaggaaaatggaggctgagatgccttgaacatattttcagctgattcttgataatgtctttctattatttctgtttccccaatcttgaattatttatcttaaatacatactaatttcaaaaatctaattttctcaataacccctagtgatgacttacgaaaatattgatattcaaggaatatattaaaagtttcctgagagcagagttgccctttggaatggagattactcaaagcaaagcttccatccctctagctacattattctgcctttggatggcatattgattgtgaactgtgacttgattctgttgtgtctttcctttgtcttcatgtaggtaggcactgagctgattctacagggctttctcacagaaactaaaaagttcagctttacatctagaatcttcccacctttgttcaaccagataaaaaaccttactctctctttgacatgtggaggcagccctcacaggtgttacctgcagacccaggttagcttagaactattgctgtatttgaacgtaatggtctctggttttattctttaagggatttagtgctggcagcatctgcggcttcaacagaagttagtatccttgctcgacaaagtgatcaggtaaatctcttttttgtcacttctgtggtgctttcttttttaaattattattttgagacagtctcgctctgttgtccaggctggagtgcagtggtgcaatttcagcttactgcaacctctgccttccaagttcaagcaattttgtgcctcagcctcccaagtagctgggactgtaggcgcgggccaccacacctggctgatttttatatttttagtagtgactgggtttcgccatgttggccaggctggtcacaaactcctgatggtacttttctgaaaaagattttggagggaattaactatatgtggttaaggtatacatgatctcacatctgttttatcaagtttctgcgtgacagcaaagcttcagtgacagagtgccttggccaaatggcttggctattgcatggagaaacacgggtgtcagacttagcacttccttcgcttctgttcttttaggatccaacccctgtctgtggaaacataccatgcagttaacctccaactggagtatgcctgatgtgtaggcggctttttctgccttgtcctgttttgtcatctttgttttattcctgttgcttgaaacaacttctatacaatttaatgataatccatcctcagttatgaaagaaaaacatgcagatgacactaaattgtgattcaccagaagtactttctgtttgactttgaaaaactgtcagaaggagcaaagcacctttgcatacaagaaccttctttcacgttgtctttcttgcagggacacagtgggcccaggtagtggtggtgcgctatccacttgtagattttgcagaatgactgtagagagggcacaacgaaagaagggaaacttctttttaaaactggcttgaacttaaaaatctttagtgcacccttataaataagaagcaagtgcttctcctccccacatggatactttgtgctccacccatacataggtactttgtgcctcttcaaccattggcatttatctgtcactctctgggtggccaggtggcccattaggagggccatggctctcattgtctaggggtggctgcttttggatgaggctagagttcagccatctgatttgctgctctagaactatcttagattgacctcagtaataatttcttattagtacaagtatttcatatgttcacacattaaaaatgcaattttatttttactttctatcagaataatttatgttcatgtttttgaaaagtaaatagtagagaagggcttataagtgaaaagaatcacccctgccctacctgtttgctttctagaggggactgtttttaatttgtaaacattttcttataatgctgccaccttatccctaaagaaaaatctgctttataactagtaattggttattagttttagaccttactgactgtacggcaaatgatgatctagctcacacatggcccccagtcccctccttcctctcaagagttacagcgttgttttaatttcttatcttggtgaacctttgtaattttaattggtgttttttaccctcatttctggtggtatctttttttttttttttttttttttgaggccaagtctcactttgtcacccagtgcattggcgccatcttggctcactgcaacctccgcctccctggttcaagcgattctcatgcctcagcctcctagtagctgggactgtaggcatgcgccaacacgcctggctaatttttgtattttttagtagagacaggtttttgccttgttggccaggctggtctcaaactcctgacctcaggtgatccgcccgcctcagcctcccaaagtgctgggattacaggcatgagccacagctcccggtctggtgataactcttgatcttccactttgtgagaggagtgtcttagcactcccaccctttcccttggtagccttccagttgttatctgcgtcttctcttttgtaaaattgcattctgtcctacaatgataagtcatctttatcttgtctgtagactgtttttaaaagttgagattgtttttgtttaatatgaacgtgtctgttacctgctccatagctaagtcacatagtgtgatttcattccctctcctgaactgcctgcctgcttgctttcttgcttgctttctctctctctctcttttttcttcttccttccttccttctctttccttctccttccttttccttcctttccctccactcccctctcctcccctccgctctcctcccctcccctcccctccccataacctaggccagagtgcagtggtatgatctcggctcactgcaacctctgctttccgggttcaagtgattatcctgcctcagcctcccaagtagctgggaccacagttgcacaccaacacgcccagctaattttgtatttctggtagagacgggatttcaccatgttgaccaggctggtttcaaactcctgaccccaggtgatccacctgcctcagcctcccaaagtgctgggattacaggcatgaaccactacatccagcctgtttttctttgttggtctttaagcactattcccctgtgattcatgcttcccagtctggtcaacactgaaagttaggcaaaatgttagtgattttaaaaaccaagagtcatttgttggaaggaacagagcctatccaagcacacttaagcaaaaagggagtttactagaaagacttagtagtttctcaaggaatctggggacaggaaagctgaccagcctgaggaactggtaccaagaactgggaagaagaactaaggttatctctgtctctatagacgagtgagcgcagggcatctgagcacagaccagccttacatgcttctctgtgaaagactgcagtagagatcagctggagttcctggccccaatccaaaatgtctaggagcaggtattgactggcttagtgctgctgttggatttgtccctcatggtcagcaatctccctagttgtcatggaaggtacctcagaaaatgttcatgatagtggttatttatttacaaggcagaggcttgatacaccaggaacagatagagagggggttgatttggaaaattaacttcccatttgctggggtacttctggcttttaggccatcttctcagatttcagagcctcctagtcaacacctgagtctaaaccaagtgagtcatctctgttctcctatttgaacaatgttaggaggaaccaatgcaaagctctaaccaacatggctttttcttttttcttcttcttcttctttttttttttttttttttttttagattaattgggaatcttggctactggaggattctagtcgagctgaattgcctgtgacagacaagagtgatgactccttgcccatgggagttgtcgtagactatacaaaccaagtggaaatcaccatcagtaagtgtagcctggtagttagtgcagaaatagtcttctttctagttagggttaatattgaaacaccagttacatgttactgacagagtctactctgctgggcacttgtagcttctggcagcacatttctccctgaagagtgataataggctgcgttgtgacaacactaaactgatttgaatggatgttcgttgatgagaccaaggccaaacactgtatgtatgtgtgggtgcatgtttgcacacttgcacatgtctgggtgtactttagaatctggttgaaatatagaacatcaggattttatggcttggtttctttgtccaatccaattccctggtgacctcccaaagaagcaatacccgaatctggtactgcacacaagtacttggtttgaaggcaaggattagaaaatagagacctcaggcccatggtttccaaatagggcctagatatgtgttttgaatagatcttccctgcagtagcttggctatactgtagtcattgaaatgtaaaagtgccacaaaagaaacagtctttgccatctggtacttaagtttagagaggtgtccccgtcaggcaccattaagttgcttgctccttccctggttaggcaggagtatttgttctgataagctcatttgctctgattctcttgaagccttaactgataaaatacatacttgtcattcagctgtgaatgaggataaagtggtttgactcatctttctgtgtcctactgtccattccaaagagtctagtctcattttcctactaacctaagtacttcttagatattcttctcttggtcaggggaatgccaagcctacctccactgaggtacacaagccactgagacactcataaaaactgagggacctttgggagagtcagagctactgcgggactgatggagcttctaggcagggcccagcagggtggtggcgatctgatagcggcaggaactctctttaaatagctggtgcacgaaaggctgttcagatataaaatcagaacaaactaacttgagctgctattcagatgagtcccttaaaccctcttcatgttgagggcagtctttgccttctgggctcaggcccttaaattcacttggtttttttatttttgttttcttttttaacaggtgatgaaaagactcttcctcctgctccagttctcatgttactttcaacagatggtgtgctttgtccattttatatgattaatcaaaatcctggggttaagtctctcatcaaaacaccagagcgactttcattagaaggagagcgacagcccaagtcaccaggtatgtgcctctgcctgctttatcagtaagggaataccatgggcttgcacaagagtatttccaagaatgaacatggtgtgaagacacatagtgattatctttaccagcctggtctgtcttaggaaggcacacactaatcttttttttaaacatgcatgtacatatttgccttcccctaccctcaagctttattctgcagccattactttacttcggagatgaaggaaggtcaaccagatgatttgcatccagtcgtttaccaacagttttctaagaccctatattatgtgatgtgcatccaaaagacattgtgcttaatcatgggggttggttaaagaaatgattgtatagtcttacagtgaaatgccatgtaccaattataaatgttatatttattgacagggaaggagtgagtggaatacatcaccaaaaaaaaaaaaaccactattctttgtgatcttttctgtatgagaaaaaacatatacatagaaaaacaacttggagatggatttaaagtctaaatggtggttatttctgggtgatgggaacatggagatttttgtttatattttcttgactttttttctcctttttgaaacatttcttaagtaatagatgtttattgaaggaaaatgagagcatgcaaaacaatggccacagtcaacattttggtacctatcctccatgaaaatgaatgcacacatataaatactagtctgtatttaaacaatttttacagtgacatttgtatcacttgtgaaaagaaacttttttttttttttttttttgtggagacagggtcttactctgttgcctaggttggagtgcagtggcatgaccacagctcactgtagccctaatctcccaggctcaggcagtcacctaagcctcccaagtagctggaactacaagcatgcgccaccatatgcagctattttttaaatgttttgtagagatagggtcttactgtgttgctcaggctggtctcaaacacctgggctcatgtgattcttctgcttcagcctcccaaagtgctgggattatacgcatgatacactgtgcatgaccagaaaatataaaacttttaaaaagagcattgtttcatatgttggaatttgactaatatttctctttttgaattctgtgagtatataactgatacaatttttttcttctattatgaccagtttcttacctaagcaaaaatgtatgaccagttggtttgtataaggttagcaataacttaggggtatattctcttcctgcatcccagtgcacagtgagttgtatatcacaaatagagccactcagatacttgggccctaacaactggcagcactaccccaagtgatataccagatggcttgcagagtgttgtatcagggtagtccattattcatagtgtgtgtactctttgtgttgtttttttttcctccttattcagccatgaataagggtaccatgaactacctatacccagctgcctggtgtgtctgtaataagcagagcagcctgtgagattaggagcctctgggatgggacgaggtttgtttctgagcctttgctactagcccattcaatgctggagcacaatcagaggccagttttactgttagcctttcctagagaaactcccctcttccttcacagttggtccagaggttatagttgtgttcagatgtgtagaagagagcccctgcggggagaaagtccgtcccatcagctaagtctagctaaagcctacttcatgggttcagaagacattaatggttccacctgtttctacactgcagttctaaggatgctgtattgatcagaagtagtagtagcatgatggttttccaataatcagttctgttttcagtggaaaaaatgcttttgatttatttagggtctggtatatatttttcatgtcagtttacctaatatgcatgaaagtgttttaacatctatgtatgtctttacagaagttagttgtagctggttccatatctattgtataaagaagtattaacagaataggtttgcttgcattattatactttcatcaatgtgacagtttacttggatttttgttttcagaaagtggtattttcatacttgtatctaagtattacgttgcattagacaaagtgtcttccatgaagataaactgccatcttagctaatttggaacaaccaagtcctattaatataaatagaaaatattgacacaaagaattcctttcttatttagttggttatttaatttaaagattaatatttttaccttatggaaagtttggaaaatagaaaaaaaaattattcatttttgagacaggggtctcactctgttgtgcaggctggagtgtagtggcaggatcttggctcactgcagcctctgtctcccaagtccaagcgatcctcccacctcagcctcccaagtagctgggactacaggcacaagccatcacacctggctgatttttgtattttttttgtagcaacagggtctcactttgttccccaggctggtctcaaactcctggactcaaagggtcctcctgctttgccctcccaaagctctgggattacaggcatgagccactgcgcccagccttccattgacttttttttttctttttaaccatttggattgcattaaatatctttttcattttttgcattatgtttgtaagctttattcttagaagagaaattactgggtctgttttttacagttttttatacaatgccaaaatgttttcttaaaaaaaatactagttacctaccagtgataaaaagtttcaggtttgttttacccatccaaacataaggggttagacatatttaaattcttataatttagaggacaaattaaaaatgtaccttgtttatatttctttgattagagagattgaatgtgttttctttatgtgagttagtttccctgtttattagtcctgaaattttaaaatctcaatttgtatgagctttttaaaaaatagaaaacatcttatttgtcatttgctatggatctttttttttagttcattaccatttagttattgtacctgagtagctattttttacacaaatcttaaccttctccctttgcgattgttttttttttggtcacttctaaatttatcaaggtgttagattctgagacctaacatatctatcaatttgcctcctttgttttgagatacctgtatttatgtgactttctatgtgtatttatctggaattacttttagtgaaataaggtggaggtctgaattaaaactttttcctggttgttaatgaaatgttgcagtgactgaactgttttgtgtgccatagtagcactgagaagtccatgaagtccaattattctaatgtctttccttagttttccttcagtttcatttatctcatgagacctgaaaactccaacatgaactgtgtacccatgtgttctttttgcttcttaaactagtaacatttctggctttattctaccacaaattctttttcacttgctttctattatgtgaacctccactgttacagtgttaacattttccttcctttttttgtcactgcaggaagtactcccactaccccaacctcctctcaagccccacagaaactggatgcttctgcagctgcagcccctgcctctctgccaccttcatcacctgctgctcccattgccactttttctttgcttcctgctggtggagcccccactgtgttctcctttggttcttcatctttgaagtcatctgctacggtcactggggagcccccttcatattccagtggctccgacagctccaaagcagccccaggccctggcccatcaaccttctcttttgttcccccttctaaagcctccctagcccccacccctgcagcgtctcctgtggctccatcagctgcttcattctcctttggatcatctggttttaagcctaccctggaaagcacaccagtgccaagtgtgtctgctccaaatatagcaatgaagtcctccttcccaccctcaacctctgctgtcaaagtcaaccttagtgaaaagtaagtcacttctaaagtttgattcttctgtgagttgggtagaaatattggatgttatttactaaaagtagagtcactctgagaggagttaactgagtagaatttttttacccagagtgatacttgcaaatggcaaaaattcaaccaacataaaatactggcatttcatcagtgggtagagtccagaagggtctcttagctagcattttatttttttgactatgggatttatattcaggtatttgttttgcttttttacgttacaaatgtaggaaatattccttattttaaaaaaagaagcaatccagagtatgcatcctggaagggaaatgaatcccttgtagtcttttttcctccctgtgtctacccttaactctctctgaactgctgtctacacagccacaaagtcatcttgtgacactgtaaattgttaggtgattcttctgcttgacagtccctatgaagccccgtggctgctcactgctaattcttaggttggtatccagtttcctccagatctgggtcgggcagctcactcatttcttatttatttacttctttatcttgttcttttcttcccactagaatgtaagcttttggagggaagcaatcccttatatcttgtaacccctcccaagataaccatgagttcccaagataaccatcgagtataagtactaccagctttttccctacttgcctgtactatctgttgttgctatggtggtgctgctgccaccacagttactgttaatactgaattggcacacatccacttcatgctaagggttgcatagtgttccattttgttgactgcaccacagtttatctgaccagtcatctaatgctggagtttagattgtctacagacttttgctctttaggtggaaccgactttacatttcctttaggccataagtatcccaaagacagttccctgcattcctcttcctttttcactccccagagaaggtgctcactctcaaaacgagttctcagtaatttccttggtaagagaaagtactaactctcctaagcataattgtgtcccacctcctgtttaaaactcagctggaaacaatagtatttcatatcatgataaacttggtatttcatattgtgataaacttagttttgatatttcccctgaataattaattcctaaataagcagacgaaaagataaatgtttccttgcagctttcaccttttataagaaatagctaaacatttttgtttcctgaaggcaaaaagtatgttatctttgtaagttaacataaaagataataagttatcttttgatgacattgctcatgctagtgtaaaagaatcttctagcaggctcttctgaggccttcaggctgccatttttcaggtttactgctgcagctacctctactcctgttagtagctcccagagcgcacccccgatgtcgccattctcttctgcctccaagccagctgcttctggaccactcagccaccccacacctctctcagcaccacctagttccgtgccattgaagtcctcagtcttgccctcaccatcaggtatgattttaagcagacaactttagacctcagccctgccttctcagattaacggttttaagtgttaagagtcgtagctaacatagttggacaaggttattttttcttgcttcctgtatcatacattaatgattaatgtgctgtgattttcatactctgaattgggagatttgctcttgcttaaatgctgccactcttctctctgacacttcttatggagctaagtgtatttaatgagtcaaaaatgccttgctcttgggcatttattttcatatggagcctgccctccatgaagagcagttacataacagttctttaagaagcacaggcacaagagttgtttggcggggtgcggtggctcacgcctataaacccagcactttgggaggccaaggcaggtggatcaccggaggttaggagttcgagaccagcctggccaacatggcaaaaccccatctctactaaaaatacaaaaattagccaggtgtggtggtgggtgcctgtaatcccagctactcaggaggctgaggcgggagaatcacttgaacctaggaggcagagattgcagggagtcgagatcacgccactgctctccagcctggcgacagagcgagactctgtctcaaaaaaaaaaaaaagtacagaggagagagtacctgcagtgattatattcatattttcacagtcagtcatactgtaaacaggaagttttgttttgttttttgagaccctctcactctctcacccaagcacatcactgcagcctctacctcctgggctcaagcgatcttcccaccttagcctcctgagtagctgggactacaggcatgtaccaccaccgtcggctaatttttaaatttttttgtagagacaaagtcttgccatgttgctcaggctggtctcaaactcctgggctcaagcaatcctcctgcctcagcctcccaaaaggctaggattacaggtttgagccaccatacctggctcctaaaattttaatatatttttttcattatcttagaacagaggctagcacaactggtggtcatcactctttaaaataaatcatgaaagtgggccaggggcaatgtgtaacttaatttcttagatttggagaaaggacatttgtgataggagaaataaaggtaataaatgccatctattttaactgacttctttttcaagcaggacgatctgctcagggcagttcaagcccagtgccctcaatggtacagaaatcacccaggataacccctccagcggcaaagccaggctctccccaggtatgtttaaattcagcttgcaatgtttgtgtttattaatttactgccccaagcatacctatgaataaaatgagttttcatgttttataattcagaccttggacatagtaattgggactatgtgatagtaaataccaaagtgcgaggtttgaatacttgtatactcgtaaaagccatttagctattttaattttttattcatgtataatacaaatagaaaaaagtacacatgatacatgtacagctcagtgaattgtcaacaactgaacataccttggtaactagcatccagatcaagaaacagaattttacgagaacctggctgggcacagtgggtcatgcctgtaatcccagcactttgggaggccaaggcgggcggatcacctgaggccagtagttcgagactagcctggtcgacatggtgaaaccccgtctctactaaaaacgcaaaaattagccgggcgtggtggcacgtacttgtagtcccagctcctgaggaggctgaggcatgagaatcacttgaacccgggaggcggaggccagaaccccagagttctttttcacctgtccccttctagtcactactcttgccaaagagtagctgatttgatttccaacagcatagatgaggttagcctgcctgtacctcctatcaagtggatttgtacagtatgtattcttgtatctggctgctttgttcaacattatgtttgtgagatttatccatgtcgttgtatggaatttattgtgtgattatattacaactatttgttccactctgatgggcgcttgagtagtttccaggtttaagccattgtatgtagcactgctatgaccgttccagttgacatcttcaatgaacacatatgcaagtttctcttgggtgtatccctatgagtgagattgctgggtcatagaatctgcatgtattcctcattagtagattcccaccaagagtgtatgagacttctggctgctccacatacttgccactcttggtatttttcatcttttgttgtatggttttgtggttttaatttgtatttctctaatgattagcaaaattaagctttttaaaagatgattattggccatttgaatattttcttttatgttgtgtctgttcatgtctttattctgtttttctgttggattgtctggctttttccttctgatttttaagagtgagttccttgaatacacacacacacgcacacacatacagtgcaaatatgttctcactgtgaattgtctattcattgtcttttttgtttctttgatgaatacacattcttcattttaatataattaagtatatcagttttttcttttatgattaatgcttttcatgttttagaaataattttctatttcaaggtcaaaaagatgtttttctaaaagctttattattttatctttcatatttagatttgtagtccatcatctcagtttatttttatggtataatgtaaagagaattgtatgtcagtttcccacgtgattacttgagtgccctgagaataagcgttatgtcttttcctttctgtgtccccctaaccaacccttgtaccctaacacacacctgtactaggtacatagtaagtgcccaggtcacagttcacggtgtggcatgatgcatgacatacagtgtttgtcaaataaatgtttgctgttaatgaatgctgatgcagtctaagacctctctagtgttaatcgttgtaagtatcaaatagtctaaagggcatttcaaattatagtatctttaaagcagaactcttgatttctgtctcccctagaggctagtccttttccaatgggtaagtagcactaacaaaccagatgtttgcacaagccccaagccccgaagcatcctagatccctctctttaacagtacctgtccccagtccaggctggcgggaggtcttgtcagctccaccctctgctgtgtcacatgtcataagcccacagctctgtccccctgctagcatcctgtgtcaagctgttgcacctctcaccttgttaacctctcgactactctctctgctatccctgctctacatagcagcaagagggatcttttaaatcataaaggagatttaaactcttgtaaaacaccagtagtagctttccaacacgtttagaatagaacccaaactccttggtgtgaccttatatgacctaccccggcctgccttcctgactctacccctgccctctacaacgcctcccctgacttcacagagcccacatttactttttttctttgctaaggtttctcctgccttgagacctctgcacttgcctttcttggtgcctggcaggtgcttcctgaagatctcatagcttgctttctgcttgcagcctccgttcagatggcagcccgcagtgagggctttcttggccatctcatctgaagtagtgcccttttttattctctttatgtttccctgtttgttctccaactgaaattatcagatgtgtttatattttattattcaacatgtcccagtaggaggtaagttccataagagttgggccctcatctacttgttcacctctacctgcactgtctagaacatgccttacacaaagtagagaccctataaataaggattcgttacaatgagtgaagaaataatgactgtgttacaggagcgccactccctgtaataggctctgatataattgcttgtagaagctatgacttgcagtttttaaaccttttccttccatttcaggcaaagtcacttcagcctgctgttgcagaaaagcagggacatcagtggaaagattcagatcctgtaatggctggaattggggaggaggtaaatttgtttcctgagggtgtttttctgaaagtagctgacagacttggatgggtcagagtgccaacccctgtatgactagttagttcattctagcgctgaagcatggcccatcccagcagtctgagcagttagtaagcacgatagcagtgacattactgtttgtccttcagactgagtagttcctcacttgtggcttctacagattgcacactttcagaaggagttggaagagttaaaagcccgaacttccaaagcctgtttccaagtgggcacttctgaggagatgaagatgctgcgaacagaatcagatgacttgcatacctttcttttggagattaaagagaccacagaggtttgtgtttatggatacttttcctgagttgaattgcatttaacaatttttttctcctagtactccatggggttatgtactttatttcttcaaggaccaccagtgttgttgtttttttaacgtggctgagtagcttgcctagaatccctgagttcaaatcctaccttcagcacttaataaattatgtgactttgggcaagttaacctcgttactctatttttcagttttctcatcataagatggactaagtttctatccctttgatgcatactgtgcactccataaaatttattataattgttaatttaatttaggtttatttgaaattttactatctcaaatagtgttcgatttttaaaaaaggatattttaggacatatgcagtatgaaaatattaaatgctgggtgttaatagtgttaattattgtaaccattattactacttactgtgtgccaggcactgtgccaaacgcatcacttgtattatctcactgaatcctcacaactttgctgtgtcatacatactgttaccctattttgcaagtcaggaaactgaggcttaggcaaatttgtcaaaagtcacccacttagcaagtggtagtgccagaattctgcttcagactctctgattccagagttcgggtcttaaatagtgtgtttggaaagaggcaagttctttagagtgttagcagtaattatcttcacatagtagtgttagagctactgtctttgtattttctgcattttcaatcattagaatgtattttttcaatggggatgaaaaataaatataaaaaaagaacattagtgtcgttctaaacagttaaattctttttttacctgagttaaatatgttcagatgttcattctgttcagtgagcgtttgagaaacaccaccttccttgatccaaacagaaagatttggacgtaacaactttttgtaccaacacattattgtactttttctagtcgcttcatggagatataagtagcctgaaaacaactttacttgagggctttgctggtgttgaggaagccagagaacaaaatgaaagaaatcgtgactctggttatctgcatttgctttataaaagaccactggatcccaagagtgaagctcagcttcaggtaggagatctatgtaaatctgtttaaaagatttaaaaacaagctcatgtaacaattgctacctctttttgcatatagatttggatgatggctctttttgaagttgttgattttctgcttataatttaccacatttcccgtaaacttccttaactgtggcaaacagtacacttcatgtaattatgtaatttttttcacttaaaacatagattttttttaaaatactttttttcttgagacagggtcttctcactctgttgcccaggctagtgtgcaatggtgtgatcccagctcactgcagcctttcttcctgggcttacgtgatcctcctgcctcagcctcctgagtagccaggaccacaggcatgtgccaccacacttggctaatttttaatattttatttggagagataaggtgttactatgctgcccagcccagctggtcttgaactcctggggtcaagcagtcctcctgccttggcctcccaaagtgctggaattacacgcgtgactggccaaaattttttattaaaccttaagcttaatagagaatactctgttgaaacatgtaagttgaattataaataaataataattataaataaataataaaaataaataataattattaaagtggcaactatttcttgagtgccatttaatctgctaggtgtttcttatgcattatttctagccttcaaagccagctgctctgcaaggtaagagttactggtccctgtagcccattatacaggtaactggaaattaaatttcataggctaagtagcttgtccaaagtcatgttggctaggaaacggggaaccagaattgaaacctccatttgcctgagctcttttctgtatgctacacttaacttttctcttgaaaaaaaatttttttttttttgagactgagtctcgcactgtcgcctgggctgaagtggcaccatcacagctcactgcagcctcaacctctgggctcaagtgatcctcccacctcagcctcccacatagttgggagtacaggtgtgtgccaccacacccagctgatttttaaattttttgtagagatggggtctcactacattatccaggctggtctcgaactcctgagctcaagtcaccctcctgtctttgtaatcccaaaattctggggttacaggtgtgagccactattcttaattattcttaatctctgcttttgctaatcggattttgctttccatctttcagtgtacaccgaatcattgtgtcactggccttagtgtgggggtcctcttctgctatctcacatttgtctggaattccagcgggaagcgttcactggcatctctggtcttcctcatgacatctgtggggtttgcaggtgtgatgaatcattcttgcctcagagaatttgaggcctcaaactttattgttccccagtgtttctgtcccacacctggtcaacttactgaaaattaaaaaaaaaaaagaaaaatggttccttcttcaagatagattgcagagcccttgctgtgatctgcagccctctggtattcctgatgcgtcctctttccactgtggatattacctctcagcaagagagtgctgcctgcctactgctcatcaaattacaggcatccgctctgcatccgagctacatgttgttcctatgtgcctttccacctctttctctattgacaaactaagaggaaagcatacagctttagggagacacttattcaggagggaataattttcttttttcatggtgctaagtagataatactagttagcatgtattgagtgtttactatggacaatgcacagatgatgaaaccaagataactgaaactgcccaggttttaccactaataaaccttgaaaccttgaacctgggcagtctgactcaagagcctgtgctcgtactcaagagtctggtttacagttcatgcaggtttacaattcactcgggtttgcaattcctgcagttgggtaagtgacagagagaaagacgaacatgtaaatgtagtgtgggatatgttgctatgggaccacaggtgagggagcagccgagccagagaaaagaagtatttgtgataggctttaaaagaagaattgtttttggctggtgggcacaattgggagggcattccaaagaaacagcagcagctaacgcagaggtgtggttgtatctgaagtgatcaaaggaaagagcctcggtgagttgaaagttacatttgctactaaggttacttctacttctcttgaatcatcttggctcttttaaaattacattttctctttttcagataggacatagacccttatccacaaaataatttttttttaatttttaaaaatttcaatagtttttgggggacaagtggtgtttggttacatggttaagttctttagtggtgatttctgagattttggtgcacccatcatccaagcagtgtacactgtaccccaatgtgtagtattttagcccttaccgccctctctcctttccccccaagtctccagagtccattgtatcattctgtctatctatctgtctgtctgtctgtctatctatctatttatttattcattcagagacagtctcactctgtcacccaggctggagtgcagtggcgtgatcttggctcactgcatcctctttcaccgtgttggccaggctggtcttgaactcctgacttcaagtgatctgcccgtcttggtctcccaaagtgctaggattacaggcgtgagccaccgcgcctgttccgttgtatcattcttatccctttgcatcctcatagtttagctcctgctcataaatgagaacaaatggtgtttggttttcaattcctgagttacttcacttagaataatggtctccagctccatctaggttgctgcaaatgccattatttcattcctttttatggctgagtagtagtagttgtgtgtgtgtgtgtgtgcgcacgcgcacgctcgcgtgtgtgtcacattttctttatccactcgttgattgatgggcatttgggctcgttccatatttttgcaattgtgaattgtgctgctgtaaacatgcgtgtgcaagtgtctttttcatgtaatgacttcttttcctctgggtagatacacagtagtaggattgctggatcaaatggtaggtacttttagttctttaagaaatctccatattgttttctgtagtggttgtactagtttacattcccaacagcagtgtaaaagtgttcccttttcaccacatccacaccaacatctattattttttgatttttaaattacggccattcttgcagaagtaagacggtattgcattgtggttttgatttgcatttgcctgataattagtgatgttaagcatttttttggatgtttgtcaaccatttgtatatcttttaagaattgtctgttcatgtccttagcccactttttgatgggattgtttgttttgttcttgctgatatgtttgagttccttatagattctggatattagtccattgtcgaatgcatagtttgtgaaaattttctcccactctgtgagttgtctgtttactctgctgattatttcttttgctgtgcagaagcttaattaagtcccatctatttacctttttgttgcattcgcttttggattcttggtcatgaactccttgcctaagtcaatgtctgtaagagtttttctgatgttatcttctagaatttttatggtttcaagtcttagatttaagtcttcgatccatcttgagttgatttttgtataaggtgagagatgaggatccagtttcattcttttacatgtggcttgccaattatcccagcactatttgttgaatagggtgtccttcccccactttatgttttttgtttgctttgttgaagatcagttggctctaataatttggctttatttctgggttctctattcttttccattggtctgtctgcctatttttgtacctgtaccatggtgttttggtgactataggcttgtagtatagtttgaagtcagataacgtgatacctccagatttgttctttttgcttattcttgctttgactatgtgggctctttttagttttatatgaattttaggattgttttttctagttctgtgaagaatgatgatggtattttgatgagaattgcattgaatttgtaaattgtttttgacagcatggtcattttcacaatattgattctacccatccatgagcatgggatgtatttctgtcttttttttttttttttttttgagacggagtcttgctctgtcacccaggctggagtacagtggcacgatctcggctcactgcaagctccacctcccgggttcacgccatcctcctgcctcagcctcctgagtagctggaactacaggcgcctgccaccacgcccggctaattttttgtattttcagtagagacggggtttcactgtgttagccaggatggtctcgatctcctgacctcatgatccacccgcctaggcctcccaaagtgctgggattacaagcatgagccactgcgcccggctgagcatgggatgtatttctatttgtttgtgtcgtttccatttgtgtcgtctatgatttctttcagcagtgttttgtagttttccttgtagaggtcttttgcctccttggttaggtatattcctaagtttttttttttttgttctttttttttttgcagctattataaaaggggttgttgtttatttgattctcagcttggtcgctgttggtgtatagcagtgctactgatttgtgtacattgattttgtatcctgaaagtttactgaattcgtttatcagatctaggacctttttggatgagtctttagggttttttaggtacatgatcataacatcggcaaacagcgacagtttgactttctctttatcagtttggacgcgctttattttttctcttgtctgtgccagctacacaaataattttgaaaatacatttaaacataataagatctctctacagatgtaaactgcttttcctagtgtatagcacattatctccatttgtagacatacttaattgaatgcctcagttttattttatttttttttaggagacagagttttgctatgtagcccaggagtgcaaaggctattcacaggcatgattatggtgcacaaaagcctcgaattcctgggcccaggtgatcctcctaactcatcctcctgagtagctgggtctacaagtgtacgctaccacgtttagctctgttttttttttttgttttgttttgttttttaattttggacacggtctttctctgttgcttgggccagagtgtgtggtgcggtggcacgatcctagctcactgcagcctcgaactcgggctcaagtgatccttctgcttcagcctcctaagtagctaggactacaggcacacgccaccatgtctggctaatttttaaaatttttgtagagatggggccttgctgtgttgcccaagcaggtctcgaacacctgggccctagcactcctactgacttggcctcccaaagtgtgagattacaggtgtgagccactgtgtctggcgtttttttttttttttttttttttgagagagagtctcactctgttgcccaggctggagtgcagtggtgcgatctcagctcactgcaacctcagcctcctgggttcatgtagttctcctgcctcagccacctgagtagctggaattacaggcgtgcaccaccactcccagctaatttttgttttttgttttttgtgttttgttttggagacagggtctcactctttcacccaggttggagtgcagtggcatgatctcagctcactgcgacttccacctcccaggttcaagagattctcctgcctcagcctctggagtagctgggattacaggcgcgcgccaccacacccgggtaattcttgtatttttagtagagatggggtttcaccgtgttgaccaggctggtttcaaactcctggcctcaagtgatccacctgctttggcctcccaaagtactgggattacaggcatgagccactgcacccagctctaatttttgtatttttagtagagatggggtttcaccatgttggccaggctggtctcgagctcctgacctcgagtaatacacccgtcctggcctcccaaagtgctgggattacatgcatgagccaccatgcccggcctgattttttgtttagagacagtgtcttgctctgttgcccaggccggagtgcagtggcgtgatctcagctcactgcagcctccgcctcctgtgttcaagtgattcttgtgcctcagcctcccaagtacctgggattataggcatgcatcaccctgcccagctaatttttgtatttttagtcaaggcgggatttcaccatgttagccaggctggtctggaagtcctggcctcaggtgatctgcccaccttggcttcccaaagtgctgagattacaggtgtgagccacagcgcccagccacctggcctgtttttaatttttgagaatcaagttgcatagccatgaaggttaacagtcgcccaaaatttaaataaaattattgcaggcctataataagttaaatagctaaaattttaaataatgacagattcagtttttagtgctgatagtgttctttgattttgcaaacaaatgagtatttctcaaatgggaagatgacttatatgttctatgctgtgaatagataggtttagaattactttcagcaccgttttgtctccattacagttaattttatgggtgggagagcaaaatctaaatggatgcactgtctgagtaccagaatggaatggaaaattcccagaccatggaactgagaaatgagaattaagcaagaacatttgttccctgggggcctaggcagccatacccattctgtttcccttttcattgtaccacctctctgccacctctgcctcctgggttcaagtgattcccctgcctcagcctcctgagtagctgggattacaggcacctgccaccctgcctggctaatttttgtgtttttagtagagacggggttttaccatgttggccaggctgatcttgagctcctgacctcaagtgatctgcttgcctcagcctcccaaagtgaggagccaccactcctggccaattttgtttttcattttaattataaagtttttttatgtaacttttttatttgtatacattattagagacagagtcttgctgtgttgcccaggctgatctttaactcctggcttcaagcagtcctcctgccttggcctcccagggtgttgggattataggcctgagccactacacccggcctcattttaattatatagttttaaaaatcgtattaaaacctattctgttttccttgttcattatggttcttaatatagaagtattttagaattcttttgactgttttgatacatcttcccccaaactatcagaaaaacaagttatttgccttttaatttttttcttataggaaattcggcgccttcatcagtatgtgaaatttgctgtccaagatgtgaatgatgttctagacttggagtgggatcagcatctggaacaaaagaaaaaacaaaggtgaatgagatctctcatctgcaatgtgttggaatagatattgctattgccattttaaaaaggttatttaggaacatatgaaaatcccaggccgggtgcggtggctcacgcctgtaatcccagcactttggcaggccgaggcgagtggatcacctgagatcgggagttcgagaccagcctgaccaacatggagaaaccctgtctctaccaaaaacacaaaattagccgggcatggtggcacatgcctataatcccagctactatggaggctgaggcaggagaatcgcttgaacccaggaggcggaggttgcagtgagctgagatcgtgccactgccctccagcctgggcaacaagagcgaaattcccatctcaaaaaaaaaaaaacaagaaagagaaaatctctacaaaacgttcattctttttaacagtcattctacttgaaatatttttctatagaaacaacaaatgatactcagtaatttacataaaatcatttatattgcagtataatttatgatagtgaaaaattggattcagcctaattatctaaaggtacaggagtggctaaataaatatggtcgctttttttcttaactacagaataccctgtaaccattgactagcatgttctccaataaattatttaatatattgaatacatattctatgttctacaaaatgtatgaatatataactatttcgctataattattagatgtaatataaaaatttaataagtaaaaagacaaaagcatattggctaataagaatgtggaggtacaaaagtaaatagatgtaacaaaatattcgtagttatatctgcaaaacgggattaaggagaattttccgtaatactcttctgtatatttcaaattttcttttttagaaaacatttgtaattagtgtggataattaaaaagatgagagaaatgatggcaaagtaatgggaaaaccttttagcatagttttttatccctagatatttggttttaagccacatattttccacaaggagtagaatgtcatgcaccatgagagcatgaagtgcccattagaaatttgaaaaatgaatcagccatgaaatgttagatttctgaaacacctacacttgattaatgattagctagccctgtatgaaaacaaaccaagaaatggtctatttgatgtacttttcagtgggacaacctgggtgtgatatcagggacaggactataatatgcttataatttagtaagcacaattcaataaattacattgtgttatgtggagaaaggctaaaaatcccaactggaggaccctcagcttgcagcatagataggtatagggagatagaagtgagaagctctcctccgccactatctaaggggagaattctgtggcctgtggactggagcacttgtctccatgggcagtggggccccattagagaactagctcacacacctggttctgattcatgtttaaccatatggtttgctttcccacaagggaaacaatggtctaaccttacagtgggtacattctgctctgctcaatggttgtatttctttttggtaattaacaagttagccttgtaagaaagtgcatgatgcttaaagagaagccaagcttttttttcctttgtaacaattctgtggatttactacttatgcttttctgagttctctttctgcagagttcaaattcttaaatctgtacaattttctattttgatagcacttctctgtttcagggccatccctgaatattaccttgaaccctattgaaatgcctttttttttttttttgagactaagtctcgctgtgtcacccatattggagtgcagtggcgcgatctcggctcactgcaacctccgcctccggggttcaggcgattctcctgcctcagcctccttgagtagctgggattacaggtgcgtgccaccacacctggctaatttttgtatttttagtagagatggggtttcaccatgttggttaggctggtctccaactcctgacctcgtgatccacccacctcgccctcccagagtgctgggattacaggcgtgagccaccgcgcctggcctgaaatgccttttaaaaattatatgttgaactaccttgttaccagaggcagtcattcaagtcagccctgaactcaaagaggtaatgggaaaaagggaaataaatccagaggtttctgtttagcaagcatttttcattccatgatttgtgttgaggcaaaatatacatagagtcacttgttgcttaacgtgcgttctgagaatttcattgttaggcgattttgtcattatatgatcatcatagaatgtgcttacactatgtgtacttattacctagatgacatcacctattacacacctaggcgcttatggtgtatagcctgttgctcctagaccacagtaccatacagcaagcttgtccaacccacggcctgcaggcttcatgtggcccaggacagctttgaatgcaatccaacacaaattcgtaaactttcttaaaacattctgagatttttttgattttttttttaagcttatcagccagcattagtatattttatgtgtggcccaagacaattcttcctccagtgtggcccagggaagcaaaagattagacacccctgctgtacagcatggttttgtactgactactatagacaattgtaacacaaatcactaggcaataggaattcagctctactgtaatcttataggatcatcgttgtatatgcagtccatcattgaccaaaatgtcgttatgtggcacatgactgtattgacataccatagcaaagaaaatttggtttataactgatgtgggattattccttatgtttttatatgtatgatttttcctatcccctctgcaaattaatgcagtcagaaaaaaatttcaaagctacttaaagatttctactgaaaagcggaagcaaatagacctgtcgccctctacagtcagacctacttcccagaggcagctactgttgtctctgtcttgttttagttcttttgggcaggttaccttcctgatgctaaatcttatgctgtccccctatttcttgacaatagtctgaagaattaactgactcccatagacttccagtgaaccttttttttttaattgaatataatttacattcagaaaaacagataaattctaagtagaaagctgactggctttttcctggttcctgactcacacctcactcctgcccttttcttcccagggcctctctcaggtttcacctaatgtatgctgtcctttgctacaggactggcctgcctgtttccagctgttttctccacattccattttatcttcattaggctttcatctcctttttattttctagtaatttcttaatggttcttgtccagtgctggttctccattttatcattttcactgttaccattgtagtcttgtttgtttttttactgggagattcctttacttgaaccattcatgtttaattcttttctcattgttgtcaacaggcacctgcttgtgccagagcgagagacactgtttaacaccctagccaacaatcgggaaatcatcaaccaacagaggaagaggctgaatcacctggtggatagtcttcagcagctccgcctttacaaacagacttccctgtggagcctgtcctcggctgttccttcccagagcagcattcacaggtgtggagaggacttgcactcaataaatatgggtgaatgaatgcatgaacatttagggagtcttagagtggttcagatatgggtttgcaagtgactctgtgtctctcacctgtgtaatcctggtcagggtcccacccactctgatcctttgtttctttgcctaaaaaatgaggatgacaatacctgcttcgtgggattgttggagagttaaattaagtctgtaaaatattacactgatgaaatgggtgctgaatatatcacagcaagtgatacaccatagtaacagtgtcatggtttgattgaaaatcagctgataggattaagttgactgacttgtttctgaagcccagatttgccattctgcttgaatggggggactttcagaccctggcagattgacagtttgccttgagtttaccaaaatggttttgtgtttatgcttttaggccaaatgtataaattttaattactttttctactgaggcaccatcatgttgtgtttgaggtggagatggtatataatatgattgtgatctcacttcttttagattaattccatcagttggtcagatggcatgtttatatattggggatattctcatgtcttgcatttatatttaagaggatagtgtacccccgacagcctccgatctttcagctcctagttggtctgtatctaacactgttctgtttcagttttgacagtgacctggaaagcctgtgcaatgctttgttgaaaaccaccatagaatctcacaccaaatccttgcccaaagtaccaggtaattgcatccttcccagtcttttaactccctttattctcttccaagtactgatatcttaaaaactgagtcttaatcatttatgggtttatggatttcttgcagccaaactgtcccccatgaaacaggcacaactgagaaacttcttggccaagaggaagaccccaccagtgagatccactgctccaggtaaagagaaccagtaactgggcctgtacatagtgatagggtgtggtggggtgtgtgtgtgtgcgcgcgcacatgcacgtgtgcatgtgtgagctagggtgctgtgtatgtgtgtgtaagtgtgtgtgtgttggttcttaataggggatagagaaaatgtctccagaatctgttgttaatctgaatagtggaataagaaccagcttatatatacttgatgaagcagcaaagtagtcgttttggcttttacactgttttctgcagtcctcaagttttatggcactgattcacaagggtttgagataggctgagctggatcctagcctctgctttagccagagaaggtttacttttctgatttgtgttgggttttgagtaagtttgcatctgggaaaaaggcattttaaaaaataaataaataatagaaaaaaataaaagacgaggtctccccatgttgcccaggctgttctcaaactcctgggttcaagttatcctcctgcctcagcctcccagagtgctgggattacaggtatgagccactgtgccttgccgaaaaaggcttcttttatgaaaaaagaagaaaaaaataagattaagcaatgttgattaaaaatacttacttaaaaatacttgcttaaagaagccataaatttttttcccattacattacctagataataacttcaatttaaagaaaaatttgtgacaattttaggcataactgctttgttttagtatccatatccaaatttttctttgagattctgttttcagttaaaatttttttatgccaataacaaatgcttttggtaatcagaataactgaaagaaatttaatcttactgatttatttttctgtactcacatagagctaaattagataaataatagtcacagacaagttaattttcaaataaattttttttacctaaagaatacattctcttggtaggtaattgggaaaaatatggaaagtataaaggagaataaaaaatattagctgagtgcggtggcatgcacctgtaatcttagctcttcaggtggctgaggcaggagggttgcttgagcctgcagctgcagtgagctatggtcatgccactgcactccagcctgagcaacagaatctctaaaaaaaattaaaaagttaaaaaattactctctctcaacccagatatggcctcacttagttattttggtttagttccaaacttttttctttgcatatgtaaatctgatttattttaaaatgaaattgagattataacagttttgtgtcttgatttttttctaatttaaaattcatgagcccttactattaaacaaaataaatgctggtggtgaagatatggaaaaaatggaagctttgtgcactattggtgggaatgtgaaatggtaaagccactgtagaaaacagtttggtggttcctcaaaaaattaaaaatgtgattactggatgatccagcaatttcacttctgggtatataccccaaataattgaaaataaggtttcaaagagatacttttgtatccatgctcatgacagcattattggtaatagccaagaggtggaaacagtgtgtctgttaatgaatgaatggataaacaaaatgtctgtctatacaatggaatattattcagtctttaaaaaggaatttttgacacatgttacaatataagtgaaccttgaggacattgtgctaagtgtcctcaaatagacaaatactgtatgattccacttatatgaagtatctagagacatcaaattcatagagatggaaacaagaataggggttgcctgaaggactgaggtggggggtcatggggagttattatttaatgggtatagagtttcagttttgcacagggaaaatagttctggagatggatggtggtgatgattacacaacaatgtgaatgtacttaataccaatgaactgtgtactttaaaacacttaagatggtaaattttatgttacattttaccaaattttaaaaattggaaaaaagatttaaacttaaaatcttaaccttttcctctgccttctgtgtttaaatattctttgaacacatgccttataaagacagcacaatatttccttgtattagaaggccataatgcctgttgctaatcttgttgccaaaattttctcagaacgtctttgttcacaaatctttagcccacatcagattatatatttagatagagtccttacaagtgagatttatgtaatttacttattcattcattcaataaatatgattgcctagtttgttccaatcagtggtaaataagagaaacatggtctctgcccacatgaagcttttcatttaagaggaggaattcagacattaagcagataactgcacatgatactcatttaatgttagtgggcatgctgggaagaataactcagcatgtaaacactttgaatttttaaaattgtgaaaaacaacacacattaagtgcacaaaacaaaaacgtatatccctgtagcctctacccaggtcaagaaacagaatattgccgttttttagaagccctcttgcataccccagttttccttcttcccctaaggcacgattatatgggcttatgtgagagttttgcctttgccttttttttttaatttgacattttttgttatttttaatttattattttgaaaaaattgaaacttccaattgcgagtacagtaagcacccacttacccctcacccatatgtttactactgtttgccacaattgttgctgaactatctgagaataagctgaagacaacgccccttattcctaaatatttcagcatgtgtcctcccaagaacaaaggtgctctcttacacaccataatacagtttgcaggttcaggaaatttaacgtatacagttatctcatatacagttgatactcaaattttgccggctgtcccacttacccctacacgttgattggatctaggatccaatccaggattctgcattgtgtaagttgtcattctctttagtcgccttttctttgttttccttcagagctttactatgtaagcatacctcccaaaacactatgatttggttttgcctgtttttgcataccacataaatccattcacttagtctctggacaggcttctcttgttccacatcaggcttgtaagatccatccgtgttgttgcctctagctgttattttagttgctctgtataggattctattgtatgaatatgctgtatttgtttattcattttcctgttggacatgtgctgctttcagtttatagctattacagaaaaggttctgaatattcccgtgtgtgtctctcggagcacatgtgtacttttcatttggttacatagctaggagtggcattgttggctcatagtctgtccatatgctcagctttcatagactctgccaggcggttttactaagtggttgtactttatcatcagtaaatgagtgttacagttgttccacatctttgccaaacttgatattgtcggtcttttttcttttaactattctggtaggactcttttgtaaaatgttttaaccatttggatatgttcttttgtggagtaccgaattaaatcttttgctcattcatttattattgaatactctgtcttattgatttgtacatgtttttatcaattctggagaccagcctttgttggttttgtgagttgcagatactcactttgcctttttgtcctcttaattatgtcttggtgaacagaagttcgtttttgtttttgtttttagaaacagactcttgctctgttgcccaggctggagtgtagtggtgcagtcatagctcactgcagccccaacctccgtggctgaagcgatcctcctgcctcagcctcctgagtagctgggactataggcacaggccaggccaccatgcccagataatttttttagtttttgtaggaacatggtcttgctgtattgctcaggctgatcttgaactcctggccttacgtgatcttcctgcctcagcttcccaaagcgctgggattacagatgtgagcaactgtgcccagcctggtgagcagaagttcttaattgtaaaatagtgagatttatcagccttttcttttatagttagtactttttgtgttctgtttaagaaatcctctatctctaggtaatgaaagtaggtatgcacctttattatcttccagaaacatttaagtttgtctttcacaattggatcaactttattgaggtataatttacatataaaactcacctgctggtagctgggtgctttttactaagtttacagaattgtatacccatcaccacatttcagttctagaacatttccatcacttaaaaagtttccccaagcttgtttgcagtcaattcttgttctacccaagcaaccactgatctgctttctttcttcttggatctgcctttttaaagaaattgcatatattatggagtctgatagtgtttgggtttaggttctttcacttagcatgtttttgttgttcacccatgatatgtaccatgtatcattagttcattccattttgtcattgaacagtattccactgtatagatatatttagttcaccctatcaataattgatttttgtgtgtgatataaggtatggctcatgtgtcatttttttgtgtttggatatctgcttgtcctaacactatttattgaaaagactctcctccctgcttagcagggccacttttattataaatcgtttatccctatacatgtatgtttgttggtctcatacactgattagaaagcactactgccacactgccttaattagtgctcaaataagtctcaatactgttctcttgctagattctagaggtgttctgtccaatatggtattctgcttactttgtttttttttgtttttttttttttttttggagacagaatctcgctctgttgccaggctggagtgcagtggcatgatctcagctcactgcaacctctgcctcctgggttcaagcaattctcctgcctcagcttcttaagtagctgggactacagctgcgtgccaccaagcccagctaatttttttgtatttttagtagagatgggggtttcaccgtgttggccaggatggtctcgatctcctgaccttgtgatccgcctgcctcagactcccaaagtgctcggattacaggtgtgagccaccacgcccagcctctgcttacatttaaattaaataaaattgcaaggcaaggtggtgcatgcctgtaatcccagctgttttgaggaggctgaggcaggaggatcacttgagcccaagagttcgaggccagcctgggaaaggagtggtgagaccctgtctcagataaatatataaattttaaaaagaaaaataagtaacatttaaaatttagttttgcaatcccagtagccacatttcaagtgctcagtaggcacatgtgactaatggctactgtaatggcaaacacgtataaagaacatttcatcattgcagaaagttctacaattcagagtaggggttggcagatttttctgtaaggggccagctggagaatagttgaggtttgcaggtgctgtggtttccattgcacctacctaactctgctgttgtaatgggaaagcagccacagaccatgtgatgagaggggcatgtctgtgtttcagcaaaactttatatttctgcaaagagacagctggtctatggttgtagttttctgactcctgctctagaatgttttgcctttcttggtgttttacattttcatattaaccttaaaattgtcttgttaaattctacctccctgtacctagagtagtcaaaactatagagacagaactagaatggtggctgccggaagctggaggagggaaaatggggagttagtgtttcatggggatgaagtttcagttcgggaagatgaaaacgttctggagatagatggtagtcacggttatacaacattaggaatgtatttatgccatggaactgtacactttaaaatgtgactgtggtgcattttatgtcatgtatattttaccacaataaaaaaataaataaataaaaaagaagggaggcaggagaatcgcttgaacccgggaggcagaggtcgcagtgagccgagatcatgccgttgcactccagcttgggcaacaagagcgaaactccgtctttaaaaaaagaaagttttgggggaggaattttgccttcctcagccttcaaaggaaagttgagattttgattggaattgtattgagtctctagatcaacttgagaattgacatttgtgcagtagtgaactctcagttcctgaactgggtacatatttgtatatttgggtgttctttaatttctcttaatgttttctgcgtgggagacatgcacatcttttgttagattaattgctaaaaatttaattgcaaaaatttgttgctcttataatggtagattttttttccttaaattttatggtttatgttggatgtagtatcgagaaataccattgatttatgtgtatttacttacagccaacaacctggcagaattcatttattctaacacgtctgtagctgtttcttggccttgtaactatggaaacaatgaaatcctccatggatactaatggtgacgtttctgcctttccagtccttttgttattattattatcattattattattattattattattttaccttacttcactggctagaacctccagtgcagcgtaaaagtgtcgtgtagctctccttgatctcaaaaggagcactttctatagttcatcctaagatgtgaggtttgctgcatctactgagatgatcatatgactttctatccttttgtctccccaccctccctgccctcagtcatgtagctttctacctttccttatctgacgtagagtgtaaacagaataagattctttaaatttcagtgggacgctctttctaatgccaggcagttagctgcatccttgatcacagcagagagcagcacccattaatggtggaggcagcaccattggcatagtgagcagtccatgccccatgcttctgtgagtgagcatgcccattgcatctttcagttgatggggttcctccaccgaaggcaggtaaattgcctcagaaaggtgaaggaaggaactaagagtaccttcatgttacataggaccttggaggttacatagttattccagtgtctctttctgtctagttcttgaaggtgatgtgattatttgagtcatcttttattgttactatcaggaactacaataggattttggagaaattatggagagaaatttggccccaagaaaacatgggtttgtattagtttcctatggatgccgtaacaaattatcacaaacctagcggcttaaaacagtacctagttgttatctcacaggaagattttctttttttttttttttttgttatactttaagttttagggtacatgtgcacaatgtgcaggttagttacatatgtatacatgtgccatgctggtgtgctgcacccattaacttttcatttagccttaggtatatctcctaatgctatccctccctcctccccgcaccccacaacagtccccagagtgtgatattccccttcctgtgtccatgtgttctcattgttcaattcccacctgtgagtgagaacatgcggtgtttggttttttgtccttgcaatattttactgagaatgatgatttccaatttcatccatgtccctacaaaggacatgaactcatcattttttatggctgcatagtattccatgatgtatatgtgccacattttcttaaaccagtctatcattgttggacatttgggttggttccaagtctttgctattgtgaatagtgccgcaataaacatacgtatgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggcgtgagatggtatctcattgtggttttgatttgcatttctctgatggccagtgatggtgagcattttgtcatgtgttttttggctgcataaatgtcttcttttgagaagtgtctgttcatgtccttcacccacttttggatggggttgtttgttttttccttgtaaatttgtttgagttcattgtagattctggatattagccctttgtcagatgagtaggttgtgaaaattttctcccattttgtaggttgcctgttcactctgatggtagtttcttttgctgtctcacaggaagattttctgtgatgatggaaatgttctgtatctttgttgtccaacagggtagctactagccacatgtggctgtagaggacatgaaatgtggatagtgcaatcgaggaattgatttttcattaatttgcttttgattactttaaatttaaataaccacatatggctactggctaccaaattggctaagacagccgtagcacatagcattggtttttagtggcatttgtttatgttatacttacattatgacaataaaatcttgcagagccatgtgcacatgggacacaaaagtcaataaatatttgcagagccattttaaataacttggggagggaagaaaaagggctagattattttgtttggtttttgttttttccaatatacaggaagtattcacttgcattctgaaatttatgatagaaagttaacatgacataaagccttactcttcgtagtctaaacagaaggccgggattcagttcaattcaattctattttctcttttgggtttttcttgttgttatttgagaaggagtctcactctgttgcccaggctgcagtgcaatggtgcaatctgggctcactgcaacctccacctgccgggttcaagcgattctcctgcctcagcctcctgagtagctgggagtacaggtgtgcaccaccacgactggctaatttttgtattttttagtagagatggggtttcaccatatttgccaggctggtcttgaactcctgacctggtgatctgcccgcctcagcctcccaaagtgctgggattacaggcttgagccactgcacccagcctttttttttttttttttttttttgagacagagtttcactctgttaccctattttttgtagagacagggtctcactatgttgcctaagctggtcttgaactcctggcttcaagcagtcctcctgcctcaatctcccaaagtgctgggattataggcctgacccactgcacccagtctcttgtattttttttttttaaacctaattgtctgaatcagaagaatcattagatttatctggaaatgttcgagacactcaggaccgaggacattctttctaatccattttgcgttggacctgttcttagaagcttatcattggaaggtgacagtaatggtgtgattgttcaccccaccatggaaacttgcctgttacatttctagtatattattattatactagtgagggctccaggcttctactttgacaccagcattaattctgtctcttactttttcacattcttttaacagccccaagatgttctcgttcacacacctcagtttctcaaatccccatctgagcaaagacccaaaaccatttttgttcacatttgacaatacctgctcccacttaaaataagtaataattaaatcattttacaagttgagtattttttttttttatcaacagtgaaaattacttagcttttgggcttgctttgagttgtctaaattgtgttttgtttggggcttttgtagccagcctgtctcgatcagcctttctgtctcagagatattatgaagacttggatgaagtcagctcaacgtcatctgtctcccagtctctggagagtgaagatgcacggacgtcctgtaaagatgacgaggcagtggttcaggcccctcggcacgcccccgtggttcgcactccttccatccagcccagtctcttgccccatgcagcaccttttgctaaatctcacctggttcatggttcttcacctggtgtgatgggaacttcaggtaagtaaacagtgggaaaggaaactgtttttccctatgatgtttctaactaatgacggaattgtaactgggtcttatactgtcacaccaatatggtggttggctccagcccacttttttttttttttctttttttttttttttttttgaggtggagtctcactctgttgcccaggctggagtgtaatggcgcgatctaggctcactgcaacatccacctcctgggttcaaatgattctcctgcctcaccctcccaagtagctgggattacaggcgtgcaccaccacgcctggctaatttttgtatttttagtggagacggggtttcaccatgttgtgttggccaggctggtctcaaactcctgacctcaggtgatccacctgccttggcctcccagagtggtaggattacaggcatgagccactgcacctggctgctcaactcacttctgcttatattctagaaattagaagactgattgaaaagatgtgtgttccccttgaaagcagttgctaggccattgtgaggaaggagatggctctccaagtttatgcgctataacagtttttctgctgagccagcttgttttttaaaacagatctttttcagaagtaaaagggggctgtttgcttcagttataaagcaacatccacactcatatcttttaaatcctggctcatttcagcctgacttgtggcatattctgcctcagaactcaccagctctgatgcttgtggtcagtattggctcactgtactgacaggtgttgtgcccccacactttcagtacagtgtcagggctttgcatcaaagtgacttccagcagagaaaaataccagtgttaggtactagaatgaagagaatttgtgagaggggatcagggaattggtctatgttggtataaaagttgtatctcaatcagtatcaggaaatgatgatgtatcttagtagaggtgggtaggcaaatttcatgcgataactgaaagatatagatgccagcctgttagtttactggtacttttctatgttaacgctaattttagcattttccctgcagtcgaacataaagaatttaccaatttaaccttttgtattttcctgttctctcacccactcacacttaatttttcttttcctcttagtggctacatctgctagcaaaattattcctcaaggggccgatagcacaatgcttgccacgaaaaccgtgaaacatggtgcacctagtccttcccaccccatctcagccccgcaggcagctgccgcagcagcactcaggcggcagatggccagtcaggcaccaggtaaaagctgtagccccatacctgtacagaggctgattatgagctgtctgagtcacaggccaggacagcaggtggcaagaaacagtgggcgctctttggtgcccttcagaagagaagattgatgtgacagccctctcccctttgtggagagagttctaagaaagcagagactaggtctgaaaatctttgcttttaaggggagggattagaactgccacatttagttaaggtggaaatcagtggggtttgtttttttttttaaacaaaattgctaatcctacttttgaataatgtctgcttagagccctaaaattataacctttgaaattcgatcatcgaataacactagcgtcatctcttagtatcttacagattgcagctaccccaagaggtaggtatttgaatggctattttggctgggcatagtgactcatgcctgtaatcccagcactttgggaggctgaggtgggaggatcacttgaggccaggagtttgagaccaccctaggcaacatagtgagacctcatctctaaaacaaaacaaacacaaacaaacaaaaagaatgaccattttgtgtttgagtaatctgaagttcagagaggtgaaggttatcccaccaataagtagcagaacccagactctaaccctctgctctttttcagttgagcattttttcttctccaactatatcttgcatgaagctttttttttttttcttttgagacagggtctcactgtgttgcctaggctgaaggacactggtgcgatcacggctcgctgcagcctccgtgatctcccgaacccaggtgaccttcccacctcagcctcctggatagctaggactacaggcatgcaccactacaccaggcaaatatttaaaaaatttttgtagagacaggatttcaccatgttatccaagctggtctcaaactcctgggctcaagtgatccacccgcctctacctcccaaagtgctgggattataggcatgagccactgctcctgaccaaagctttttttttaacattgtaaaatttaacttttacagaaggaagcgctaataagtcagttagcacttaacatttcgtcagtggcttgtcattatcccaaactttctactactttctacgttaatgtacattgtacattaggattttacagtctgcgtagttggtctcaaggacttcagttatcactagttatcagttttataagctagtagttctcaactagaggctgcccccacttccctgtcctccacccctgaaacagttggcagtgttgctggcatttagtgggtagaggccaggaatgctgcaaaaaaaaaatctttaaaatgcataagacacccccacaacaaagggttatctagccccaaaatgtcagtagtgccagggtcaagaaacagatataagccaaatattttcattttagctgagtaaaattattttttagatgtatcactgcttacaacacttatcaatttagagttttttttaaagactaaaaagacataatagtttgatttaggaaaaaagaactaacattaaacagtgataagtcaaaagattgtaaagaaaaattcaaatattaaaacctttattaagacatctaacatatatattgaagaacaaaacaaagataacttttgaggtacctttgggctttctaaaaatagaattctttgatctctttaaatattacttggaccaggtagaatcttgccattgtgctgaacaggcctgaaatcaagttgatcaagtcaatgatctgtaaaacgttaaaatctattaggattgaggattgttccactcagcagaaggtggtgtgatctgtattatcatgttggatgcaaaaatttctaaggtataggcacctttgaatatgaaatatgaaagatgtgcagtcgtgggcaagatgttctggtcacttctttgaaagagggaataaaagagaattaactacaggtctgtcattctgcttgtgataaccactttcaccttggccagtgatgcagttagtaatgagccacaagctttgctcaggcttccttaattgctaattatagaatgtcattaagtcttttgggatacaatttacaattataagacgaaagctgatgaggaggtgtcagatatatgcctcttagtctcttctcccattattgtccaagctccattttccacattttattcattatgcctttctgtctcactaggccatgagtttctttagagaagaaactatagatacattttgtattcgcagcccctaacacagagcctggcacataataagcccatgttaaagaaagacagtgaatgagtggcagaaatcctgagtctagatgctgttaatcctctagctcaagctgcccttttccaggacagaccagcagtgtggcaggtgtctcagctctgtgtagaaaagctggccagagaattcttttcccctactctagtacattcgattcagttacaggaagccttgttccatcacctgtgttaatggagtaggccaggtgttcctttgaacacaatgctgcaagaactacctagagtagatttccttcacatgataaggctctaatctgcttgggctcatgtcttggtttttcatttatatgtggctagaactttttatcctttgctggaattaatatggtgttctctcttctctgtttaaattagctgtaaacactttgactgaatcaacgttgaagaatgtccctcaagtggtaaatgtgcaggaattgaagaataaccctgcaaccccttctacagccatggggtatgttctgactgcagtgtgtttcagcccctggctgcttctgtagtagcggtggactgcctgcagggagcagcagtgccactgtcacagtctggttttcctgcaccgccttaggttataaggggggtggcggctaagcctgcctacacaatgcattttcaggagactgtcctttttaactggccggtgacagttgcctcacaaacttttaaagtttgtcttgatgctgtatgctcagtttctgtttgccatgtgtaagtctctgtgtggtacacattaggtgtgcaggttgattttttttttttttttaatgccctaggggttccagagttgatgctttgggtctcatgcagacttgattctggaaactgtaatctcaagggtgacactctcctccctcacttcccttctccaggcatttctgttcttcccatttcttttgcttttgtataaaagacagcacctctgtttggagactttagcttctctgccatgccatgtttgagggctggattgttgctggtggagctcacttgtttttttggtggtggtggtggttttgttgttgttgttgttgttgttttttgttttttgttttttcttagacaaggtctcactcttgcccagactggagtgcagagtgcagtacgatcatggcacactgtagccttaaccttctgggcccaagccatgctcccatatctgcctcccaagtagctgctgggactacaggcacatgacaccacacccagctaattttttaattttttgtagagatggagtttttgccatgtcaccccaggctggtctcaaatttctgggctcaagtgatcctctcacctcatcctcacaaagtgctgtgattataggcaggagccactgtgcccagcctagctcatttgtctttagtcctcatctgtgttcggaattcagggtgctgactccctcccgctgccctgggcaggttcgcagaacatgcctgtgccctgctttgccctgcatattttgtgactgtgatccctttagaccaaccaccatcccctgtggcaaagggaagagttgagggacatttcctcacttggaacatggggatcttgaggactagtatcagatttcagggagttagtgtctggtacccatgattagtctagcagcaagaagggcagccatagaccttgtggttctccacagcgtgcccaccctctgccattgcacagagcagatctgcccacggttctgttttccctctctcaagtggccctgcctcactggtccgctggcctctttttttccatgttgttctgtttatcaacactgcttgtttgaggaatttttagttatctcagggccatactaacagccaaaaaacaagccttctctattactattttgtagtgacctcggagccttggtatgctgtttagaccaagatggtatttgtggttgttgcaagcttttcaagggaaagaactatgcattagagtttgggaattgtagccagattcccagcatagggaaggcaaggcagaatgttacataagatgggaaaactcagcatatggtacaggaagtattgtctagtgtttctgagatatattaggtgctaaccatgtatgagaagcaccttttggagattccacttctccttttctcaagcttcatttccctaaatggttcatctgagctgatctttgatgaagggtttgttcaaggagtaattttgagtctactctttctgacaaaaaatctcagacaacttaagaaatcttgaagaaactttctgttccattctccacagaattagactctggtataattatttcatgtgtatgcccagcatggtgcctgaaatgtagaagcattcctttcaataatcatttattgaataataggtaaactctactccaaacataaattgaaaagtgaaaattggtgtttactgccacccctccccaggaaagatcgagagaatatgttcattgtaaaatgacttgctttcagattcttttatgttttatttttaaaattattttcagccagctctcgtggaacagattcttttaaacagtagtttcctaagtgtattttaagtatttaattttgcagttagctttttctcagtggtatctacagaagattcatcataggatgagcttacatatttctgccattggtgtactttatgttcattggcctcatccattcagttcgttggaagagtgtttatctggcgccaacccacagctattcaaattcctttgcagtgctccatcgcttgattcagcagattcttacacagcgtctgctgtgagcatgatactgccctgggtactagagatagggtagttgaataagacaaaccaaacaagaagacagccgggaaactgccaattacacaaacacttattttggtgtgcattcattcatttattcattctttcaacaaatacttaatgagcatttgttgtatgccacacagtattcttaggagctggagataaactacctgttttgttgttaacaaaatagaccaaaaaaactaacagactgattgtttggagagacaaacaataatcaaaataaataagtaaaatatgtaatatgttagatggtgatatggtgtgatggagaaaattaaagcgggggaaaggttagagagtattgtctgaacatgggttataattttaaatagggtggccagggaaggccttctcaggaaggtgacctttgaatgaagagagaaaggccacacagcaggtctcattaatatctcggaagaaagctccaagcacagggcctgtagcaggagcgtgtctacaagttgaagagcgagccaggggggacctctggtgacgagagtagagggaacaagaggaagaatgctgggggagtaggtcaggaaagactgttggtggacagtgtctgtttgagtccctgctttcagttcttttgggtatgtatgtaggagtggaatcgctggattacatagctcaaactggtttacagaggtgctgcaccatttttcattcccaacagcaatgtatgggggttccagcttctccacatcctcaccaacactcattattgactatctttttggttatagtcatcctagtggtataaaatggtatctcacactatcagtggttttgatttgcatttccctaatggctggtgatattgagcatcttttcacgtgcttattggccagttgtatctttggagaaatatctatttagttcctttgctccattttaaaattaggttgtctttttatttttgagctctaagtttctttatataatctgtattcaagtctctcatcaagcatatgatttgcaaatattttctcccattctttgagttgtttttcactttcttgttgtgtcctttgacacgaaaatttagtccagtttatctattttttcttttgttgcttgtgctttaggtgtcacatgtaagaaaccattgcctaatccaaggtcataaagatttacaccgatgttttctttgaagagttatgtggttttagctcttatatctaggtctctgatccatttggagttaatttttgtaaatggtgtgaagtagagatccaacttcattgttttgaatgtggatatccagttgtcccagcaccacaacatatcttttccatccttttatttcaacttattttgtctttatatttaaaatgggtttcttgtagcacagcaatgtgaatgtacttagtatcactgaactacatgtgcacttaaaaatggttacttttaagatggcagattttgttaagtgtattttaccacaataaacaaaaataatttaaaaaaataaaatggatttcttatagattaggggtccccagccctgggctgcagaccagtaccggtctgtggcctcttaggaactgggccacacagcaggtgagcggcaggcaagtgagcattaccacctgagctccacctcctgtcagatcagcggcagctttggattctcataggagcatgaaccctattgtgaattgcacatgcaaaggatctaggttgcatgctccttatgataatctaactgaataaaatataaaattatagcctgatgatctgaggtgaaacagtttcatcctgaaaccatccccctccgctgtccgtctgtggaaaaaattgtctttcacaaaaccagtccctggtgccaaaaaggttggggaccacagttgtagacagtatatagtgggccttagcttgcttttttttaatcttgaccatctgtgacttttaattggggtgattagatcgtttaccttaagtgtaattattgacatgtttcggtttaaatctgttatatagctatttgtttctatttatcccatctgtttgttgttcagtttttgtttttctgcctttttttgggttaaatgtctctatgactctattttaacttttttgttgacttattggctataacttggtgttatttaagtgcttacattagggtttatagtatacatcttcaacttatcacagactgtcttcaagtgatactatattactaaagaatagtgtaagaatctaacagcagtattctattttctcccttcaccacctttatgctattgtgcattttacttccactgtattgtaaacctcatgatacattgttataaacagttgactatctttcctccccactaccccccagatggattcttcttctgtcgccaaggctggagtgcagtggtgcgatttcagctcactgcaacctctgcctcccaggttcaagtgattttcctgcctcagcctccctagtagctgggattacaggtgcccaccatcacacctggctaatttttatatttttggtagagacggggtttcgccatgttggccaggctggtctcgaactcctgacctcaggtgatccgcctgcctcggcctcccaaagtgctgggattacaggcttgagccaccgcgcccggctgactatcttttaaatacatttaaataagaagaaaaaagtttacatgtttatacatatagttaccatttccagggttcttcattcctgtgtctggtcccagcttgccatctggtataatttttcttctgctcaaaggacttcctttaatgtttcttgaggttcatatctgaattcttttagcttttgtatgtctgcagaagtctttatttcacctttgattttgaaagatattttcacagggtaaagaattctagattggcagtttttttctttcactgatttaaagatgttcctctactttaaaaataataactctagtaatgaccagaaacttaaaaggaactttaatccttttgtttttctaattacaaatgtttgttgtagatataaaaaagatagttaaaaagaacaaacttaaaatcacctttattcccaccacaaatgtatgattgttatttacacattttttcatccttattttatgaaaatgtttcttgttagagaaaaatttggatgcatgctgctttgtaaatttgtaaccttttcagcttaatcatgaaatgtaatcgtttacattttccatgtcattaaaaattcttacactattcgtattttttcttttctttttcttttttctttttcttttttttttttttttttttttgagatggagtctcgctttgtcacccaggcaggagtgcagtggcgcaatctcagctcattccaacctccgcctctcaggttcaagcgattctcctgcctcagcctcctgagtagctgggattacaggtgtgcaccagcacagccggctaatttttgtatttttagtagagacggggtttaaccatgttggcccggctgatttcaaattcctgacctcagatgatccacccaccttggcctcccaaatgctgggactacacgcgtgagacactgcagccggcctctctcttttttttttttttttgagatggagtctcgctctgtcactcaggctggagtgcagtggcacaatcttggctcactgcaacctctgtctcccgggttcaagcgattctcgtgcttcagcctcccaagtagctgggactacaggcacctgccaccacacctggctaatttttttgtatttttagtagagacggagtttcaccatgttggccaggctggtctcgaactcctgacctcaagtgatacacccacctcggcctcccaaagtgctgggattacaggcgtgagacaccgcgcctggcctattttttcatatttaatgtggattttttcaaagctctaatgcaattccgtcttaattatttaagttacttagcatctaaacattcatgcaggaaatacaatttgctttaacagacttttggatactattttaaagaatgtgtctttgaagacattaaatttaccaatggagaaaatagttggcagttatatttccatcgacagatgtcaaaaacgcccaagaattgaatatagagtgtttgttttcagtatcttctatcattttcattctttttccctgttgatttctttgtttcttcagttactcttgataagttccactctctcatatatgagtatgtatgaaaagatacatgtgatagtgattaagatttaccaaaataaaacataaccaggtctcttgttttttatgctttttaaaatcctgaaataagttacaagaagttgaggctttttacaacaatgggatgagtatttaccttgttgaagttcattaaagttggagggatcaatagcaaagggcctaggtgacattttaatgcttcacaacccaattttataattgtgtgtagagtacacatccatggaacatgtgtgcatttgtctgcctctgttggcatgtagtgctggtaatgtgtggccaaaaacagaaaaaaatgactcttctgtgttttatttttctccaagaacccgagtttccagactcttagtgatctgtgcctctgtcgctcatttctgaagcaggaactttagtgttgctggcaatgtcagtgtcatttgtagactcactcagtaaagagatgtctctttggggctctgttatagcaccattttcttcttagaacaaatatcaagatgaatttctgatatttttcaactccatattgctaaaaagtggaataaagtcacctaagatatggatacttctgaatttggcttttctatctcttgatcatttctagctattgatttccattgttttggttcatgctcatgcaaaaacgtttgaacatatttgtttgagagtatactgtttttttctgtgtgctgtcttggatcttgataagagatttattggatctggtttgttaattggtttactggctgattgcactgaacagcatttctttgcaggggtgtcacgtggtgtgtaggtactgtgaatcctaattttgtgtatttggggatttaggatactcaggagatacatagaattatcacaaataaatagaataataattacactcagtcttattcatgcataatttactatcatgtcacaattgaattctggctgtaaaaaattttctaaaatttggataaattgctgcttttatttttatttctgatttctgtttgtctttgagaaagcatgaaagagtttcctttcctttgtaatccttgtgagctccaacctcttctctaagcaagtctgctgtgtctgtccaggtactgctcagggcccagcagtctcactcacacattcttttcctctggtacagattcagcggaggtgacgggggaacactgtatctgtattgcctgcttggtaaactatctcaggggaacagagatgtgtttctccagagagatgcatatttatagctgcttctggcttcagtagaagcatgaaacgggttttgtttcattgaacataagttcactttttcttctctctcaatctaataaagtctgtttaggaaggtccccttgttattccagcagagaatctcaatatgcttgtaaggtttgttaagctgtttgataattttcttccgtgaggcacaggcctatcttttatcttctaagttcatttttgatggaaaatatgaatcctccctaaatctaggggagttctgaaaaataaccaggtcctacaactactactgctatatataccagtcagagtagcgctgggctgacaacagataaattgaaaaaattgccgctaggagccaagaacttttgtgtgtgattacactaacaggtagttttcccatatgtgaacactagttattgaaataacagttcctcacatacagtattcacctacttcagagttaacaaaagatgatgagagctctttctgcgaataggggtatacttttcatgctgtagcaaagatgcaggttgggaatggaacagtggtacatttgaatcccttggatgctgacctggtgagccctggagatagctgctgtgagaagctaagatctctttggatagcacctttgcggtagcagcgaattggatgcataggtggcagtgagaatgcttcccatagagcctgcttgggtaagagaatcaggaatttctcgtggtctacaacagggggaagggccagggaggaggagggcttatactctggatagcaaaaagatctagttctgaatggttactaatttttttctttggattgcagaaaggaaataagttataaggccactgctttgactttcatgctaaaaacccaaagttcatttttaaaatttatccttcaaaaaaaatgtcaaatcagttgtattggggtcccatgcatctgtatcctacccaaaactggtattgtatattggacagaaggttggcttgagaatgaatgtgatttttacctagtcatgcctttctctgagtgtatgctttgtgtgtttttcagttcttcagtgccctactccacagccaaaacacctcacccagtgttgaccccagtggctgctaaccaagccaagcaggtaacttactgatttttactttttttttttttttttttttgagacagagtcttactctgtcgcccaggctcaagtgcagtggtgcgatcttggctcaccgcaacctctgcctcctgggttcaagtgattctcgtggctcagcctcctgagtagttgggattacaggcacccaccaccatgcccagtcaatttttgtagttttagtagagacgcggtttcaccgcgttggccaggctagtctcgagctcctgacctcagatgatccatctgcctcggcctcccaaagtgctgggattacaggtgtgagccaccgtacccggcctgagttttacttttaacattcatgccgtgtctgtctttgtaagtgaagaccatactgtttttaagtcttgactttgtttaaatgaaccataagtctgataaaggcccataatcccttccccacaatttatgccagtcttgacatggctgttaatcagggtaggtcagtcaggacctgatactgtcttcataggccatttaaacattctgcacctagtaatttggggtcataattctaataccatacatttttatatgaagtattttgctttgcagtttactttcacattatctcagttaacccatacaacagccgtgtacagtgggaggataggtgtttagatatgtctcactggtgaggcagcctaggcttgagtgaccaacgcaaactctcacgattagtaaatggtggaaccagagctgggacccaaggcttctgacttcctcctgtccattgctcgtttcactacacagttgagtatcaatgtctggggtataggttatctggttttctcctgcaatccctgtttgtcagagtttgcatatttttagtgatgttatgtctagcttgtctagcttcaggcttttgcctgataaacattgtcccttagaaaaataggtgatattgcaaacagttaaacaatccagaaaaaagtgataggggatggttggaaggtcagtcaggctagtgctgaaactcttcctaagaagttctggtttctctcactactcttacatctgtctctgagatgagtagtttgtgttagagatcagaatttgagactggatatcaggacttgcctatttaagttctcaaacttgcctctgttccttagtttaccataacttaaaatggcatttaagcatttagcattcgatctttcttctggaggtatttgtgttcaccatggaaaacacatgataaggcataagtcatggcgagtgaaggaacattgactggagatggataagtcagttttgcttttaaccttattgtacatgctttgagagctagaaccattttattaatttactccttcattaattcatctacctaatagtcaagtgcttttgatgtgctaagcactgtgctaggcactgggaagatagccatgaactaggccagtgtgactgccttcttggagcttgcagagtatttctattttcatcctttaatatgatcttacatatggttaacttaaattgagaccttttttttgtttcctttttctttttggtaatttatctaaaagtatttgtccttgcttattttaaattatatttttgtgtttacattttacatatttctttgttacaaagaatggttagtggtttaacataaacattttgcttgcattctgttataggggtctctaataaattcccttaagccatctgggcctacaccagcatccggtcagttatcatctggtgacaaagcttcaggtcagtttgcatttttgttttcttgaaaagtgaaagaagcactccacaataggggttattgttctggatcactgagacagttgccataggaaacaggagtcacatttgatgagatcgggagcattcagggtagtatgaccatagacaagagatcatatttgaaagccgtcagctaatgaagaatttctagaaaattagtatgcccttcaatggctatgtagacttctgaaatttttaggttagtttgaaaatgatagagcaataggagaaaaacctccctttaaattcttttcctaaaatggagcaatagtattatctttttcttccttgctggatgatcacagttgagaggaatggatcagaatgctaaacgctatttcttccactaaaaggaattaaaaattctgttggtccacagtgacagttcaaaagcctataaggtagagaaagtgaaacagatttgtaagatctcagagtatataatgagtcgatattatgagattttatggcttcacgtaacttctcctacactcactcaagcataattattcttaatttagttttcacagtaaccatgagtgttttgaccagacactttgtccaagtgtcattgcccaaaccaactttatgcagaatgtgggtcttcctcagtgtccccttttgttggctcctttattatagcctacctaatttggcgtgtattacttcctgctgcaagggtcttgtgctgtctgcaatactgaatttttacaacactgttgattctggcatttgtttcaatcatgctcttaagtgggccttcaagcaaattctgttagaaattgaacttcatacattagcagcctgcgtctcataatcttaatcatacagtcattctgactttctctgtaatcccaaactttctgattggatactggatttatctttagtagctattccttgcagaaggaagccattattgcataagccagagttgtattctagaattcggagtgatatggaaccacagttggtatcatgtacgcctcacatgagaaggaggtatctagcacttctcgaccggggcctaaagctttatgttaaaaggaaaattatatagtagaactgtcaaagacttgagtattttacaaaaaggttttgaaagatcatatactcttttttcaaggacttcattggagaggtttttgtcactcttggagttagaatcaaagaaacctaaggaactttgctttatgcatgtctgggcaagtagtgtgacttgcaagaaatttccgagattcaccattcattgctgatcatgaaatcctctcttttgttacgaggtgttcacttctgttttcacttgccaggtaatcaaggtttagaaaagaacttttttcttttggtaggaaaacttccctgaaaggtgctgcttaagagtttgcaaaaagtttctttttgaaaaagagcatttctaaaacctctagagaatagttctcttattagtaatggaaataccttcattgtttttctgattgtaaaactattacatgcccagaaaaagcctatggtgtagagatatataatgtagaatgtgaaagctgccctatagattctgtattccagagatcatgatttcatgtatatctcttgaggttacttcattgttttttaaagaaaaatatcctatatactgtatatcctatatatattgattttgtaacttatttccccttctctgccccctcttacaataaatgtcttggtctctgcaggtctgatacagatccaccttactcattttaagagctgtctacaacctcattgtgtagttataccctgttaaatttaactagtactctgctgatgatttagattgtgacttttcatcctgtacattttacattgtatatcagtagttttaaaaatatttgtactgccatctaccctgtgtttgtttattttagaaggttggtgttttttttttcttgttgttgtttggtttagtttcgtttgatttgggcttttaaatagttttcctctttcctttcccccttttgaagtggagcaaggccaggcctggtggctcatgtctgtaatcctagcactttgggaggccaaggcaggcggatcacctgaagtcaggaattcgagaccagcctggccaacgtgatgaaaccctgtctctactaaaaaaaaatacaaaaattagccgggcatggtggtgcatgcctatagttccagctgcttgggaggctgaggcaggagaattgcttgaacctgggaggcagagattgcagtgagtcaagattgcgccactgcactccagcctgggcgacagagcgagactctgtctctaaataaataaataaataaagtagagcagtagggaaaagattgaagattgtacccaaactataagtaagtagttagagtgaaatcgaacatggggagaatgatggattgcacttttaacctttttgcatgtctccatattatagcaatcatgttttacatctgtaattttaaaaaaagaacacgattatttgttaaatgccaacaaaatctgtggaaaatgcagaaatgtatatagaagtaaacagccttaaagtcactactcagaaatatttagcttatgaacctatttctcttttggatttttgtccttcagcatagattaatttcaaataattataaagctacattatatatagttttatttacttttgtggggagggggcttagcctcacattataagcattttcccataccattgaaatatataagagtgtacttttaaaactgtacatttaaactatactagaattattttgatatattttctgtaaaggagaagatggcacaccttagactggaattaacattgacagagccacggagcaatttcagagacctcaaacacaagtgaggcaacgtgctcactccccatggccactgacgtgtcacagaaggcaaatgtggtgctaagcagcacctcacaggctgagctacagggaattatacactggaacagtgtttctgtctttttgtaatattcttttttttttttttttttttttttttccataatttcagggacagccaagatagaaacagctgtgacttcaaccccatctgcttctgggcagttcagcaagcctttctcattttctccatcagggtcagtaatgaacttaagttttatggcaaattactagcaattagcttccccaaatcttacaattatagatatatttatttacttattaaatgtgtatgaacccagagttcttaccatggcagtaatacatgtgatgatagtggcagtagtttaatgttctcatgtaaatcgattttccctttgcaattcaagttaatacttgtttgttacatatttgtgtatctgttttgttttttagcctaagcctcattttctttgagtaatgagtctgctaaattctgtagttcatctagtttgtcacactgagatgtttccattctgacaccattttgggggctagatgtgacattcaaattgactttgctggacaaacatggtggctcatgcctataatcctagtgctttgggaggccaaggtgggagggattgcttgaggccaggagttggagactgacctgggcaacatagtgagacctcatctctacaaaaaattgaaaaattaaccaggtacgttggttcacttctatagtcccagccacttgggaggctgaggtgggaggatcccttgagcccgggagttcgaggttacagtgagctatgatcacaccattgtactccagcctgggcaacagagtgaaaccccgtctccaaaaaaaaaaaaaaaaaaaaaaaaaaaggcttactgcatcgagagtacagtatactaaacttagagaatgtaatgaaagataataggcatttgaaatttgaggttttatatagatgtggaggaatctgtttccgtttctttaaaaaataataataataatgatggctgtacttgtaaagttgagttgtttttaaaaatgaaagaatcttctataccttatctcaagatgagcctttgttaaggtgcctgttctctgtgccctgagcgctcatgttgaaacctgtgtgagctgctgaagcattgggttagactctgtggaactgagatcaaaatgtgtcaaaaggattttttgccattgaagcattgtgcattcagttccttagaaaagcctcttaagttcttcagtttatgcttttgtaactaggagcatattaaccagtctctttttcctgattttaatatattttttgagtgtccttcagcctaaggagaaaagagggtattagaatattatttgagggggaaagtaatacatatattttttctttattataaatcattatgttttatgcttcccaaaggtaatttgcagcaaattttaaagagtaggtcaatgccaagaattattgcatcctttacagatggctaataatcagtcttctgtgaaatgatattcttcttccttttctttttttttttttttttttttttttttttttttggattttcaggcagagtatcactccgtcaccctggttggagcgcagtggtgagatctcagctcactgcaatcttcacctcccgggttcaagtgattctcttgccctagcctcccaagtagctgggatcacaggtgtgcaccaccacacccagctaatttttgtattttagtagagatggggttttttcatgttgcccaggctggtcttgaactcctggcctcaagtgatccacccgccttagcctcccaaagtgctgggattgtaggcacgagccactgcacctggccctcttcccatttttaaaataacccagaaaaggtggggtcattgaatcaatggcttgacactattagataaaattttttcactaagaaaggttgtgtttttttttttatttttaatatgatgggcaaaggtgtctaagttattacattatttagtatatttgatgtgcttggttcgttatattttaaagctagtttgaaatctgcaatttgaactttgcgtgtgtgtgtgtgtgagatagagcaagattctgtctcaaaaaaaaaaaaaaggtgcagtggtacagtcatggctcactacaacctccacccccaggactgaagtgatcctcctgccttagccccccgaataactgggactacaggtgcgcgccaccacacctggctgatttttgttttttaatttttcggttttggtttttgggggtttttgtttttgtttgtttggtttttgggtttttgtttttgttttgtagaaacagggttccaccatgttgcctaggctggtctcaaactcctgggctcaaaggattaacctgcctcagcctctcaaaatgctgggatgtgagccaccatgcctggcctgagtttttatcacagtgaataatctgttctgattcacactcgcgtgggattttcttccttagctatggtgtcttcacttacagtgtaaagaaaacgtacaaaaggagagaggagatggtgaaaggagtcacaaagtttttgaactagattttcctagccgtaaaactcagttctgtcaaaatgactgagttagggcttctatttcattgtatccattgttttccctagcagtgtggggctctctgacatgcttgttggtcttggaggggttctgagaggctctccctagtcttaagtgcttctgtcttaccagaccttccttctgtcccctcacttaacagaccatctgctccggccaccattcccacatgcacatttgtcatgtgtctctactgctgcagctttgctcatcttgcaagaagtccccactcaaacttctgctacagaaagcccagccatcccccaatgggctctcaactgctatccctgtcgtatctcacacacaaactgcttctctgcttagagatcatagagtggccttactgcttctgagataggtgctttgactctgttgtcatttatcttctagattgtaaattcctgagggcggtttgtatgaatgaatgataaaatggaatattaagagggcaatattgtgccttggtttgttcctttttaatttctctttttccacttgttaggactggctttaattttgggataatcacaccaacaccgtcttctaatttcactgctgcacaaggtacagactctgtgttgagtagcattactcatgtgttttctctaaataagtacaggttatttttgcccacatgttagtatttgacttgttcctgaatcttacttacagtatctgcaataagctcagtgttgataatgtgcattagaaatatgcttaatttaagaaactgatgtgaaggatttctatttttataattaaggacaaggaaaggatttgcttctagaaaatcagggctgtgctttaacatttaaatgttaacatgtgaattaaaatttctccattttttgtctgtaatttaaaatttcttcaatttatagggtgattctgtagggcaagatagacatggtaatagatagactgtagaaatgaaagaccaaactcgtttttttccttgataacataccagcaaacacactcatcccatgcatgttgttaaaaatccatcaatagactgggcgcggtggctcacgcctataatcccagcactttgggaggccgaggcaggcggatcacctgaggtcaggagttcaagaccagcctgaccaacatggagaaaccccgtgtctactaaaaatacaaaattagccagccgtggtggcgcatacctataatcccagctactcaggaggctgaggcaggagaattgcttgaacctgggaggcaaggttgcagtgagccaagattgtgccattgcactccagcctgggcaacaagagtgaaactctgtgtgtccccccccccccccgcgccaaaaaatccatcaatagcatgtttttaacatttaaaagaatttgaagccctataaagaaaccagatctatttgttaagtgcctttcagttatccgtttatgattaagtcttttattttatttatttattttgagatggagtctcactgttgtcatccaggctggagtgtaatggcgcaattgcagttcactgcaacccccacctgctgggttccagcgattctcctgcctcagcctccctagtagctgggattacaggcgcccaccaccacatccagctaatttttgtatttttagtagagacagggtttcaccatgttgattgatcaggctggtctcgaactcctgacctcgtgatccacgtgccttggcctcccaaagtgctgggattacaggtgtgagccaccacgcccggcctcgttactcttgtatttattaaccactgttgtttgaccaggccttatgggtgctttacccatatttcctgcgatctttgtaacagcacaatgaaggtaggtattgtaatgatctagattttccaaatgggggaattgaggctcagagaggtaaagcaacctttccagattcacacaaccagcgagtggcagagtgcatagctccagagcccatgtccttgaccaccagaccgtactgcctctgtcaaatagctgacttagtagagcactaataagtagccattaattgtacataaaaatgattttctgtggactgacactttatttgctcataaaaatgaaggaagaacttccattttgaatcaagtcctggtctatcaggaggtccacaggccattgctgtgctgaggatgttattaaggaaagcacacagctagggtaaattaagggaagaggcttttttatttctctttgggataatatgttaatttcacatattctagatattttgtatttgttgtgatttaatggtcataaaaaaagtattttttccttttcacctcagacgactcagagctgatgtttgtgtggagaagcactcattccacctccttagagaaagctgctgtgagaacaaggcaccctgactctgtagagggaggagagaaactttggcttagaaacacaatcagtggaaatgtaatgggtcatcttttgctaaatccaacccattttctgatttctttttcttgctaggggcaacaccctccactaaagagtcaagccagccggacgcattctcatctggtgggggaagcaaaccttcttatgaggccattcctgaaagctcacctccctcaggaatcacatccgcatcaaacaccaccccaggagaacctgccgcatctagcagcagacctgtggcaccttctggaactgctctttccaccacctctagtaagctggaaaccccaccgtccaagctgggagagcttctgtttccaagttctttggctggagagactctgggaagtttttcaggactgcgggttggccaagcagatgattctacaaaaccaaccaataaggcttcatccacaagcctaactagtacccagccaaccaagacgtcaggcgtgccctcagggtttaattttactgcccccccggtgttagggaagcacacggagccccctgtgacatcctctgcaaccaccacctcagtagcaccaccagcagccaccagcacttcctcaactgccgtttttggcagtctgccagtcaccagtgcaggatcctctggggtcatcagttttggtgggacatctctaagtgctggcaagactagtttttcatttggaagccaacagaccaatagcacagtgcccccatctgccccaccaccaactacagctgccactccccttccaacatcattccccacattgtcatttggtagcctcctgagttcagcaactaccccctccctgcctatgtccgctggcagaagcacagaagaggccacttcatcagctttgcctgagaagccaggtgacagtgaggtctcagcatcagcagcctcacttctagaggagcaacagtcagcccagcttccccaggctcctccgcaaacttctgactctgttaaaaaagaacctgttcttgcccagcctgcagtcagcaactctggcactgcagcatctagtactagtcttgtagcactttctgcagaggctaccccagccaccacgggggtccctgatgccaggacggaggcagtaccacctgcttcctccttttctgtgcctgggcagactgctgtcacagcagctgctatctcaagtgcaggccctgtggccgtcgaaacatcaagtacccccatagcctccagcaccacgtccattgttgctcccggcccatctgcagaggcagcagcatttggtaccgtcacttctggctcatccgtctttgctcagcctcctgctgccagttctagctcagctttcaaccagctcaccaacaacacagccactgccccctctgccacgcccgtgtttgggcaagtggcagccagcaccgcaccaagtctgtttgggcagcagactggtagcacagccagcacagcagctgccacaccacaggtcagcagctcagggtttagcagcccagcttttggtaccacagccccaggggtctttggacagacaaccttcgggcaggcctcagtctttgggcagtcggcgagcagtgctgcaagtgtcttttccttcagtcagcctgggttcagttccgtgcctgccttcggtcagcctgcttcctccactcccacatccaccagtggaagtgtctttggtgccgcctcaagtaccagtagctccagttccttctcatttggacagtcttctcccaacacaggaggggggctgtttggccaaagcaacgctcctgcttttgggcagagtcctggctttggacagggaggctctgtctttggtggtacctcagctgccaccacaacagcagcaacctctgggttcagcttttgccaagcttcaggtaagaatttgtggaagctttttacttgtttccctctctgctatttgaaacattagcaacagacccctattacttttgtaattaaaggggagactcaaaacccaaaaataatctgtaggttaaagaagacagcttggagcacatgtggtctcaggaacttgtttggcctaattggctggatctgttacagcttaatgcagctccagttttgcttcttagcaaattgtccactctgcaagccaccagagtgtgtttcatggggaaaaatcaagcatctttagttgaggtcctgccaagtaatttaatgaacaataaataggaaatttcaaatttggaaggcactgtagagatcattatacccaaagctgtcaagcctcaaggagactgctctaatgtcaggatagtgccagtggaaccagcaggagagtccaagtgtcatcatagtccaccgccctgccagtgttttctgtctcctctgacaccatctttcttactgtaatggcagtcactgacatttgatttgggttcttttctattttcagtgttatgactttttgtaaaaactacagtttactgtttttgacagtgaaacctaattcttctctattgcattttccattttagcagctacttttacttctaaaagttatcaataagcaaggcaatttgaaaatctgtcctgagatttgctttctgaaagttatcttatgaaaggtaattcttcagcaatagactctaggagaaaagcaaggatcaatgatttcatggtgggcaagattactagtaactgctaattcattattcgatgataacttgaaaatggttcataatttattagaaaggaaacattttcctttcttcaacaaatgtttgttacactcctcctaaattcagctataaggacacggtgttgaaaagacagatatggttttgagacctacccaatgccctgtgaagaggccagagggctgctgaatgatgggaaatgtgctgacttggtccagaaaatgggcaaggagaaggccctatgagtcttagaggagaacgtgtaacacagtccgtatcactaccacaccatttgctctgcagtcagaacctgagaagacctcatgcacaggcatggtcatactatttcaacaaattcagaacccaggaaggaatcttctttcatttagtatctgtgcggaaaggtatctgagctgtctacttcagccctagttgaggaattgagtcttgtctaagctcacctacccaatcagtgacagaaatgagaatagaggctgggcatggcgactgacgcctgtaatcccagcaattcgggaggccgaggcaggggaatcacttgaggtcaggagtttgagaccagcctggccaacatggtaaaaccccatctctactaaaaacacaaacattgccgggcgcggtggctcacgcctgtaatcctaacactttgggaggctgaggcaggtggatcacctgaggtcaggagtttgagaccagcctgaccaacatggagaaaccccatctctactaaaaacacaaaattagctgggcgtcgtggcaggcgcatgtagtcccagctacttgggaggctgaggcaggagaatcgcttgaacctgggaggcggaggttgcagtgagccaagatcgtgccactgcactccagcctgggcaatagagcgagactccatctccattaaaaaaagaaaagaaacgagagtagaactcctgccttctcactccttgtctggagctcttttgttgtatagttctgcctcatgttcccaggccctgttcagctcagcacttcaaccatgttatgccatctggaagaaagataaactaccctgaaaagaatgtggtatctgagattcagaagaaaccgaggagtagaaatattcataatattaagtcattagaaagaatttctggtcactgaaagtgaggataaactattcttagcccccatccacgtggggtttggtaggagaggattcattccccagggctttagaacttacactattttaaaatgttagcaatgaaaaatggtctttaaagtatttgctcagacttttctccatactagatgaggaaacattttattcataagttgatttattatgggctatcttagcacacctgaatgtcatttaaaaagaaataaacttaggctgggtgcggtggcccacacctgtaatcccagcactttgggaggccaaggtgggtggatcatgaggtcaagagatcaagaccatcctggccaacatggagaaaccccgtctgtactgaaaatacaaaaattagctgggcgttgggaggcggagcttgcagtaagccgagatcgcgccactgcactccagcctgggcgacagagcaagactccatctcaaaaaaaaaaattagctgggcatggtggcacacacttgagtcccagctactcaggaggctgaggcaggagaatcgcttgaacctgggaggcagaggttgcagtgagccaagatcccaccattgcactccagcctggtgacagagcgagactctgcctcaaaaaaaaaaaacaacaaaactttaatgttgtaaaagactcatccaatccaaattgaatttttgttttctttgtattttacaggttttgggtctagtaatactggttctgtgtttggtcaagcagccagtactggtggaatagtctttggccaggtaaatatgcatttgtcttcattcacgtcaacatgtatcaaacccattcagttttcttcactgtaatgtagtcagttcgtgttgtatatctaaatccagcaaatatagccctgtgtggttcttaagctgtactcccttcagctgccttggaggtgcagaagtctcagcctctgattaaagaggatcactagaattttgatcctccttccacagtcttctgagaaagtattttgaaagcacattgcctgattccttttttctttagacacaggatcttgctgtgttgcccaggctgtagtacagtggcacaatcacagctgactctagccataaactcctgggctcaagcaatcctcctgcctcagcctccccagtagtttggattgtaggcatgcaccataacactcaactaattttttatttttgtagagacacagtctcgctatgttgtccaggctggtctcaaactgctggcctcaaacgatcctccacgcctgaccacattgcatgatttctatcagtcccctgcctgttaggccaagggttgacaaacttcagtctgtgggctaaatacactgtttggcttttggggggtttgttgttgtttaacttcttaatctaagaatggtgtttgtgtgtgtgtgtctatatgtatacatatatgtgtgtacacacacacacacacatatatatatttttgtttgtttgtttgtttttgtttttggaggcagagtctaactctgttgcccaggctggaggacaatggcacaatcttggctcactgcaacctccgcctcccaggctcaagtcatcctcccacctcagtttcccaagtagctgggactataggtttgtgccaccacacccagctatttttttttttctttttgtgtttttggttgagacggggttttgccacgttgcccaggctggtctggtctcttaactcctgagctcagggtgatctgcccgccttggcctctcaaagtgctgggattacaggcgtgagccactgtgcctggccagtttttatatttttaagtggttgtttaaaaagaaaaaagaggaagaagatttggcaacatatatatcccctctgctacgctatatgtagcccagagactccttttggtgaactgagctgtttgattttatgtagctagcagttatctatgtgccaggcataattttaagtcttttatttatttatttatttatatttatttatttacttatttttttttttgagaccgagtgtcgctcttttgcccaggccggactgcagtggtgctatctcggctcactgcaagctctgcctcccaggttcacgccattctcctgcctcagcctcccgagtagctgggactacaggtgcccaccaccgcacccagctaattttttgtatttttagtagagacggggtttcgctgtgttagccaggatggtctcgatctcctgatctcgtgatccgcccacctcagcctcccaaagtgctgggattacaggcgtgagccactgtacccagccaattttaagtcttttatacaaattaactcatgtaagcatcacagcacctccataagataggtgcgattattatcgccatttaagagatgaggacaccgaaggcccagagaggttaaattgactgttacatcagacaccggctgcatttagatcatttagatcatagtaacctcctaaggagcccttatgaagaaagataccctaatttatcagaaaggattgtgactttctgaaggtagaatttgtattagtccggcagttaataaagtggtaggcataatatatgtttcttatacatcttcaggaagaaattttctttatcatctctgttttcctttgaagataggctctgtcctagtcagtgatctttcttaagagagaagtgaaacttctgatttccagtttctggtagtagaggactaagtcattcaagggaaccaagttccctactgaaaactactaaaaaatgctagataaaacataaaaaccttgtctttaaaagcaccaataaactaacaaggtattttaccaagccaaaaggaaaatggggacctagagaagtggagcccagaagccagttgtgccctgacagcatttactaatctgagaaaatgtgaattttctatttaataaccccaaaggtaaagggacaaaaatcaccaactaagatatgcacaaagtggggagtctaaaagagacccttcagctgggactccatgttgacaggtctcagcccctgactagactgatatggttccagagtgatgctgcctccaggtgtctggcagaggcagcgcaggcccaccctgaaggaaaggaactttacttagccttcgaattactcttacaagtaatttctgtccctcaatgagacacacaaggaaaccaggaactatgagcaagagccagaataagcgtcagaaatcacctttgcacagactacctaaactgtaaatcagctggggcttacagagtttagaagaaatcaaagacaaacttgaaaataccagtaaggaatataaaatcttaagaagtgtcatagcaaatttgaagaagaaccaaatagaatttctaggaaaatgtaatgattaaactcaggtgtaaactcagtggctgtatttggagcagattagacccactgaaaggagcagtggtgctctagaacagaatgtggtagtcagcgtttccagctttgagggctatcgatagcctctgtcagaagcacttaacgctgccattgtagtgcagaagcagccgtagacaatatgtaaacgaatgcgcatgattgtgttcagtaaagctttgtttacaaaaacaggcagtgagctggatttggcccctgcgctgtagtttgctgacctaactagaaggtaggttaaggtgagttacctggaatgcatcacagagagcgaaatgaaagatacaaaagagaaaaaatcctgtaggagaaaatccaacacacatttaatcagagtcccagaaggagaagagagaaagacagaaccttccaaaactaatcgataatagtaatccacagattcagaagcccaacaagtgccaaacgagaatgcataaaaggaaactgattctaagacctgtcctagtgatactgaagaacaccaaagatgaaatattaaaagcaactagagaaaaaagacagattatcttctagggtgccataggcagactgacagcagacttttcagcaatgaccatgaaagccagaactggccacctagcatttctaaatccagcaaaaaaatatctataaagaatgaagagaaatcaagactttttttcagataagcaaatactgaaataatttatgtctagcagacctgactccagtctgggcgacagagcaagactccatctcaaaaaacaaaagaaattctaagagatactgtttggaaagaaggaaaatttgacctcactaaaattatggccctcttaattttagggtaaaacaagccattaaataggaaaattgtagcctatgtaaccaacagtgtaattgtattcagaatatgtaaagctttcctatagttcaaaaagaaagacagctatacccaaattaaattaaaaggctgacagtaccaagtattggtgaggaagaagagcaactgggaactcatattgctagtgagagtgtaaattcatattaaccactttggaaaaccatttggcagtatcaaaactaatatacaaaatccctcttggcccagcaaatctaccctgaatatgtaaccaacagaaatgagtgcctttgttcaccaaaagatattgataagaatgttcacagcagaatattcttaatagctaaacacaggaaacagcccaaatgcttatgagctaaagaatgcataaataaattgtggtatattcatacagcccaatactacagagaaataaaatgtactgctcctatagctggcctaggtttgtttttttgttgttgttttgtttttgagacggagccttactctgttgcccaggctggagtgtggtggcatggtcttggctcactgcaacctctgcctgctggattcaacctcagcctcccgagcagctgggattataggtgcccaccaccacgcccagctaatttttgtatttttagtagagacagggtttcgccatgttggccaggctggccttgaactcctgaactcaggtgatctgcccacctcgacttcccaaagtgctgggattacagtcatgagccaccatgcccagcctaaatttgttttttaaagaaattcgtgcacgtatgtatcaggatacaagtgtattcatagcaacattgttataatagcttacaactagaagcagcccaaatgtttgtcagcattcatatgggtaggtaaatttacattattccacatagaatttttttcttttttcttttttttttttttgagacagggttttactcctgtcgtcaaggctggagtgcagtgatgcgatctccactcactgcaacctttgcctcccaggctcaagtgattctcctgccttagctacccaagtagctgagactacaggtgcacacactgtgcctggctaattttttgtatttttttgtagagacggggtttcacatgttgcccaggctggtcttgaactcctgggcttaagcaatctgcctgcctcggcctcccaaagtgctgagattagagacatgagccactgtgcccaaccctcttttctttttttttgagacaggatctcactctgtcacccagggtggagtgcagtggcacagtcacaggtaactgcagccttgatctcctgggctcaagcagtcctcctatcagttctccagaatagctaggtccacaggtgcaccaccacgcccaactaattttttcagttttttgtagagatggggtctcaccgtattgtctaggctggtctgtaactcctggcccaagtgatcctcccacctggacctcccaaagtgctgatgagattacaggcatgagacaccatacctggtctcatagtagaatattatccagctatgaaaaggagcagatttcagctccatgtataactaacaagcacaatgttgagccaaagaaatagaaaacatcactgtgataaactccatattgttacttccccttccactccgtattcttccaccacggaaattatgtatgcaattggaagggccaaagattgaaatcaaggttttttctatgatggcaggggccttattgtttttattgattgctgtatctccaatgcttaggactatgtctggcacatgataggcattgtggaaatgaatgaactttcaggtagcagaagtatcctcagaaaactctaaagatgctaggcagattctggctaggatgtaaaagaatatagaaaaccttcactgccataataacaccaagaaaaatccagatgatgtagaagtcacacttactctggcagtattggaattatttactgctgtataacaaattgcctcaaaacctagtagcctgcaacagctacttatttattatagtcttggattctgtaggtcataacttcagatggacttagtagggatggcttgtcttcacagtatctgtgatctcagctggaagaagggaagactggaggcaggagtcatctgaaggctcactctgatgtcagtggttggcttggctgttggctcagaccttagctggagctgttagctgaacacctacatttggcctatgtagcctgggcttcctcacaacgtggtggctaggttccaaggaggaacattccaagaaagaggaagagccatgctgaagctgtataaccttttatgacctatcctcagaagtcacagaacatcacttaggctgcatcctcttcatcaaggcactcacaaagtcccatccaggttcaagaggagatacagaggccgcctcttgctctagaagagcatatgtgactagaagtattgctgtgatcatctttggaaaatatctgtcataatgggaccattgaagagtggcagaaagccttgttgaactggtttccagagagtggagcccatcataggtgtgagcactgtggcacagcagctgctgggggcagatgccaggtctgggtttgagcaggtagtagagaggacttgccaaagactgagaaaatgtactggctggagaaggagctgttggcagtgatgggggcaagcaaaataaatgaccagtaattacatgaaaaggtgatcaagtagcattaaactaatgagggaaatgaaaatcaaaaccacaattagataagataccacttcacaccccctaggatggctatcatttaaaaagtaaaaaataaaaataaccagtgttagcaatgatacaaagaaattagaaccctcatacattgctgatgggaatgcaaaattgtgcagctactatagtttggtggtttctcaaaaagctaaatatagtacttctaccatatgacccagcaattctgctctggggtagaatacccaaaggaattgaaaaaaagggattcgaacaaatacttgtacatcaatgttcattgcagcattattcacagtagccaaaaggtggaaacaacccaagtgtcaaacagcagatgaatggataaacaaaatgtggtatatacattccatgggatatttttcagccataaaaaggagtgaagttcttggccgggtgcagtggctcacgcctgtaatcccagcactttgggaggctgaggcgggcggatcacgaggtcaggagatcgagaccatcctggctaacacagtgaaaccctgtctctattaaaaatacaaaaaattatccaggcgtggtggcgggtgcctgtagtcccagctactcgggaggctgaggcaggagaatggcatgaacccaggaggcagagcttgcagtgagccgagatcgcgccactgcactccagcctgggcgacagagcgagactccgtctcagaacaaaacaaaacaaaaacaaaaggaatgaagttctcggctgggcatggtggctcacacctttaatcccagcactttgggaggctgaggcaggcatatcatgagtcaagagatggagaccatcctggccaacatggtgacacaccgtctctactaaaaacaaaaattagctgggcatggtgaagctcgccggtagtcccagctacttgggaggctgaggcaggagaatcgcttgaacccaggaggcggaggttgcagtgagccgagatcacgccactgcactccagcctgggcgacagagtgagactccatctcaaaaaaataaataataaaaaggaatgaagttctcattcatgctacatatagataaactttgaaaaccatatgctaaggctgggcgcagtggcacacacacctgtgatcccagcactttgggaggctgggatgggcagattgcttgagctcaggagtttgagactagcctgggcaacatggcaaaattccatctctacaaaaaaaaagacccacaagttggctgggcgtggcagtgcatgcctgtagtcccaactactaaggaggctgaggtgggaggatcacttgagctcgggaggtcaaggctgctgcagtgagctatgttcctatcactgcactctggcctgggtgacaaagtgagaaccctgtctcagtcagtcaaatttatttatttatttagagacggagtcttgctctgtcgcccatgctggagtgcagtggcacagtctcagctcactgcaacctccgactcccaggttcaatcaattctcccacctcagcctctcaagtagtagctgggactacaggtgttcactgtcacacctggctactttttgtatttttagtagagttggagtttcaccatgttggccaggctggtctcgaactcctcaccttaggtgatctgcctgcctcggcctcccaaagtgctgggattacaggcgtgagccactacacctggcctcagtcagatataaaaattaaaaactcagattgggatctgaaagacttgtaagtgcaacaataatttattcagcatacatatcctccagctctcccccgctaatcctccccaactttgcaaagaaaaaggaactaaagcagcactaaaaagtagaaagaactcacagggtcttacattctcctgttttctggaactcttgtttgaaaggtgatacttcctcttgcctcccacctcagatacttacagaccaataacctaaaacctaagtggagactgttgggctaaccagaggtgagctcagtcttcttaaatctgtgactctgttccagatcaacccttagtgaaatctgaataattatttcctcactttaatcagacgaaatgggagctctcactctctaggaaaagcattaatgttcttcagtcaccactgttcttccataatacaaacatacagagcaaccaaaaaagagagtgacacccacaattaaatttttaaaatcagcaaaaaccaacctatagatgattcagatattggaactggagacagactttaactgtcatgttcatagggcttatgggaaaatagttgaaacagtggttgaataaggaatctcagcagagaaatggaagcttaaaaaaaccaatggaaaggccgggcacagtggctcacgcctgtaatgccagcactttgggaggccaaggcgggcggatcacgaggtcaggagttcaagaccagcctggccaacatagtgaaaccccatctctactaaaaatactaaaattagccggcatggtggcgcgcccctgtagtcccagctactcgggaggttgaggcaggagaaccacttgaacccaggaggcagaggttgtggtgagccgagatcacaccactgcactccagcctgggaaacagagcgagactccatctcaaaaaaaaaaacaaaaacgcaagtcgttatctgtatttgaagtttaaatctagtacgtgaaataaaaaacaaaataggcttaacagcagagtgaatactacaaaagaacagtgaactcgaagacgtatcaatagaaattatctaaaatgaaggtcagagagatggaaaaaaaatggatagagcatttctacgatctatgcaacaatatcaggcagtccaatatatgtgtaatcagagtcctagaagggtaggagacagaatgggtaggataaattcacaaaagaagtgcaaaacttatacaatgaatactataaaacattgttgaaattaatgacaacctaaataaatgaaaatacatcccatattcatggatcagaagactcaacattttgttaaaatggaatactcttagctagtaaattgtagaaccagtactgaaaccaaggtctgttcaaattaatttaatcattcatataggaattcatggtgagtaggacaggcaaaggtggctgtgttcatggagcctccattagatggagggagtcattctttaataaaacggtataatttcagatagtgttaagtactgtgaaataaagcatgatgtgataataattggggaagatggtttaggttagatggtcaggaaatgcctctctgaaaaagtctcataaatgtctctttttctttttacattttgttttcttgaattaggaccaaataaaggccacacattgagattgcttgctatgtctcttaagtctctttatgtataggttcctctttcatatctcgcttttgaatttttcctggtaattcagttgttgaacaaagctggtcatttgtcctgtggcgtttcccatgatctggtttctgactgcacagcttccaagtgaatgccatctgttgcgggaagtcagggaccccaaatggagggacctgctgaagccgtgacagaagaacataaattgtgaagatttcatggacatttattagttccccaaattaatacttttgtaatttcttacgcctgtctttactacaatctctgaacataaatcgtgaaaatgtcatggacgtttatcacttccctgatcagtactcttgtgatttcctatgcctgtctttactttaatctcttaatcccgtcatcttcataagctgaggatgtatgttgcctcaggaccctgtgatgattgcattatctgcacaaattgtggagcatgtgtgtttgaacaatatgaaatctgggcatccaaaaggaacaggatggctgcgattttcatggaacaagggagataaccattgggcctgactgcctgaggggctggacagaacagagtcatatttctcttcttacaaaaccgaataggagaaataacactgagttctttttctcagcaaggaacagccctgagaaagagaatgcattcctagggagaggtctctaaaatggccactctaggagtgtctgtcttacacggttgtagatgagggatgaaacaagccccagtctcctgtggcaccccaggcctcttaggattgggaaattcctgcctagtaaattttagtcagaccgattgtctgctctcaaaccctgtctcctgataagatgttatcactgataatgcatgcccagtgggacatgaaacttcatcagcaattctaatttcaccctggtcctgtgatctcgctctgccccatttgccttgtgatattttattgcccttgaagcatgtgatctctgtgacccacaccctattcatacaaccctccccttttgaaatccataataacttactggttttgtggctcagggggcatcacggaacctgccaacatgtgatgtctcccctggacacccagctttaaaatttctctcttttgtgttctttccctttatttctcagactggccgacacttagggaaaatagaacgtatgttgaaatatcgggggctggttccccgatagccatcctcagccctctgttacttcctctgcagtggtggttgggtctagaggcttgaggagagtcaagttaattgtttttggcaatattgtaagtctggatcttaaacacttactccttactccttacactatattaaggcattattgttaaaattttcggatataatggtcatgtagtgatggttttttttatagatttatacaggaaaattagtggatgaaatgatatgtctgagatttgctccactgtaataaaggatgagaagtacttgggggtaaagacaaaatctgacaggccatgagttgagcattgttgaatctggctgatgggtgtctggagggttcattatactcttctgtctgctttttgtagtttttagattttccataattttgtagtttttagattttccataattttatgttttaaagcctgttgttatttatctcaattaaaatgaatggaattctctctcacccatttatgaggatgcaataactatcaattcatgttgacttcagtaaaatatgttagtgatctacttcattttcatgggaagccattatttatcaaatcacttttttttttttttttgacggtgtttcgctcttgttgcccagactgaagttcaatggcactatactggctcactgcaacctctgcctcccgggttcaagcgattctcctgcctcagcctcccaggtagctgggattataggaatgcaccaccacgcccagctaattttgtatttttagtagagacagggtttctccatgttggtcaggctggtcttgagctcccgacctcaggtgatccacctgcctcggcctcccaaagtgctggcattatgggcatgagccgctgcacccagcctgtcaaatcacattttaaaaattaagctgaaccatttgaggtttctgagctttttcaggcaaaatgctcatatactggcaattttctgtgtttcagcctgatgcatggacgtcagctaagcagtcaaataccttccacatgcatgcattcattgttaggttttctaactttccatggcagtttactagttatcagggccaatgctgttaggactgaattggattcctagtttttaaaagctgtgactcaccattaaatggttgtagtgaattggtactgttgttgttgttgttgttgttgttgttgttgttgttgttgttgttaagaaatttaaagggggaaaaaaaaagagactaggaagtacattaagtatgttaccctaagacagaaattagcttgttgtatttgaggcacagaagatatgtgtgactgccctgagtgagggggaggatgataaaagatgatgtcagagcagtggaaaagggacagatcatgttgggccttctagaattggtagacaggagtgaaatgatgtgactgccattgcaagtagtgctccagctgctgtgtggacgtagactgtagtgggagcaaaagaccagctaagttgttgcatagtctgggcaaaaggttggggttaggtggctcagaccagagtagaaaggaggggataccctagggggtggggggcatttcagaagtggcccactggaggtttgatgagtagagattaagtgattacttagaaaatacttaggaatgtgcctagcacatacagagtgcttgatttttggttcattgtggttaaaacactgaacagcaaccattttttgagcatataagtctgtttcaggctctgttctaaagtgtgttacatttcttggctcacgtaattcactctccgctgtgttgagatgggtagtttattaccaccattttacaggagaggatccatagcaccgctctgctcttgcaagtttctatgcacagtggcccctttccaaagtccatcttattctgcattctcagccacggagagatgacacttaactaaggtgaatggcccctcaaatgtagcccagttgttctttaagaaccagcttccagagaagttaagtgtctgggacctgacacagcctcgagtcagcatttgcccctgtgctagcagcatcctctgagcatgagatttgcaaacttggacagaattcagctttggtcatcatttcaacaatgaagctaatttaagcttacttctgcagcactgggaaagtcattatgaaataaaagtgcacaaatggagagaaagacagtgaaaatcacttatcatccattgctaatgagttcagccaaacgctggaggaatcagaataagtggtgtccgtaatagcttgtaaatgttttcgaactttttatttggtggatctcttgtggggttggttttcctgaccctggcattgtgtcaaacagacactgcgggcagtgtagcagataaacattaaaagttcccacctaccataaatcatgttttcagagaactgtgaacatggaatagcttgagaacttctcatagataggaagtccctgtccagagtctagcttcttttgtggtggttagagcatttgtaccagaactaatcttgctttttccatttgtgccagctgtgagcacctcctgcccacggatgcagcctgccatttcacgatgacctctcatcctatcttgcttcctgacccttttgttttttagcaatcatcctcttccagtggtagcgtgtttgggtctggaaacactggaagagggggaggtttcttcagtggccttggaggaaaacccagtcaggatgcagccaacaaaaacccattcagctcggccagtgggggctttggatccacagctacctcaagtaagttgagaagacttttcccagtcccttggtcccctaatgccattgtcattcttagggtgttatcaaagcttcagtgacaaatataaaaagaaaaaaaaatctagaaggctcatttaaaatatcttccccaaagcagtgtgatctgttttgcttttttatttttggttttttaatgagatgtcctatataatcatgaaaagatatcagagctgagggagaggatctgtgtattgagctgctcccctcttctctcccaaggcccaaatcgctctgtttcttagtattggagtgacttgaagtgaatgcaagcagacaagcataaatgagcagcagcagagcaagccgaggatgctgggaggagagcatgcagactttcatttggatagtactctccaaattttccttaaaattcagctcctgtagggagatgtcacccaaaagttgaagcctttaatatttctcacctcttacatttttgttttattttcatctgaagctgtatctgccagtactttctttagctaattttttttttttttttttttttgagacagagtttcactcttgttgcccaggctggtgtgcaatggcgtgatctcagctcactacaacctccgcctcccaggttcaaatgattctcctgccttagcctcccaggtagctgggattacaggcacgtgctatcacgcctggctgatttttatatttttagtagagacagggtttcaccatgttgaccaggctggtctcaaacttctccgcccgcctcggcctcccaaagtgctgggattacaggtatgagccaccatgcccagccttctttagctaattttaaaaattcttttttttttttttttcttttttctttttgagacagagtcttgctctgtcaccaaggctggagtgcagtggcgtgatcttggctcactgcaagctccacttcccgggttcatgccattgtcctgcctcagcgtcctgaatagctgggattacaggtgcccgccaccaagcccggctaattttttatattttttttagtagagacggggtttcaccatgttagccaggaggtctcgatctcctgacctcatgatccgcctgccttggcctcccaaagtgctgggattacaggcgtgaaccaccacgcccaggcttttttttttttttttccttttttttgaaacggagtgttgctctgtcacccaggctggagtgcagtggtgcaatctcggctcactgcaacctcccaggttcaagcaattctcccagctcagcttcccgagtagctgggattacaggcacctgccaccaagcctggctagtttttgtatttttagtagagacggggttttaccatgttggccaggctggtctcgaacccctgacctcaggtgatccgcccacctcagcctcccaaagtgctgggattacaggcgtgagccaccgtgctcggccttaaaagttatttgttgacctgtgtattcatggttggaaatgaaagaaatctgtttgtgtagatctttatcctgctgctcaggcggaagctgagattagaagttgggagcctgtcctgtttgtctcagcttctctcatttaatgtgccctacatgaagtttctctcatctgttgtgctgtgtgagatctccatgaatcatgagctagtgttctgcagtcatgacagatgtttccttaatattaaggcctgtgcagttagcaaaactttctatcctgatttgcccttctaaactcctaaatcaaaaactagtcagttttttagttcagcctgggcaacacagcaagtccccatctcaaaaaccaaacaaacaaaaacctagttattttgatgtcactgtccactccactaatacataaggaaagattattgtcaagagacacataccttttaccttgtgaaattatgtaatcagaagtttttgttctttaggtttcagtctgccaggagggatttagaatcctggatcttagaaatcaagtctagtagttttcaaaaactgtttttgccaatgaactcttaagtagcatcctgataaggaaaacaaaagtaggttcatgctgaagcaggggtcaggaactccaaaacacacagctggctggcaccacaggaccgtgaggctccatagcacatactttgaaaacatcgtccttttatggctcttcattttccattgaggaaacaagcccagaattctgaggtcacagagccagaaagtcacagatatagaactcagctagactatatgtcacatgccagacacagaatctggcacagaatagacacttaataacatgctccactgcagttagaaatttgggtttatcccagagctaaggtatcatctgcgaggttgtgttactggccaattttgttaaaagttaaatgtgtcatatccctataaacattcgtttactcatctctaatgccatggctcttgactgtcaaggagttgccttctgtcagtggctggctgcagctggtttgcacggacacatgagagccagccaagcacatcttcccagttgttcattaggtgacatcgtttggggtaacctgaaatgagccattgtggagtatttatatcatggaaatcagaaaaccctacaaaccaggactccccagcctgtcaaacattactggctgattcttctaattctggtttaaagtaaacacataactattcttgataccagataacctgttagtcttcatcttctaaatgttggctgttaactataaaccaacaatttacatgtgtgcctaagggaagtttaagtgattttgaaggagtagaggaaacacttaacattgtattattttaaaaactatatgattttatttcaatagtttttggggtactaggtgtatgattcaatagtgaaagggacaggaattgttttaactctgagggccaccaagtacagaataaaaggaaggaacagtggagaaggaagagctgggagtcgtctggggaaaggcattgtcctcaccacagtactcaggatcgtttctgcagaatcatcagtgacagcttctttctccttaattgactctgcatcatttgatgctttgagcaccacttctttcctggactgtatgaactgattctcctggttccttctgcctttcaaacaattcctcctctgcttctcttcttatctctaccttctctccctcccctcaccaacccccgcactccccgccccattttgctatggggcattccccgtggtcatctgttcatcacaatcttcttctcccttccccctggctcttccattgtggtctgaaaatccatgccaaacccgagtcttaagactgcatttattttgccccttttcctactcaaacccttgggcaacttcccactgactataggataaagatgaaataaacttgaaactggaattcagggccctccttgagctggccccaaagtacctttctgactgtactcagttccccagcacattccttctggtttggtcagtttgtctgcttgcatccctccctcacttcctccaggttcacttggcaccctgcacccaccttctgagcctgtccttctttaaaagatgaatgcaaggctgtttctgtgtgcactgcacctttgcctgagggtcattcaggcccaccatgatcgctccctctctggaaatcctgcagcccttggatttcatcactacacaaaccatcaagcagaaggaaaccagcctttattaatcacctgctgtgtgccagaagctcaatgcacgtgagctaaccacttcttacaacagtgcttttagatgtggctgtccccatttcactgataggaaaatcaggtccaagaggagatgtatactgcagaagttgcacagctactaagtggcgtagccaggatttagtccagctgcgtttcccgagctctgattggccttgtttacagaacgtctcccaggtacgcctttttgggcaacatttatgcatggaaaagaccccattatagagagttatttgagcagtcccctttgtgacatttatgccccgggctgctttgccctgaaactgcccactttacccctgagaagtcgtgagaactataacaatgaccgcaaaagacaagctgagaacaccagtacttggagttggcatgttctgtatccagaagctcaaagcttgcaagaagggcttcttctctctgtcatccccatagaatctactaaagaaaacctgggaacccatggagacatctaaaattcaccaccactgtggattgttacccataaggacctgttgcctcctttagtattgtcctgaggacactgtgtagggccattcccagcacattctttctgtttagggtcctgaaagacatatttgtctcatcagaagatgaagaagccgtttgatgatgatcttgtgggtttacagggtccctctacaactgttctttaagaaaatatcttggaaagtatcctgggcaagagcttcctgagagaccctttcggagtatgcattgaattcttgttcaatgactttagacctgcaggatgatatggggcctggtctgatactctgtatcggatttaattgctatccagtttatattaagtataatttaattcagattgggtcaggccctgatgttggatgatgctagtgtttttgccaaataaaagaccaaagaagatccatgttttgccagcagggtggaagcccagagcagatgccagttttacctgtacttggcacccctaaagtgtcagtcacagatggctatgcaaagacaaacttgttttttttactggatagtttatttacaagtcaagaagaatcttctacagtgaaatattgttcggtccgccaagatattctcttatggtaatatgagaatatggtaacatattttcaaaaactagagactatgttattttggaaccattaggagaaaaccaagaaacacattgttgacattagaaacagagactcagtcattgttttatgctactttgtttcagagcagtttaaatcaatggtaaaatgtctcaacatgcagagctccttgagagactgtaaatgagagtgattacagctttaatggtgtcattcttgggatcttttaaaaatgaaaaggatttgattatctcctgctgacctgctcagtgtcttactagctgaagtgtgattgagatgtggaaggaagaggttgaaggaacagagaagggcagcagccttttccgagagtctacaacataccacactagtgccctgtgtgcatcatgttatcttcccagcatccctgcagagtcacaattgctgtcctgttctgtgtgtggggaaactgggacttaggatagttaagtccttgcccagggtgacacagctattaggtaatctcacccgggtctgactgcaaacttcactgcttgttccactatgatatgccataaagattttaaagtcaaagagttcttaaagagagaaaaagattaaaaagcccaaagacttctaaatgatctctgacttcccaccactgtcccaataacatcatttcacctcacatttcatatggttgcaccaagtttctccaagaggagattcaaccccagtcttgcccttgaatttgtttgctatttgaattttgcattgctagcactaacaaagtgcaaaaatctgttcttgaaataccaagtaaacggaatggctgagaagcctgttttcatctccattgtcaaatgtactgccattgaaggaatcagacgtaactttgggctagctcgataaggggaaggtcaaactgctcagaaggccattttgtgggactccgtcaagggatacattatcctgtggtaccgagttatgagggtgatacaaagggatttcttaaccacccagctgccagtacctgacatacctgacatgtgggtccttagccaggctctcaaattgtcagcagtggttttatagggcagtgaccatgatgtgatgggccaagtcatattgtattactggtgcctggaaatttgaggtgactgggtcccaaagtgaggccactcacttcctggattgtggattaagagcattgcatctggacgtattaaccatggtggctctcctattagagttggttggtagcagcatgagttgagagacctggggaggtgacaggttaatgggggggccacctcttccaacagctcgactttgaaaatgatgttaagtgctccccctcctccagtcctctcctttcactttgcttgtgaacacctgactggcttagggagagactggtccttcattacccacccagtgattacccagagcatatgctgtgcctcccatttatgccttgtgtctttgggcatccactccacttcaggatagcttctccctgccttgtgggcatatattcaataaaacacccatctagacgtggtaggaaacgtgagttattccttcccttcccaccaacgcccaccccccccaaaaaaagtttgaaaactctgacatatcctgtgctatattatctgagtgacagctgctgtgtatgtggactttgtctgtttatctattattatctgtcaggtttgcatttcttgtaacaggtgaaaaaaaattctcagccatcttggtttttagtagtttccttttttcctttaattcttggagtgaattcagtgcatagttgagagggggatgaccccctagataagtatctaaaaggtcaagggcttcattaaacctcttagaggaaatctgactggaagtcttgctagcctctttaacattcttcagaccatccctatatccccttggatcaaagacaggagcaccatgatttttctcatttcactgccattctctgagcagctcaggcagccataagcatgctgaacttgactataaaagcaggaggtaagtgctagaagccattatgcctgggttggatttgttctaactttaatttccctagtttgacaaaatttgaagttggtcttgtgtgaagagaccaatcaaagtaagccctgttttccagaagaaagcagcctgtggggcagagcccatggcctccattgctgggcagtcttgacacttgcaggagcacccagtgagcttctacaaaggagccttttcagtgggacctctcactgctcctttattttgtgcctataaaatcatgccaggaaatcctgagcctgggtgccagaatgattaaaaacttcccagcaaggtgcgtgaaaatcagagaaagtacctgttgctgtcactgtcgctccgctcccttggcttctaggcggcttgtcactcccatctttccaaacacccaactgagactttttctgtgttctgagaagcaggtaaggacatttgtctccctctgacctccctcacatcttcatctcttcagatacctctaacctatttggaaacagtggggccaagacatttggtggatttgccagctcgtcgtttggagagcagaaacccactggcactttcagctctggaggaggaagtgtggcatcccaaggctttgggttttcctctccaaacaaaacaggtactcctatgtctatttgttatggttatctttatatatgtatttgtttatgcatagatatctggaaggagacatctctagggtggttatcttaagagagtaggattggagtaaagaagttaactgtttcctccgcattatttttatatttactgagcatctgctacattcctaacatgattccaggtcttccaaaacatgtttaaaagcatagaatgcaagtaatgcaacatttttttttctttttttttttgtgagagggagtctcaatctgtcgccaggctggagtgcaatggtgcgatctcagctcacagcaacctccaactccctggttcaagcgattctcctgcctcagcctcccaagtagctgggattacaggcatgtgccaccatgcccagctaatttttgtatttttaggagagatgaggtttcaccatgttgggcagtctggtctccatctcttgaccttgtgatccgcccacctcggcctcccaaagtgctgggactacaggcatgagccaccgcgcccagctgtaatgcaactcttaagagaacacagattcttcttggggagaaaacattgtaaatatttgacagttgcagaacaaacaaaataaaggaacacataaggaaatgataactgaagtatctgcaggaaagcatcctgagtcatggatttgttggggttcccattatttgtgagggtcaaagcagattatctgtttaatttctaatgtgtatgttactttcccctctttcgcaaatcactttttttttatttttatttatttatttatttttttttttttttttttttttttgagacggagtctcgctctgtcgcccaggctggagtgcagtggcgcaatctcggctcactgcaagctctgcctcctgggttcacgccattctcctgcgtcagcctcccaagtagctgggactacaggcgcccgccaccacgcccggctaattttttgtatttttagtagagacggggtttcaccgtgttagccaggatggtctcaatctcctgacctcgtgatccgcccgcctcggcctcccaaagtgctgggattacaggcgtgagccaccatgcccagcccccaaatcactttatttttaattgaagtatatgtttatccacaatccacataagtacacagctgaattaattatcacagttggaatacacccatgtaaccaaggaaaaggaacattactaggactactttttatcccagcattactattaaagtatatatttatataaactatatgcctttttataatcatgtatgatgtatttataactacaaatttttaatgaacagtgtatgtttagatctgaaaacatgtacttcatttctgtcatctgcctctccaccctgtttctgtctctgagatctgcggagagtctgcactcctgtccttgttgatggaaagttgtgtgaaaagagttttttttaagacaggtggtccagggtgggctgtttgagcaagcagctttttaaagcaaactccccctgggtaagtgggcaggacacttggccctcgtatgcaggggatgctctgaaatatgctaattccagaggaaggatctaacctcaggactagatgcatcagtggctctgacctgggagtaaggctgccccaaattaatacatggagtctcatatttagagcctaaagtgctgtggtttccaaatccactgtgcaccttacctcagattgtgactcaggtagcttagtctttctttggttgctagttgttaatactgttttcctagaaattaaaacagaatattctgaaatgggcttcacagctttctttttgctacacacacagtgcattgtttaaaaatgaaagggccacaaggcttttatcccagttagaaaggtgcatcgtgaacatttcaactggggaattttagttcatcgatcatcaagactttttatgtttttaggaggctgataatgttttctttgactcttaacagttttcctatatatggttctttatcctgagattatatccccattgatttggaaatctgacctttgaaaattccacctgtaatcccagcagtttgggaggctgaggtgggaggatcacttgagcccaaaagttcaagaccaacctgggcaacatagtgagaccccatctctaaaagaaaaaaggaaaatcacacctaattcagacactgggtacagtggctcacgcctgtaatcccagcactttgggaggccaaggaagacagatcacttgagtccaggagtttgaaaccagcctggataacatggcaaaaacccgtctctacaaaaaaaaataatgcaaaaataagccaggcacgttggtgcacacctgtagtcccagctcctcgggagactgaggtgggaggatcaattgagcctgggaggcagagattgcagtgagccaagattatgccactgcacttcatcctgggcaacaaagcaagactctgtctcaaaaaaaagaaagaaaatctgacccttttatttgtctagtcttagagaaaatgtatgccccaacttttcatagtaagtacttatttgccccatgaaactaatacttagattgaggcctcgaatagagaacaactatctttcagatacataagatgagtgaactagtaaccataaacatcaaagtgagggcaggggaaaggccactccccctcatgtttcaggacttcatctctctgctgcagaactcgtattggttctgggagagctttttctattgaaagaggggactggaagtcccgagcagaaggaagggctgctgtgaatagaggaactgccttcctgtccaggcatcagggcactttttgctttaagagagattttaagttgatgatttggatgggtctttgaaaaattccaaaagtatctatcctcccttcagtaaaattgcattataaaattatcctgctggaggtcatccggggagaggacaggaggaaggtgggatggactgaagatggccttgctgcccaccatggtcagtggtctacaccctgctgtctcgctaaagtgttagatttggagggaggcaggcaggggatgaatgatggggaagatgagaggtgggcgtttgagtcgcacagaccttgttccagtcccagctctagcacccatcagctggctgaagttgggacaagtggcatattctctaagtctcagtttcctcccctgtgatgtaaggatcccaggcttattgggaagatttaagaaaactgctgtgaagcacctggcatatagtgggccctcaataaatcagaaagtttatcatcattgattattagaaaatttgtttcttctggagaagaaatttatgaaaatacggcaactgataaaatcaaacccctcctgccatcaggagagagttgcctctttaagccagagtgactgttttcttcctgtttaatttggctgtgacccaggtgtgttgtttgggggctttttctctctgtgtatatttaaccgccacccctcccctgtccagtttattttctgtatcatcatgacttcccatttttcactcaccttccaccaagaagtctaagcaatattgatacaaggtactagatagcgccctgcatgtctaggaagaaagtgtaactagatctgtgatcagtcttaaataattcaactgtaagggttttttagcactttttttttttccagtctgttatatttataacccaacagtctccattatcatggcttggaatttcactcagtgttttaacatgcggaatgttaacccaaacacgagccttagcaaaaaagtatcttctcagttgtgcagcctaccactgttaatggcaaataggcacatgagtgaatcacaaaataacagttaactgagggattcagctgacaacttttcatacccaggatttgatctttcctgattcagatggcagaagcttgtgttgtgattacataaacaataagaagtctggatttcatccctctaacaacagattgactttctgaaaggggagaaaaggcttgtcgctaggccaccattactcccgctagcacgcagttcataggccaacactcaccttaagaagtactccctttagagggtgctcccagttagagcacatttcttatgccattctattccattcattcaagaagacactcactgagtgtctattctaatactttagaatgatttcagcagtatcttggaagtttgggaacccgcatcaggaatagctcaggagaggatgttttgtcttcctgcctgacaggcatcaccagcaatcagagtagggtgccctgtgcgtgacctgacccttgtctgtgtggccacctgtgtggtgctgccctctggcagcctgagcccactgggcagcagtgttggcaacgttgcagaaggcatctgaactctagggctgtcctcactgttgacttattattttattagatttatgcagcagcctgcctccaaagaagaaatttggtgtgttttttcattgggaagtaattccagactgcaggaaaaaagcatttaaaaaaaaaaaaacaaacctccactgagcgagagaaagggagactctgatgagagacgtaggagccatcaggctgtaaataaataaaaagcacctggctgggcgccagcatacacgtctctgtctctgctatgacccaattcagggattctccctgagaggaggttttgagcctctgattttataatttgggtttctatgaagctggatgtcttgcctgtgtactgataagtaatatagtctgtcatcttttgtcagctaggtagggattggagtttttgagaatggtttttcactccaaacagctcagaggacctgggaggggtggaaggtgcaccgagtgggctcttggaggtctgctcacacggcttcacagtgacttcacagggtctgcaggagctctcctgagtggaccccagagccctctgctaggaatggaggggagtggtttggtttgagggcttttgttttgttgttttcattactattttcttgatagaagggcgggggggagggggggtgttgccctttactctagttcttgcatttgaattgctaacatcctcttttcccttttttcttcctattttgatttggtttctcattgctcaatgtcttctcttcctgtctcctcctttctttctccctatttctgtttgtttgcctctgttttgctcaggtggcttcggtgctgctccagtgtttggcagccctcctacttttgggggatcccctgggtttggaggggtgccagcattcggttcagccccagcctttacaagccctctgggctcgacgggaggcaaagtgttcggagagggcactgcagctgccagcgcaggaggattcgggtaagccccctggggagggcccttgggaacccacacgccagccaaaaagcactaggggcctgtactcttgctctgaaaagaaatttgaccatgaggtgaaggcccctcccttgaaatttgtgaacaactccctcaaggattcctgtacctctccagggtaagactcatttcgttcaagccaggctttgttgaattcatggtggacctcagctgtgttgctgttccctggtatgagaaatgctggtcatcagagcccctgttctcctgctggggctaaaggaaggcaccagccctgccttaactactgctttgtagccaagaggtgccccggtgtggagcttctgttaggaagtcctcaatgaatggttttcaccagattctttcctcttgggattattctgtgttagacccgttgtccttgaacaaacaactccctgtgtcccctgctcccctgcagccccccagagtgagtattcagttgcacaggtcctcccgtgggaagatcctggatgatcagggatttcgaagctgctctcattgcctcgtgtgcgtctgcactggaaaaggccatttttagggagtcgcttttaagggcagaatttcagtgtggttgccaaaaccccaagggaaaaaaaccttcaccacaccacaacatcccaatttaaaaaatgtacacgggatgactaccaagtctcttgttcaaaggaggtgtcgatgcctgaaaggagttctaaaacgcctcttgccgcagtactgggctcagcatgagctgaaggtttgggggaggggagatgattttgtctaggggaattgttgagatacttggatctgagtcttggcaagatgacagcatctttatcttgaaaataaactatagtatgttcttactcacacccttcccctccgtgcaagatgctggagcgcagcagcaggagtgagagggttggcgtgctgcttctcctgtttcacgggagactgatgccttaggtttgccctcaggaaaccccaagaattaaagttaaggaaagctttgaaaggacagttagagacccacttaggctggtattctcagaggtcttaatggatgctgttctctgcagtgatgaaccagcacacagtaccacagagttggtagaaggtttgggttggctgggtatcttgtgaattgatttatttatttgaaaccagctgttttctttactagtagaaaagtatattctgccttggggcggctctcacacaaatcccgattggctggttagtcagtcctaaaaaaggttaatgccaggtcagttattaaatctccataagagcccattaccttcttccaggtccctggccatgagcctgtctccgaccctgaagggcaggctgttgctgatgaggcccaaggcaggaggaggaagggagcaggccgctcctgggagaaagtccaatgagagcagatcccttggccacctttgtatggaaagagccttgacctcaccattaaaagtgaatagaatggtgggaaggcagagttttagatactttttcttgctttggggttgattcttgcccccaggtgctgccccttctcccagaaaccactgatccgtttccctcacctagtcacctccagaccccagaagctctccccaacccagccgagttcctctgcaaacaattcaaggggctctgataggtcacacagtgccaccttgtgtgctggaccatatctggagggagaactgagtgagggggcacaggggattgtctccaggtggggcgagcaggggaaggaaaatagtggccacttttacattggtttgggtagtaattattgattcaggaagcaaatacaaaatcctgaatgaaatgacttggaaaaagtaaatagaatcaagatcccaagaggagctgaagataaataaatgggagcaggatgtgggggaatggtcggtaagtgagaaatgctaaaatgatagaataaagcttaaggattgttggaggtagagcaggaactgtgtactgcatagttcccaaatgccctggtgttccaatgggggatggaaactaaaacactggccaggttggatttcatactgtagtcctgccatttttcttcctagagcagagataaaagttggccctgggcgatagctcattctctctgaaaggctgctagttaggcccagcctgtcaccctggatcatgagtgtcgtgtgtattgggacttacggcagggggctgaggcttgcagatgggcaagtggtgagaggccccactgacctcagtctgtttctcactggagcgcaggtttgggagcagcagcaacaccacatccttcggcacgctcgcgagtcagaatgcccccactttcggatcactgtcccaacagacttctggttttgggacccagagtagcggattctctggttttggatcaggcacaggaggtaagctgccacaagttctcccctcacaagcaaaatgggtccctcttgccttctcccccaaagaaatgagtatgttttacctgaccagtctgtttagtattttaaaagctgactgggcacgtggttcacgcctgtaatcccagcactttgggagaccaaggcaggaggatcacttgagcccaggagtttgagactagcctgggcaacatggcaagactccattctctacaaaaaatgttaaaattcgccagacatggtggcacacacctgtggtcccagctactcgggaggctgaagcaggaggatcacttgagcgctgcagtgagctgtgattgcaccactgcactccagcctgggtgacagaatgagaccctgtctcaaaataaataaatatgtaacatactgaaagtggttgaaacatatatatatatatatatttttgagacggagtctcgctctgttgcccaggatggagtgcagtggcacaatctcggctcactataaactccgcctcccgggttcacgccattctcctgcctcagcctttgagtagctgggtctacaggcgcccgccaccaggcccggctaattttttgtgtttttagtagagatggggtttcactgtgttagccaggatggtctccatctcctgacctcatgatccacccacctcggcctcccagagtgctgggattacagcacctggcatatatatttttttttaggttttagttagacttagaacactgtgtcatttcttaccaaagaaattactgtcttgatttcctctcaggatttgagaagcccaaaataataatggtcttactaggccttggtttaaaaaatctaagccagcagactcaaaaaaaaaaaaaaaggcatagaaacttcacaaaacatcttgcatttgtttaacactctgcttcttcagatggcagaatatgtgtcttccattttgttcttgcagtaaactgacaaggcacagaatttaggtatcattacaattgtacccgtgaagaaacagaaactccaaggaactaagtgttagcagttagcagtagaaccaggcctagaatccagccatcttgcttctctggcccccaaaaagaagaggaagcaaatggatggaaaaacaacaacagcaaaaaaaaaaaaaaaaaaaaaaggttttcctaatgaatggatctatgtggtccagtacagctgagaggccaagccagagaccctctgcctacagctggggccgaggagggaggaagaaccctaaaataccaagaagataactcataaaaagtaaaggattttttctgccttctgggggatctgagtagctccagaggacaaactcagaataaaggggcttctgtgtgtacctttcctgccttcctgtaggtggtggaggcacggagggcttcccacaagaagcacagaggagggcagacacttagcatggggaccacctttgtctttcgagtggatgcgtgctttaacttcactcttattctgcttttcagggttcagctttgggtcaaataactcgtaagtatccccctttttgagtctcaccttaattaaaagcattaaataaggttggaagtgtgtggatcttgctggatttgtgcattttcttttcgttttttcctgtttttagagtttgtcctggaagtgtgggggttcagcagcagggtttgggttttgtggacttgctcttctctgtagcaatatggcaggaggtgccaggcctcgccttcttaagaggcgtggttcaaagagaaaagagcacgcctgccagtgagctgggcctgagggcagcgctgaggagatgctgctcctgacttccctggaggtttctcagaagctgcatgctaacccctgggctctgggccatcaccaggtctcatgtgttgatccaccctctgtgcttctgtgtaaaatttcatggcgttaaaattcagtcttagccaggtgggtggttcacgcctataatcccagcactttgggaggctgaggtgggaggattgcttgagcccaggagtcaagaccagcctgggcaacagagtgagaccccatctctactaaaaattaaaaaaattagccgtgcatgctggcttatgcctgtggtcccagctactccagaagctgaggcgggaggatcacttgagcctgggaggttgaggctgcagtgagccaagatggtaccactaccgtctagcctgggtgacagccagaccctatatcaaaagaaaaaaaaatatatactggccaagcacggtggctcacacctgtaatcccagcactttggcaggccaaggtgggcagatatttgaggtcaggagttcgagaccagcctggccaacatggtgaaaccccatctctactaaaaatatatatatatacatatatagataaacacacaagaattagccaggcgtggtggtgcatgcctgtaatcccagccactgaggctgaggcaaaagaagcacttgagcccgagagacagaggttgcagtgagctgagatcacgccactgcactccagcctgggcaatagagtgagactctgtatcaaaaaaataataataaaaaatctgagtcctgacctttgcacacaggcagagcagcagagcctgtgactgctctgtgacagagcagctgactccaccactgtcctgtgcttccttgcaggtctgtccagggttttggtggctggcgaagctgagggcgtgtcagcaggcctttcgatccctgggaccaaccgcatcctcagcttcttccccgagaaatgctggagcaggctgttcagaccgacgttgccatcaaaacacatacacccagaaagaaacaacagaaaccaaaactcacaaggcgcatgattacttgttttatatttcatgttgggttttccctcccactattaaacagtctgtttccgtacagaacgtatgtgggttttttcagatcacagccaagaagattgccccgtttctgtggctctgagaagccagcagagcctccatcagccagaacactgtgtcttcaaggatggcatcagaagtcaccagcgtcgggtgttgataaacagcatcgaatgtgccgtggtctcacttggacctagcgccctccacatagggaagaggttgaatgctggtgggtcatctttttgaggctgaaacttggttatctcctctccttgttcttttagccattgtgtatcaggaccatccaaggacgcactctgcgattgagtggaggcagaggaagccactcatgccagcagcagttgagtttcagaagcagccatagcgcttttcagtacagtacaatagtagccagcgtgaggcaggacagtgctgcgccttagccggccttggctctcatctccatgtggctcttgggtgccatgtgtcctactccagagaggagggggccggtcacttgagaagacagcctttatattctgtatgtggcagtgacattggtagccacacctacccagtgtctactaaccacagtgcagatagcccttgggtagacccaggaagtgtgaagacagacactgctgttgccagacaacactagcagaacgatgctggatttgacaacagtgtttgctaggacggcccagagctcatcactgcagttttattagagtgcttctttatctttaatgcagtatctttgaggcctgtaacatcctagatagttgccatcaaacaaggaccgtctcgcattgaaaacagatgtaagaatttctctttcaggcccagaatctgacagtgctttggcttgggtcatgagcagcggggagttgggaagagatttttttttttagagttttacatattggcaggttgtatttttttaatgttttaataaaagtttgacatgacattaattcatcatgttgcagacagtgtgacctccttggttctgatggcttatgtggggacagtagaccatggtgaggtctccactgtgtcaccacctggtctgaaggtccccatctcgcctgtgccccagggtcacctgcagagttctttgtcaagtgcacattcccagcctccatcctggggactctggctccagaggactccgatagaggctggacgcccacctggctttgtgtttggtgatttcttaagctcacgagaagaggaatctcattgtatagcactgttgggtttcagaaatccctccctcaaccagatgccagcagagccaagagctggaattagatccgtggtgtctctggatgactgtcaccctgcgctctgtgcagttaggagagggaggggctgtctgtacggtccgttatctaggggctctgcctctcgcaaagagctggggtctccataaatttaatgtgtgctctttttggtccttgagaattgaagagcctgtcacctccaccctgtgttcacaggtgaagtggggggacagtccccatgacattcacaaccagtcacagggcatctttctcccacgtgggctcgtgctagtctagagacaaagggactcaagctctgacaggagaggctcgtggcggagggcttagctttaaagggagagatgtacctgaagctctgcaggctccgttctgcccttggctgtcatcctgccgactggcacccaggccgagccagtcttctcctacccttttgcttccccctggacactcctttttataaatagaaatggttcggcctaaacccttgacctcaaattctctgcgttgatcctccattgaggtggcatgtgacatctctccataaggcactatcagctgtgctcaggcagataacacccccactccctgtcaggcagcagccccggaggaatgtactactggcatgtgagcccctccaagttccttttttgggggtgattacagcggtagatggcaggggtcagctcagcctgcatcccctgacgcctgaact

SEQ ID NO: 15640 - DNA, 13985 bp, Human
aatataccaacctaacctgaccagcttagcaagtcattgatcttgagcacagcctagtcttcctctccagattaccaccttctcagtataatatgctaattctcatgtacatgcttttagacgtgtgaccagcatctctttccaccagatcaatccccagcctcccttccatatttgattgcaaactctcctccctaaaggatacaccctcacatgttttctccttaccagactgtaagcatctcttctgtagggatgctcacagcccctgcactaggtcctatttcacttattttttgagacggagtctcacactgtcactcgggctagagtgctatggtgtggtctctgctcactgcaacctccgcctcccaggttcaagcgattctcctgcctcagcctcctgagtagctgggattacaggcgcctgccaccatgcccagctaagtttttgtattttcagtagagacagggtttcgctatgttggccaggctagtctcaaatgcctgacctcgtgatccacccgcctcagcctcccaaagtgctgggattacatgcatgagccactgcgcccagccgaactaggccctatttctataggtgctaaaactaggctctgccagcaccttgtgcagcagttgctgcccaccttacctttgcaggaccctctctcatcttcttgatctgatccttatacttcactagctcagcatccaatcgagaaatcttcttgtcaatggattctgctctactgtccaccttaggggaaaatatcaaatgcactggtagttactgcaatacacttattccagaaggggcaggtagagaggaaggaatacagaggaagaaaagaggagcttaaggggaagggtgaaaaacagtggttcacaaagaagggtattcccaaccagaaaccctgggctttataaattattctcttaccccccgccacactgccccgattctgatataccaggtagccttcaagtgggttggggcagaaaataatttgagaatcactgagttgagttggaatttccctagaatcagagactagccaggctgagagttcctccaagaggcacatgaaatgggccagtgccaagtgaaaccagctgattgtagatctaatgccattccctaaatcggggatggtggcttaatctgaggggctagggttctgagttttgtgttactgagatccaggacgaaggcacagatatgttgacctaggatatcaagctgagtcctgatgtggactggggatgacagatggaagaagggtaagggatcaggcaggatgaggtgggaagggtgtatgggcctagggctgggtgaggtgagaggatcaaggcgagagcgagtggacgggcaatgggcatcaaaacgggttgggtgctggcagggcaaggcagtgatggggttaggggttccctggtttgtggcgttaggaatgacttgggtaacagggatgaaggggagaaggtgagatagagagggacgacgtgtaaggggcccaggacccgaaatgaagtggaagaatatgggcccggggctgggggtgggcggggtcgggtgtgtcagaggtcctgagcctacttatgcatgatcaaatgcccaccgtgccaatgcagtcagtcaggctgggcggcggagccttgggtttcgctttcccgaagagtcggttcatcttgagcagccgcgaagaaacccaaacactagagcaaaaccagaaacggaagcagagtcactcccgcctcgacttccggcccctccgtgcgcaagcgcaatatgcctcctggcgtttcccgattctttttccggattttcagccgggtcttccggggatggagagcaaaaggacttggtgctctcggagagagcctgcagggggcggggtgttggtagaaggagtgggaggggttttactgtagcaaggcggggcctcagttgagtgggtggggcctggaggcaactaacgcggcatagggcgagggcggggccggcaggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagtgagtgtcgggcgccaggtgggctccatgcaggtcccgaaagcccggcggggtctgtgggtttagtcacgtgtcctccagaagcgtgtgaccttgcgcttgtcctggcgtccggaagcgtgggttattggttgtgtccgtggaactgtcttttgtcccgggcttgtgtctgtacacttttccatgtggccggtgtattttgtctctggtcatttgtgcgatcctgggtgtttgagcttctccgtgctttacgtcgtgggcctggttgtgtttgtgtgcccgcgcagttattgtgccctttgtgtcaggcatatattgggccatgtggtctacgactgctccgtgtgtgataagtcagaacttcgtgcatgccggggtgctcctcgtgtgctgagtgccttctccgtgtgcgccgcttgagttggccgtgggtccaagcgttgtactctgggcaccctttgggtctgcctactgttggagttgacacaccaccaaatgaagtcagtacaccggagagctgagtccatgaggtttctctagaaccagctaggggaggcccaagggtctgggaatctggagacctggattctagatcctgcggttttgagtgaccttgggatggacggcttctttctaagaatccggtttctcctctgtgaagtagatttggtaaccctggctcctgctgacctcacggagctgttgggggaaccaaaccttggtgtaatgtactgtacacaggctccctccttgctgtccgcatccctggaaaagaattggcgtctcttcttcagaaagaaaggctctgctgttcgtatgcatttgtctgtttacttagcacaaatcatggatgcactcaagtgtgttcagtgggagagacttggaggaaaacagtcacttgcccattacagcaagcgagacgagaccaatacaatacagggtacagggcagtcaagccacaggaagcagatggcttgtgatgaaaaaggtgggcttgggaatcagctagatctgatatcaacttctgattccaacagttgagtctccataggcagtccttaacttgcctgaagtcacagtttgctcatctgtgaaataagaagtaataggtagatctacttcgtggggtttatctgaggattaaattagattatgcatgaaatgcttaaaatgttagcagatatcattcatattgttagttattataatagaggaaacagagatacttgaggaggtcaccagaggaaagctgggtggcatgggggcaggctctgtggagtaggtggcatatgagctgggccttgaaggctgggtaaataaatgtgataaagtgtcatcctatattggtgtatgtgaaagaatcatattcgtcaaatgcttttctttctccccaggcaatgagaagcacgaccttcatgttacctcccagcagggcagcagtgaaccagttgtccaagacctggcccaggttgttgaagaggtcataggggttccacagtcttttcagaaactcatatttaagggtaagcatttctttttctttctttctttttctttttttttttttgagacgaagtttcactcttgtcgcccaggctggagtgcaatggcacgatctaggctcactgcaacctccgcctcccggattcaagtgattctcctgcctcagcctctcaagtagctgggattacaggtgcataccaccatgcccggctaatttttgtatttttagtagagacagggtttcaccatgttggccaggctggtctcgaactcctgatctcaggtgatccacccgcctcggcctcccaaagtgctgggattacaggtgtgagccactgcacctggccaagggtaagcatttcttttccggcttttccttatggccaaaggacagttttaaaactgctgaacttttcctaatagtcactctgttttcaaactgggacaatttttatttatttgtttattcattcagttcttcaacagatatttattgaggacctgctaggtattggacactctcaaacacctggacaggtgtcagatttgaagtcttatgatgatggcagaaatctcaccattttcgatgaagctcatgggcagtcttccctcgctaggttagatcatcttcccattatatgttaccatggtactccctgctatttttgcatcacttctatgaaattactattaaataatcattttcttagttgcttaacatctgatttctctgttaaaataacagcctccgtgagggtggagatactgctgtgtttccagtgcctcccattgttctgactcaaaggaggttttgagcaaacttacctgaggcctggatgtggcgggctcagtggatgcatgatgctcatttctgccaggacccacaccctcctggcccctgccctctgtcttcccacccccctgagaatctatcattctggtatccactggggaaagacttaccccattgggtgtcagtcattataaagaatttagtaataggaggcatttttatttatatttcatagtgtaacatattgtctttaatttttaaaaatattttatttctgaattataaagacaatagaaattcatgtttcaaaatagaggaatgcatgaaaaagaaaatgttcccctggataaaacccctcataataacactgtgtcatcagcattcattgtggtattggggtttcctgcaaaaaatgagctttaatggctactgtagaccttaatgcctactgaagactttaaagtcttctgtagtgtggttcgttggtccctgattcctgaatatttggctctttccagtttctcactattatgaaaaggttgcactgaatattatcgtatagtagttactgtggagtcgcatgtccaattatttgtttaggataaatatctggaaatgaaattactgggtcatgacaccctctaaaaagataccagttctcattagtgaacacacttgtctatttcctgtatcctgctgaaatttattttcagtgttgtacaattattacaacttggcctacctttctcctctttttaggaaaatctctgaaggaaatggaaacaccgttgtcagcacttggaatacaagatggttgccgggtcatgttaattgggaaaaaggtaaattgctttttccatcagaaatcctcagaatcaaatgactgaagtcttttatacatgtttctgtttagaagaccaaactggggacccagattctgcattgataaaacacctctctaaacaaatacaatctttattggttttacaggattaccagttttgttgttctcataccctcctgctcctgttggttagaacttttgctctaggaattaggagcggttgtgctgccttaataatatgttttttgttttggtggtggaatcttggtctggttaaaatggtgcctgggacaggtctcattcacttggagtagaatttgcaagagtcttttgttaaaataaacttgtagatattaagaataatcactctgttccagttcaggagcctctctccctttaaccaaccttttaactaaaatctcccacaagggaaaaccttcgactggaaagaaaggttcagactaaagaactgaggggaaaaaaagacagatgaggtcagcaacccttaaggtgatgagagagggctgtggccagccctgcattgtgacacagcagaattatgagcatatgaagttcccttattgtgagttaggtggctgagtagagagagggcagataaacaaagtgaaggcaaaaaaaatctaatccagacttggaactgccaggagactggaactcaggacttgccacaaagagaagtgaataatttgggatagcataactaagcagaaagctgctagacctatctatcaattgtttacctgagagaagagggaaatattctaaatttcttgcttcagggtcagggagaatggtgatgggcaacaggcagaaccaaagagtcaagtttgaagaaactataggacttttacttggagctgacacagagcgtatggagcgaagtgtgaactcaaggaaggcaccatggcacatgcctattgtcccagcaagttgggagtctgagacaggaggatcacttgagtccaggggtttgaggctgcagtgagttatgatcatgcctgtaaacagccactgcactccaacctgggaaccgtagtgagaccctatctcaaaaaagaaaaaagtctgaacttaagtctaatctacctcttttggactgtgtgatctcatgttactttactacattaagcctcagtttcatcatctgtaaaacagcagtacttccctgatggagttgtggtaaggcttaaaaaataggtaaggtgcttaggatagtgtgtggcatgtaggaagtgttcaataaaagtattcatcgttgttaaccagcatcacattaaacaggagcgctcaattggaggctgccatttaggaattccatttaaaggaatggtagaattccacctttcttgccattctggactcctcacaagtgtttactgaaatgtgattaccctccaggcttcagtcttggttgttgatcagtatagggctgagactgaatctggcacttggattgtctccattctctgcacccaagctgtcagggccctcaccagaatgtttacctaacaccttctctctagtctggagtctttgtagatggaaaacttgatgtataaccctttgacttgatttccaagaagcaacagagttaaaactgttatttctaggtgagtggcttcatgcaggtgtggtcaggtatttttcctgacagaggctgctgttcttgttgattgctttttcttttttcttttttttttttgagacagtctcgctctgtcaccctggctggagtacaggtgcacgatctcagctcactacaaacctccacctcccaggttcaagctatactcctgcctcagcctcccgagtagctaggactacaggtgcacgccagcatgcctggctaatttttttgtttttttagtagagacagtgtttcaccatgttggccaggctggtcttgaactcctgacctcaaatgatctgcccatctcggcctcccaaagtgctgggattacaggcatgagccaccatgcccagcctgttctttttgactattggctttattttcttcttaaacattttagaacagtccacaggaagaggttgaactaaagaagttgaaacatttggagaagtctgtggagaagatagctgaccagctggaagagttgaataaagagcttactggaatccagcaggtaactctcttcatggaccttaactttctgccttctatcagagcttcctggatataacttgtggttatggggacatgttctgcagtcagactccctgggttcagatcctggattcaccctttctcttactgtgaacaagtttatctttgtctcaagttcctcatctgtaaaaatggaataatggtgacatttccctattaggattgttgggagaattaaataatgtagattgagcttgacacatactaagtgctttataagcatttattgtcatagttattgtcaaaccccagccagcatccatttatgctcacaggagagcacctgccttgctaggatcatgtattgtctgaaatagaacaagtagcttctctctgggctgttgtaatgtgtttggcaaggcaaataacattttgttggttcatagaaggtccaagttgaacatgatagtggggttgggggagtcatcctattcaattccttatattagagatggggtactaaaacccagtaaggattaggactagctcaagaccacttttatttatttttccctctcattttatagcattaattggggtgtgtttgtgttttggcttttttttttttttttttttttgatatggagtctcgctctgtcacccaggctggagtgcagtggtgcaatctcagtggctccctgtagcctctgcctgccaggttcaagtgattctgcctcagcctcccgagtagctgggattacaggtgccgcctgccaccacatctgtctgatttttttgtatttttaatagagatggggtttcaccatgttggccagactggtctcaaactcctgacctcaagtgatctgcccgcctcggcctcccaaagtgctgggattacaggcatgagccactgcgcccggcctatatgtttgtgttttaattacagaatacatggctgactgtacaaaagttttaagtacatgtataggcactaatatggaaaataaaaattacccatggggcaccaactcagagatgacgattaccaaagcctgaaatatatttttcatcttaaaaaaatttgatataatgttatttacactttataaactattcttttattggataaaaaattaaacattttcctgtgatggtatttttcaaagctcgcatgcatttcatcttgtataaatgtattatttacctagccaactctgtattgttcatttaatattatttttaccattatgtgtaatgcttctttgactgtccttggacgtaaatcttttttgaccattcctggtttttttggtagaataaattctttgagttggaattgctgggtgatgtttaaagctcttgctacgtgttgtgaaatctgtgtctgtagctcgtggctgtgataaacatcctcagagatccctgctatccaactcttgtcaccagctaactggtcattaggccaagctgtgtgagtgaaccattagacaatttgataaaaataagcactgctgccattctttagcatgcgtctgtgccacaagttagtgacacatgtacatatattccctttacctcacagtaaccatctagggtgtgggcatcataatcttcatttttaaaatgagggtactgaggcatgaataggctaaataatttgctcaagatcacaagttagtaaatggcagtcagttttcaggcgtaggctttgaagactctaaacctgtgcttttaacatctgcctcttcttgtgactgggggcttcactggagccaagcctcaggaggcatttgcagccacagtgggtcatgcgaggtagagcagactgcaacctgatagaattcttggactggcccacggccagcctttttaatttttccaagagttaaagttgtggatctgagatgtggcctggcctgccagggctatggtgggctcagtgtgattgcatcattagtattgtggcatggagtcttccgtcagcctcagagaacccttgcaataatgcattatttccccgcagggttttctgcccaaggatttgcaagctgaagctctctgcaaacttgataggagagtaaaagccacaatagagcagtttatgaagatcttggaggagattgacacactggtaagtaaatattcagctgagaagaactagttttctttgactttatttcagtcacattcactctttcagtaatttactctcctattgcctgagcaaacccatcacttgagaatattaagcatctactattgtgtgccagtcatgttgctaggtcctgggtgaatgcatgatgataagacagttcctgctttctaggcactcacagccctccagcataggacttttatcatttacacttatgtttgccagtagcatctgtaatcgtcatgaagctgggacccaaggagtccacgatctcatggtccaggaaacagaggatttaactttctctgatgaatatgtgactgataattctgcagggctcattacttatagatgattcagccagacccaggtcatgtgaggccattgaaaatcattaactcttttgcagatgatagtaatgatatctctagcctgatgcttcattcttgaaggtgaactgcactgtgtacttctgttggccagggtgggtgtaaagaagcagcagcaggcacttttcctgtcacaatgagcccatggtgtggccagggcagagtatccatacataggaaacaataaaagaacaaagtctgtgttacagatcagttcctatggcccagacattgagaacacagggagcttttatagggacaagagccatggaaaggccatacaggatacagacccagggaaagggttcctgaaaatggatatcacatttacattggtgacctgtgacctgttttgtgtactgtgggtgtttcttatgtgctctcatgtcattttcactgaggattatttgttacatgtttactatttactaacttgtattatcaacttactcttccatagatcctgccagaaaatttcaaagacagtagattgaaaaggaaaggcttggtaaaaaaggttcaggtgagttgtgtaatagtgcacgacaaggtgtaatatgttaatgtgtaggtatgtgtgtttatctgttcaaaatcaggtagtgtaggagcgtggtgtgtggtatgggcttgttttggttacatttatcagcaggaaccccaaacgtcagagaagagccacctgtgtccctgtaattatatttgaatttaaactatttagggagggaactcactggagagcaggtagggctgacacattacacaattccaggaggcagtattcatgcacacagtgcttcctgcgattgtgcagttgctgtgcagtggccctgaggcaaagctccctgcctttaccaccttttaggggattgctggcctagagcatggtcagaatgctggtcctatgctccctccctccccttaccttggaacccaggccagtggcccatctccattcatgcacaatctgttttgagtctcagccatgggttccccagaatgggtaagcaaggagccttgtgtgggcagtggtcggctacccctggatgggcccttactgccccgtgtgtattttctaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctccttctgtctctgtggttgtactgtccagcaatccaccttttctggagagggccacctctgcccaaattttcccagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcaggaatattgggaatggcctagaacaaggtgtttggcacataagtagaccacttatccctcattgtgacctaattccagagcatctggctgggttgttgggttctagactttgtcctcacctcccagtgaccctgactagccacaggccatgagataccagggggccgttccttggatggagcctgtggttgatgcaaggcttccttgtccccaagcaagtcttcagaaggttagaacccagtgttgactgagtctgtgcttgaaaccaggccagagccatggattaggaagggcaaagagaaggcaccagaatgagtaaagcaggcaggtggtgaagccaaccataaacttctcaggagtgacatgtgcttccttcaaaggcatttttgttaaccatatccttctgagttctatgtttccttcacagctgttctatccattttgtggactgtcccccacccccaccccatcattgtttttaaaaaattaaggcctggcgcagcagctcatgcctataatcccagcactttgggaggctgaggcgggcggatcacttgaggccaggagtttgagaccagcccaggcaacatagcaaaaccccattctgctttaaaaaaaaaaaaaaaaaaaaattagcttggcgtagtggcatgtgcctataatcccagctactggggaggctgaggcacaagaatcatttgaacctgggaggtagaggttgctgtgagccgagattacgcccctgcactccagcctgggtcacagagtgagactccatctcagaaaaaaaaaaaattgagtcaggtgcagtagctccttcctgtagtcccagctacttgggaggctgaggctagaggatcacttgagcccaggagtttgagtctagtctgggcaacatagcaagaccccatctctaaaatttaagtaagtaaaagtagataaataaaaagaaaaaaaaactgtttatgtgctcatcataaagtagaagagtggtttgctttttttttttttttttggattaatgaggaaatcattctgtggctctagtcataatttatgcttaataacattgatagtagccctttgcgctataactctacctaaagactcacatcatttggcagagagagagtcgttgaagtcccaggaattcaggactgggcaggttaagacctcagacaaggtagtagaggtagacttgtggacaaggctcgggtcccagcccaccgcaccccaactttaatcagagtggttcactattgatctatttttgtgtgatagctgtgtggcgtgggccacaacatttaatgagaagttactgtgcaccaaactgccgaacaccattctaaactattcatatatattagtcatttaattcttacataacttgagaggtagacagatatccttattttagagatgaggaaaccaagagaacttaggtcattagcgcaaggttgtagagtaagcggcaaagccaagacacaaagctgggtggtttggtttcagagccagtgcttttcccctctactgtactgcctctcaaccaacacagggttgcacaggcccattctctgatttttttcctcttgtcctctgcctctccctctagctcccacttcctctctgctctagttcattttctttagagcagcccgagtgatcatgaagtgcaaatcttgccatgtcagtcccctgcttagaaccctccaatggctcactttctctttaggcaaaagtctttaccccatgccttctcccatctcatctcaaccccctcatttgttggctgtctgctgtcagccactcttctttcaggtcctcagatgcactgcaccctctcctgcctgggggtctttgctcctgctactacctctgcttgaacagctcctcaccttccttcctccaaccctacccttgtataggtgacttttgttcatccttcagaattcaactcacatgtctcttgcatggagaaccctcacctactgtct

SEQ ID NO: 15641 - DNA, 10066 bp, Human
gtcactgcaacttccgcctcctgggttcaagtgattctcctgcctcagcctcccgaacagctgagattacaggcacccgccatcacgcccggctaatttttggtatttttagtagagacagggtttcaccatgttggtcagtgtggtcttgaactcctgacctcaggtgatctgcccgcctcggcctcccaaagtgctgggattataggcgtgagccaccacgcccagccgggggcccttatttctcatattcgtccctcaagggacaagtcctcagggtcattagcccacctggattaagtccctctggaaaatgatttctttgatctcctctggcaatgctgccatagaagctcagcctaagggcatgttgtttgctcccaggccaccagatgtttccttgttattaaaagcagcatagagggcaaggttgcacttcgggaggccgaggtgggaggatcgtttaaagccaggagtttgagactaacctgggcaacatagcaagacctcatttttacaacagatttttaaaaattagctgagtgtcatggtggcacatagtccctatagtcccatccattctggaggctgaggtgggaggatcacttgggcccaggagttcgaggctacagtgagctgtgattgcaccacagcctgggtgatggagcaagaccctactctttaaaaagagagagagggcaaggttgtcccatgatccccctcagatagggctgactcccccataattaagtttgcttaaagaggcagacttgctgggctcagtggctcacgcctgtaatcccagcactttgggaggctgaggcgggtggataacttgtggtcaggagttcgaaatcagcctggtcaacatggtgaatccccatctccactaaaaaaacaaaaattagctgggcatggtggtgtgcacctgtaatcccagctaatcgggaggctgaagcaggagaatcacttgaacctgggaggtggaggttgcagggagccgagatcacgccattgcactccacctaggcgacagagagagactccgtctaaaaaaaaaaaagagacagactcttccttggctgggggtaagtcagatgggagaggagagggttaaaaacagctgggactcagcctgctggcaaacatgtggcatgtggcatgtcggggcaactgcagctcagcctctggagccatgtgagcaatgcacgcaggtacacgtgtgacaagctaggtcacctagccatgttcaacaggcatgtgcacagccacgaggaatgcccagccgtacaattaggcacacaggacatccgccatgtgtagacacagctgtggacatagctggccaggacatgcgacacacgacgtgctcatagcacagggagaagggcccatgaagtctggttggaactcagcacgtgtgtctgtgtgcccacctgagtctggactgctgcccctctgacactagctgtccccttgaagggtcggtgccttatctgtcctgacagaagagacagtgttgcttctcacttggggctcgcagcctcctcctcctgcctcgaactgaggatctgttgggtccagtcatcctggagagatgcggccagtttctttctgacaggtctcctcctgcccgcaaggaagtggggtgatcacagggcgcaggtggtctctatgacagctgcatcctctccagccatggccctgaaccctgcctataatcccaccattggctctcagatctgcctaagcctctcagcccccttgacgtcccctcccttaagcgccctccgaaggccacccgtccctcaaagctcctcacactccatgcccgcagctccctccacccggcgtccgcaccagcctcccagccgaggtggggcgggggcgagggggcgcgcactcctcggcgctccgggactgcagggcggggctgcagggcgggcggggcccgtgtctccagcgctcctataaagggagccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtggtgagtggagggagccggggaagcccttctctctccagcccttgcactccccaaactctcacttccccgaaggggctgtgttttccaaggtagcctggacccacctccccagctctgacccccacgcttaaccgcggaggatcaagctgacttccaaagtcctcttccccacggttctaaccccctctctgacagctccgactcttgccagaatgacagctgttactccccagtgatagtgccgatcgtttaccctcccacaagtgactcagccaacaggctgggggcagcggtcacgcttgcagtctgggacagccagccacttcccctgcctcccacacccctccagattcccagaatcccagcccccagatgtaggggagggggcggaggcaaatgagccattattaggttatttgggtcctgggtgtctggcctctaatgaataattaagcctcaaaaagtccaaaggttgaagtgagtgaggacagtttgcacgagtgggggcagagggtgcaggccacatgggctgcgaacagcgaagtgggaagggaggcagattctgacggtagaagggtgggaggaagctaggcccaggcacagaggacgcgtgtctaaagttgctcacctggtgctcagcgactcccaggccctgtctgttatccagacagatgctgtcagcgtctgtgcagaagacgacaagcattctggttactccctggcctcttggttactctgtgggttctctgagtgagcatttccctgcctgagttactcctcagtcctagttactccttggtcacaccagtttcaccctggttttgttctgagtgactctgtttgcacttcttaggtctggcagacccaccagttatgttctatttcctgtcccagttactctgatttttcagccgctcatgtggttacacctgttttcctctgtgttcagttgctacattgcagtgagtgggttactccgttcctgccccagccctgggtagtacagaccagctggcccactgtggactaggaagcctaactaagggcaagtagggatccccaaatggttgaggatcaggatctatgggcagaggagggctgaaacccacttctggcttccaagaataggaagtggggaagccacagggggcattttatccacagcctcccataagattagtcgtcctatcagccagccctagcccctctctcctgtgccaagaaggcaataggaggtggcctttatcactctcctgcctcggagccctcactcctatcggagtcctgagtccagccacctgttttagagcagccaggctaggggaggatgatgtcttctattttcctagaggggcctcctcattccctcccaagtctcagttcactctctcacaaaggagccgttagtcctcccactgagccccaggatcatcaggcttatcccagaccacaaaagaagagtgttaaattttaggggaagggttgcagactcagatggatgtgaggtattggatatcagtgagaagcagaacttcaaggactgcatgaactggaggggcaggcctggggatccctttgtagtgggtgagtgcctgcctgcctacctgcgtgttgggagcctaggcctgcagtggcagaatcagggttggctttggggtgaggaaagcccctttctctgagatacctggtgtgagggcagggggcggtgctggccgagaactcagggcaggggttgggggaggaagaggaagattagccccaaggtggtggaactggctctgacagctcctccctccaaggcgtcctgggatggagccaggtctgagcctttggcaggcaaggagctgctgccagggcctcccaagcagggcagggcgcctcagaccctcacgtgcctgtctcccaccacccctcctcacacatacacctgcaatctctgatctttgctctcacctgcctgcacacctttgccccatgtcattgccgctggcttctccgttatctcttggtctttctgggatgataatcaaaatgcttaactatccagtacaacaggcactgacccgtcagaataaacaaggtctgtagcacaggtcctggaaactgcctgctctgtgggcataaaacctttagttatgggcaggtgggagaggagaccagggcaaggcattggagcagctttgagggacactcagggggctcagggcaacaatgctttacagctgctgcagaagtattttcaggcttgaacaaggggaacagacatagtacgttctttttcttttttaaatagagacaaagtctcactatgttgcccaggctgttctcaaactcctgggttcaagatcctcccatctcagcctccaaagtgctgggattacaggtgtgagccaccacagctggctccagtatgttctatatttgtagaacaccagggctcttagtctcttttagttcccccatttttggcagaaagtttagaaccgatctccccatttctacagccctgggtcccgggctggggatagtgagaggagccacacagatccctgtctgtaggacctccaaatctgagtggggaatctggacccctgagagcagagaggtcatgggtggagagaggagacgctgggacagggacaggtaaaggaaggggaggttgttgagggggacatggtgaaggctggggctctggcatcctggactcaggagaagtggattcaacctcacttctggtctcctccctatttatttatgccgcccattgccaccactaccaccaccacatgagcttttcttttcaactctttttttttttttttttgagatggagtcccgctctgtcgcccaggctgaagtgcagtggcgcaatcttggctcactgcaacatctgcctcccattttcaagtgattctcctgcctcagcctcccgagtagctgggattacaggcacctgccaccacgcctggctaatttttgtacttttagtagagatggggtttcactatgttggccaggctggtctcaaactcctgacctcaggtgatccacccacctcggcctaccaaagtgctgggattacagtgtgagccactgcaccgggcctacatgagcttttctttggggcagctgggggatgagtgagaggcttcccacctttatggtccaggcctgaagggctgtggagaaacttgtgctaaggtgaaagctgttcccctacacctacgcctgctgaaattcaaggaaaatcagtgaagatggttcagtcatcttctaggatcccagtcgcagaccctgcttccagccctttccatagggccctctcatattagagttgggacagtggggtgggaaggcatgtgtcctttttctggaaagtgcaattacagcagaaggggtttgggctgggttccaggaagcgcctctagtcctcccagtggtggcgagtgggcatgttgctggcttcaccccttccttctggagtgagagttgctggtcctcaccctccctgcctgttcttcttcctgacagatgtttggctgtggctccgtggcccaggttgtgctcagccggggcacccacggtggtttcctcaccatcaacctggcctttggctttgctgtcactctgggcatcctcatcgctggccaggtctctggtaaggccttaaccctgcccccagcccttggccctcaatagcattcccactaggtgtcctggcattcctaagggcaggtcacagctgtggcctctgctttggccccttgggaaaggagggtggagaagaaacttgacacttagaactttcgactctcaccttggaatcagagattatcagctgacctgttacatagaccaaccgccatcctgtgcaagaaacccctctctgcaccccttctcaggggaccctagcctgccgactgtggcaggctgcagctaataggtcccttgtcccctctgcccaggggcccacctgaaccctgccgtgacctttgccatgtgcttcctggctcgtgagccctggatcaagctgcccatctacaccctggcacagacgctgggagccttcttgggtgctggaatagtttttgggctgtattatggtaagcattccccaccctgtcctcctccactacccccgtccctctgttcaggacctgctggcaccaggccttttgatgacagacggctaggacctgcccaggccccgggctcatgactcactcattcacgcacagggtcaaggtagggggcacgaagggaaagaaacaagttgggcaataacagagtctcaggccctccaccccaccccacgccaccccctctgcctgctgcaatacagcagtattgctacttacccataactcatgggagggtggggagggcacacctgagagggaagtctgggctcaggcctctcccccgactcactgtgggtctaatctgtcaccagatgcaatctggcactttgccgacaaccagctttttgtttcgggccccaatggcacagccggcatctttgctacctacccctctggacacttggatatgatcaatggcttctttgaccaggtatgggctggggacgtgtgaggggaacgcagggaggggaccgagttgccttggtagctcatgggctggttgggggacaggactcctcgactgtagcagggtttctccaatctgtggggtaacccgcatcagaacatggtggcaagtacttacaaaacatgcggctctccagcgggttcttgtcacgcagacattctagcaccattgctttcaggagaagagcatgggcgggcgctgacaagagtttaagagctagagggaagacgggggatggaaggaggggtcagagaaagggagggagctgcagctcaccctgttctccccactccccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgtgagtacagcccccacccagctcaccccagcctgcctctcctctgccctgccccccatgtccctgactatgagtgtctgtccccccaggaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaacctccagttgtgcaaatatctttctgcttgctctgctgcttttctggggccagttaaggagcttccgcatgcccacactgacccagggtgcccggctgagtgtctgatctggtcaggttaccctgggggtcatacagagaggttagagagcctcttcaccaaggctctcagtttgaactcagtggtcccaaactttcccccaagtttccgtcctcatgggtacccccagcataatgaatggaatcttcttcccaatccctgtacccacacatcaccccagaaaggcttgagccctatgcagggaagatcttgctgcagagctacccaatggggagaactgctgcccaggaggtggtgagttccctgttcctggaggagacccatcagactgggaacctgtattgtcctccacaacctgcagctattcaggctccataacctccacccagaccttggccacagcccccctggcagcctccctgcctccaggcctgccccagtcagtccacaaagcaaccagagggatctcttcaaaacctctgctgaaagtgcccatctggagaccatccacaatgctccatctggcgttcaggacctccaggtagggtcaggagcctacccctcctctcacatggctccatccacctcagcctactttatgtgtttctgtgtttttgtgtcttcagactttgctccaaagtcccaactcacatctttgctcattaaagtcctcatgatctgctttaacgcctcttcctccgggaagccatccctgctctgcctcactcttccagcaacttctagtcagctgtcttaagtgccaagacccgcagttgcgttcacgctcatctccccttctgcttcatttcttcagtcatttcttcacttctacagaggcacctctgtgcccagtaaggcagggggttggaagactgactctggcgctctgacttgcccagaaaagcaacgggctcggcacacctgagaacaggaagcttttctcatttgcttcttccttaccataccctcctcaagtttcatcaagggaaacttcatgcaatacaagggaaggcatcccctacccaatccctcctctgagcgaaccccatgggagccagaggatccctgggtgtggcaggcgaattgtggtttttagaagctaagccagcttttgctctccagccttcacagatgagatcatggtccagagagggcgggtggcaaacacagggtcacacagccaagaatctgcctacggaggtgagggcaggagaaggcaataccattttaggtttctatcccttctttgtccccagctcccaagaggcgtgtctggaatgctggagggacctgagccagagggagtgtccccttcccaggccctggggggaggaagggcaaaccttgggaggggaatacggctgcagagggtcattccagccacaccagtcccacctgggctgccctcaccttgctgtcctccccagcatgccccatgtccttctgtcacccatttctctcaaatcctgctgctgaccctgaccagtcagcctagggggtgttggcagcacttttggtgctgccacctggcccagcaaggattctctagctgggtgaccttggggtagtc

SEQ ID NO: 15642 - DNA, 79634 bp, Human
actaacttccagctacttgaaatagtgaaataaaaatggtgcctctgatctttgccatggccagtttcctgatcaatgtgtcctgtttcccttcctcatgtctcttatgggtttttttcctgagggctttgcctgctgcctcatgtctagttgaacatatcctgtatatgagtacatgcagccttctctggattctctagttgcatcaactcattactgcttaacgagaaacactcttttcctatcctttactaggcttctctagacatctttactgatcttatttctgcccctctttccagtctcgctttttcaagcaagcgagaactacacaatacccactggtccaatttaaccattccaacctttaaattatcttatgtttccagaatacctctgccaccctctgcatttgtctaatccttttgtgattttgtgaggccctccatcccatcccctagaattctgcctatgtgaaagctttcaggacaaatcctgaattgggtgagaggttactctatgacctttatgatcattccatttttcactgtatgtttctatggtacccactgcccaagctctgttagtgtaagagcgcagtctctaatacacaaactgagttggaaccccgagtcttccttggaattcctctgtggccttgggcaagttcctactctctgtgcttcagttttctcatcaggaatgtaaggattaaatgagttaatacatgtaaagtgcttaggatagtgcctggcacataatacctaataaatgttaggccttattattaaacctgaaaccctcaggctctatactgcacccatcaatgctcaagcctgtgtgtttcagatcctctgtagtcctaacagcaatgatagagtaccattttaaccattttgtgtgtgttattaacttgctttactcttcactgcaactctttgatatagaggttgttactatcttcattacatgtaaggaaaatggggctaagtaactttcctgaagttaaaataagtgataagtgacttaaacccatgtcttccaggtcttaccaatttatagtatattctgtatgctacacatagttctgactttgctactaattttatgtccttaggcaaaccattttgtctttgtgcttcagggactgaattgactgtaccaagaagcatcttctgggggaacatgagtgggttgaaggggagtatgcttaattttttccactttgggattgtagaccagattatagaggttatgtatggaaaacccaaaatatattcctaggggaaagagatgaaaactaatacacttattaagtactatctatgaaatcatatttaaatttctcagtaaccgttgaaataagtattgtcatcctttaccatagacaaggaaactaaggctaaaagcaggcacgtgatatccctaagttcatacaataagttggacaggtggactttaacccattttggcttagtccaaagcctgtttacttgatattacacaatgctactttactgttttgaaagaagaccacatggaacctgatgattgatacccctgaactgttagctggccttaaatttttgtaataaaatgaatagatgtatacatagtactttatggcccaggtgagcatttttactcgacaacacttagctgtcattggctattggtgtttggtttttggacatggaataatgattgattagtcctccacaagcaccttgaacccatcaccttcactggaaacatagttcttacttaacagcatgttttatacaaagttctaaggaaagtaatttttagatttggcttggagtctatgagtttcatggatgaagtttaatctctttactggcatgtctattttttatgtcctaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggtaaacctacctagataggaaatattttgttgtctttttaatttaaatttttaaataagtcatatattcacataatttagaaagcagaaagtatggaaagttacactgtaaaaagtctcaatctttattcactgtctgcctaagttctaccaccactcgctgctccctgccccaataggtaaccacttagttttatgcatatcacaagcaaatacaaataagaattctttttcttttccaaatgaggaattttgtaagggttttcaaaaatgcaaatacgggtggtgtagatgtctggttacaagattttttttgagttgtgaaaacaagtggtgggtggtaacatctctgctgcctcttttggtttcatcctgcatcatctaatctgcctcatctggtctgcttagttgcagcagttcctaactggtcttatcatctcttaatttctctctttcagttcacctcttaaaccagcatcagagagcaatctttataaaacacatattttatttatttgtttttttgagaggagtctcactgttgcccaggctagagtgcagtggtgcgatcccagctcactgcaactcctcctgggttcagatgattctcctgcatcagcctcccgagtagctgggattacaggcgcccgccaccatgcttggctgatttttgtatttttagtagaaatggggtttcaccatgttggccaggctagtctcaaacttctgacctcgggtgatccgcctcggcttcccaaagtgctgagattacaggcgtgagccactgcgccctgcctaaaacacacattaaactgtgtcactcctctgcttaattccgtttactgcttctgccttactcaacagtcccatcttctgctgcctcaatatctaccacattttattccctggattctacacttttttgtctttgcatggtgttgcatgtggctccctctctttagaatttctgtcactcagttcgctgacgaagtcttactcatttttcaaaagctactttaggccaggcatggtggctcacacctgtaattcctgcacttggggaggctgaggtgagaggatcacttgaacacaggtgttcaagaccagcctgggcaacataaggagaccctgtcactacaaaagaattaaaataaaaaaattagccaggcatgttagcacatgcctgtagtcccagacactcaggaagctgaagtgagaggatcacttgagcccaggagatcgaggctgcagtgagctattgtactccagcctggataacagagcaagaccctgttttggggggggaaaaaagttactttagtcacatgtccagggaaccttttctcacctttatagatagcgttaatctcttacagccctcacgcttatgtctttctcttaaatttgcatgcttctattacagaacttacactggaaaccataatttatttatgcttcattgtcctccactagtctgtaagctccttaaaaacagacactgtatatttcttttctttttttgtgaccctgctgccccacacagctcttgaaacatagtaggtactcagttctgaccattaaaaagttcatccttatattgaactgaaagcttctttcctttccttcctatcctttggttcaagttttatcctccggagcagcatagtaactagtctgtcttctcacagctccccctctccttactgcaaatcagctttttgcagtattcgaagacatctatcattttgccctaagtgtatatttcatcaagctgaatagttttattctgctagctcttcctcctggaccttcactatcttaatccctctccagtttaatgtgagatacagcccaacccttgaagccaccatctacccagggcctgtttttacaccagcctatagttctagtttcttgctttatcaggattattcttggaacctcaatgtatatgtgaagcaaagcaatgttataccagagttgttactgaatccttaaggctggttaataattacctcttgctttatagtgaattatcacaatgtagtggcttatgataacacacatttactatgccactgtttctgtgggtcagatgaatgggtcctggttagctgggttctctgctcagtgtctccaaatttggctaggcatgtgatctcatctgaggctcagggttctctttcagtcactggttgttggtaggattcagttccttacagatgtaggactgaggttcctgttttcttgctggctgttggccaggggtgtctctctcagctcctagaggccacctgtgtttccctgccacatgactctgtacacaacatgatagtttgcttctttgaggcctgcgggaaagcagctgctgccacttcagatctctctgacttctgtttgattttcaactcttttaaaatggcttacttgattaagtcaggcccacccatactcaaggggaggagattatatagggtatgcataccagggaggtgggaatctggaagaccatcttagaattctatttaacaaatctcttggggccttaacattctcacattattcatatcatttttgagaacacttcattcatatttgttgcataaatactatataccaagcactgttctaggtacagggaatgctgatggaatttacattctggtagggaagacaggcagaaagcacttagatatttaatatgtcaggtggtgataaggactaaaaagaaatattaagaaggttaagaagacagagtgacaagagtgctattttacataggttgacctctttgataaggagacatttgaacagagacaagaatgaagtacagaaatgcaccatgtggctagcttgagaaagagcattctaggcagagggaggagcaaatttagatgtggggaggggtattataggcaatgaagataggggcaggaaaggtggtcagagaaatagcaagggctggatcatgtgagtcccttggatttggttctgagtaagatgagaggctgctggaaggtcctgggaagagggatgtcatgaacttacattctaaaataatcacttagggtctggatgtggtggctcacatctgtaatcccagcactttggaaggccaaggcagaaggattgcttaagcccaggagttcaagacctgcctggacaacttaatgagaccccatctctgcaaaaggcaaaaaaataaaaattagctggacgtggtggcacatgcctatagtcccagctactcaagaggttgaactaggaggatcgcttgagcccagtgggtcaaggctgcagtaagtagtggttgtgccactgcactctagcctgggtgacagaataagaacctgtctcaaaaaaaaaaatattattaagctgctgtgtggagaataggctctaagaaggcaacaggacaagttaggaggctattgcagttgttcaggtaggagatgatggagacttagactggagtaatagtgtggaaaaggtaacaattggatagattttggatgtatttggaaggaagattttatgcctgagcaacttaaaagaatggaattggcatttactgaagtgtcaaagcctagtagagaaaaaggtgtttgtctgtaaaatgtttcagtttggaataatttcagatttatagaaaagttgcaaagatagttcaaagaattcccatatatctttcacccaacttcctctaatgttaacgtcttacataaccagactgcctttgttaaaactaagaaattagcactggtataatcatattaactaaactacagatgttattcagatttcaccagtttttctgccaatgtcctttttctgtttgaggacccaatccaggataccacgttgcatttagtcatgtctcctgagtctcctaccatctctgacagtttcttcatctttcctttttggaaaagatgtttctgctcttgttttatttacttcttattcagggaagatttttgtttaatttggttaaatttctgtaatcccagtactttgggaaaccgagtcaagaggatcacctgagcccaggagttcaagaccatcctgggcaacagaggtagaccccatctctacaaaaactaacaaaaaaatcagccaggtatagtggcacacgcttgtggtcccagctactcaggatgctgaggtgggaggatcgcttgggcccaggagtttgaagatgcagtgagccacgatcatgccactgcactcgagcctaaactttggtgacgcctgtaactttcacagaaagaggttgtggaacagactaaatatcactcatttattcctttatccatgaatttaacaaatatttaatggagcacctagtatatgccagacactggaaatactacactcagcaaggtagacaaaactctcccttctcctgagctttcagtctcagggtgttctctatttcttttgacattaaactgaacaatcagaaagtaaatcttaggagagccaatattatggaatattacagtgtgcgcttttgagtcagatagtttgacaagtttgaattttgacttttaaatttctagttgtgtgaccttggataaatgatctaactacatgaagccagtttcttcatctgtaaaatggtacctatgttatagcattttttttttttttttttttttttttgagacggagtctcactctggagtgcagtggtgcaatctcggctcactgcaacctccgcccccgggttcaagagattctcctgcctcatcctccttggattactactgggattacagccacactccaccacgcccagctaatttttgtattcttagtagagatggggtttcaccatgttggccaggatggtcttgatctcccgacctcatgatctgcccgccttggcctcccaaagtgctggtattacaggtgtaagccaccgtgtccaacctgttacagcctttttgagaggactaaataataatatgtaatgtgcttgcaatgttgtatttaaggttaattttattcttttaacttatttagacctgaaagcaaataacaataatattatgaaataaatgcagtgctaaaagtatgtactcaaaaaagcatatacacacactcacactcagttttgagagtatctggctgtattgaaatctagaaagactttgctgcaattgtgtttgaggaaaaaaatctggaagtgggtgaaggtattcaggaatagatctgggaggattattctgatactacacactggtctgtgtcactggactttgagctcctggagccagggactgtaacaccaccatggggcttatggtaggcaccaagaatatctttgttaagtgaatgactaaagactttgagggcaacggctagagccatctcaccactcatgggttgttggaacctgcccagacttgggcttcttatagctgacactacagcttcacgagcctctttctaacctaaatccatggatctgatagatttagaggatcctggaaaatagaaaatgcaaagcaagatcctgtattgcccagtggatcctcaggctatgttacaaggggcatttggctactctgctgttttcctgggaatgtttccttaattgtgggaatccccacctgagtgtctccttcctaaatcctcttcctcagcaaattcctgcccctttttggcctcagtctgaatagccagctgccttacccagaatcagatatcccttaaaatctctgtgtttggattcttctcttgagtgacttgctgatccttggttgattaaagtgaggaatggttttttgtgtttgagttaatcttttttgttattttgttttttaaacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcaggtcaattaattctctcttctgagtagttattctcccctatttgatacgtttaagtattattaagcccagctttaaaaatacagtttaatttctcttaactactttttctgcagggagagtatgttaccttgatcatgtgtttcatatgaccagaattaagttatagatcttaaataaaccagctaaacaacaatattaaaatatattttaagatacgacaaaatcagtcactcttattgaaaatgatggcttttacttattattttttctttgacctactgattttatttcctgtggatacataaacagaagtgtgattgcaggatcatatggtaattctatttttaatttatcttcttccatttttggccaggcatgatggctcacgcctgtaatcccagcgctttgggaggccaaggcaggcggattacctgaagtcagaagttcaagattagcctggccaacatggcaaaactccatctctactaaagatataaaaattagccaggcgtggtggcgggcacctgtaatcccagctactcgggaggctgaggcacaagaattgcttgaatccaggaggtggagattgcagtgatctgagattgcaccactgccctccagcctgggtgacagagcaagaccctgtctcaaacaaacaaaaaaacatttttttttcatttttaaatttttactatgcatacgtaatagtttacatgtttatggggtacacatgatattttgatacaagcgtacaatgtgtaatgatcaaatcagggtaattggcatatggggattccaacacctcaaatatttatcatttctttgtgttaggagcatcccatttctactcttctagttattttgaaatatataataaattgttgttagccatagtgctactaaacactagatcttattccttctatctaactgtatttttttttttttttttttttgagacagagtcttactctgttacccaggctggagtccagtggtgtgatcatgtctcactgcagccttgaattcctggactcaaatgatcctcctgcctcagactcccaagcagctgagactacaggcacatgccaccacatccagctaattttttttttttttgagacggtctgctgtgttgcccagtcttgtcttgaactcccaggctcaagcaattctgcatcagcctcctaaaatgctgggattagacacatgagccaccatgcctagctagtggtttttttttgtttgtttttgttttttttttgagagggagtctcactctgttgcccaggctggagtgcagtggcacgatctcggctcactgcagcctccacctcccaggttcaagtgattcttctgcctcagcctcctgagtagctgggattacaggcgcgcaccaccacgcccagctaatttttgcatttttagtagagatgatgtttcatcatgttagccagggtggtctcaatctcctgaccttgtgatccacccacctctgcttcacaaagcgctgggattataggcatgagccaccacacctggcctttttttttttttttttttaatgaaccccatatttagtggaaaatgctgtattcaagctaagcagtcagtattgtgaatttgttccttaaatgtctgatatgcttaacattgaaattattaccactacttcaatattgtgtcttcctatagatttaaatttttttaattacatgtagcttttggaagaaaatttatttggcctactcccatttttcctgacagatggccagagtggttggaggtgccctgcctgtcagaatgtttctgcacatgttcctaatacctacacttgtttctgtggtaagtttgtttatatacactggagtctcttttactacatacattgtacctcagttcaggaaaggtggtctgcggggcatgttttagaagttactaatgagacttcaaagctctaggagtctataagactgtaattatgtggtccatcacacagctagagccacagcctttgtgctcctggcaagctgttctggagatggccaaccaggctcatgctgcttctgggctgtagtgcttgtctccttggtcttgagaccaggcctgaccatgtagcagagataggtgtggacgtgggcttcatctcacccccagcagttacagctttgatagtccagatttgagcagtatgagtaaataatagtgtttattttaatcctggaaataagtcattggtatttataatcagattttttataaaccagcattataaactctatcctggcatcttccctctttatggaatacttctttctgtttttgaatatctcagttcccccaagtattaggggaaaacttcttgtaacccagatgctcattcttgctgctagcccatttctgcatgttttttttcctttcctgccttttaatgactaacttccctctagttgttgatttttcagattttgtttctttgctgtctgtctccctccctgaagcattgcatttttgcttctgtcttgttgcctcactgaaaccgtattcagaaattaccaatgggccgggcttagtggctcacgcctgtaatcccagcactttgggaggccaaggtaggtggatcacctgagatcaggagttcgacaccagcctggccaacatggtgaaaccccgtctctactaaaataagttagctgggcatagtgttgcatgtctgtaatcccagctacttgggaggctgaggcaggagaatcgcttgaacctgggaggcagaggttgcaatgatccaagatcatgccattgcactccagcctgggcgacagagtgagactccatctcaaaaaaataaataaataaaataaaaacaaagaaatcaccaatgactcctttccagccatatctagggctgattttataagctcataatctttttggtagagtgatagcccttgacacctttgaccattcccttcttgaaataagtagctcttcctgtttgtttctgcatgctctccttatttttctaaccaatttgctcatatttctcctttcccattacttagctagcagctttcacaaagagtcaagtcatttaccatcaactctgaatcttctagatgcaataccttggtgaactctttgacttccccttcttttctttcaattcttaaccacagtatcatttaagatctgaccccaaacaccctcttacaaaggaagctttcctttgttattctctgtctcactttggcctctgttttatttggaattttccggtcttacatgttttattgacagaatctcagccttaatagatactaaattggtattagatgagggaataaatattcttgaatatactaccagaaaggcagcatgaaactggaagtaagagatcagtggaaatttgggcaaataggacaataccaatacttaataccttattttgaaggattacataaagtaccacaatggaattaaaaatcttgttaaagcctctactggcaaattagatgagagactctaaggcagtataagaatgtggagtgaaggtcaagatgatctgaaagtggtaaaatgatgtgagaatgcacataaaggccttatttgcagatgactttgccccacactgttcttccaggggaccattaatttaacatgtttttattgagaacttattaatgttcaaggcactgtgaagaaacagaggcgaataaaacggttaacttaccagagcttacagtctaagagttaaaacacaattagcctgatactctgctagaagtacaaagtactatgggagatctttggggtagttacgacttacagctggatgattaagagaagccttcttggaggaggtagaattgaactggcattgtaaactaggtaaaatctttgtaggcagaaagatatgttgaagggaatagcataggcagttcaaaatcaacagggtttagggtatattgggagaagagtgattcatccacttacagagcccaggatctatgatggtaggggagtgggagatgactggaaaggaagggctgaccctttgataccagtctcagatgttgggacttcatttggaaggctgtgggaagccactgagggcatcaacatgattctttatggagattagtttggtagcagtgagtagagtattttggagcctaaataatttgggacttataatccagatgaagagtagtacaagcctctaaggagtgtgatagaaaaatatggtgttaggttgattcctgacagtagtaggaatgggagtcacccaaagtttcatgcttttggaaatggtgataccaaggaaaagggcaggtcaaaagaagaaggtctggtggggacagtgactacagtttagaaatgttgagctggaggagtgagcagaacatacagtgaaatatgtccaacaggcaggtagcaatatttgaggaaagaccaggacttaaggatgagaatcacagctgagaggagtagttaagaccctagcggatgaaagggtacagagtgagaaaagggtgtaatgcagaacacttgcaggggaaagaaaagcaaaaaaccccaaaacatcatttggagtcagggacaaaaggtagagctcttgagagatgttagaggaaaaccagggcactgtattggagcaaaaaagcacagaggcagggaggcttttgtgatagtctggagatgaggttttggccagttagagaggcaggaacaggagagcgatgaggtgagagccactttgtaggaaaaattgacacaacttggtgattaagtagaaagaggtgtcagagatgactgtagtttttgagcgtgtgtgactctgacagagttgacgtcactgacagaaataggaaaccctgaaaagggaggagttatagagggaagatgtgaactttgactgtggataaagccagtttgaggtgactgtgaaaccccaagcaagaatgttcagcagacatttggacatatgggtctgaaactgaagattcagggcaagagagaaaatgtggatttggggatcaatggcctttaggtggattgcacctctcaacatgaataaaatttctgaaagagatagtatagagagaaaagcagaggccatggactggggatggctgcaatttagtgtgcaaattgcccaagtgaggatgaattcctcaagggcaaggaggaatcctgtgccttcgttttactcttccctgtctctgctgagtccatggaagatgtgccatgaagatttgcagtgacattgattataaaagtataaggtcttttatgccgactttatagttctggaataggtgagttcctgctactcgggatttatgtcctttccatttcttactgcctcccccctttccccacggtgctcttctcttattccctctctctgatccttccagcagcaattcgcatatcagttcagaagtccagttatagacgacttgtcttataggtatttatcttaaattaaacgtttccattagtcaagatagtattttcgtaagtaaaagtgactttttatttatctttcccaggtaatccaagatttaagatttatcatactcagtgaaactttttatgaatagcattatatttatctttttattttaagatatgggataatacatttgttgaaataataaaaaccacactaaagttgcatgctgcctagctatactttactgtttcattaaagttgagaatgtggttgaagtttgtaccattgactctctgatctgatatgttctaggcaaggtaaagaatcctgagtggagcagaaatgaaattccacatagctgtggtgaggtttgtagaaagaaacagcctggccaggactgcccacattcctgtaacctgtaagttggaatgctaattccgttgggattgctggtggacatgctttgctggtggctctaagtaaacatacctggttagcatgtaatggtttgggatgaagggtgatatgggacctcagtaaatggtctcaaatcaccctgtgccaggcactctacatcagttaacttgttgaatccttaccacagcccagtaatagatatttaccatctctgctttacagatgaggctcagaaaggccaagcctcttgcccagcatcacagtggcagggcgtggatggtggagctagggtttccaaagccagtgctgcttccattacattacactgcttgcttctaagaagaaatgtgactcatatgttttatcccgcattgatatccaggtccaagagaatgtatgggagaaccttctgtctggggaaagacaattgtttagggtcccggtcggacagtatttccaagatgtcaagatgtcaatctttttctttctttctttctttttttttttttttttttgagacagggtctcgctttgtcacccaggctggagtgtgagtgtggtggtgtgatcacagctcactgcaaccgccgcctcttgtgctcaagccatcctcccacctcatcctcctgagtagctgggactacaggcgtgtgccaccacgcctggctaatttttgtatgttttggtagaaatggggttttgccgtgttgcccaggttggtctcgaactcctgggctcaagcaatctgctctcctcagcctcccaacatgccaggattactggtgtgagccaccacacccagccataggatgtcagtcttttccctacaataaatagccagctgtagattatatccataagccagacacggtggctcatgcctataatcccaacacgttgggaagccaaggcaggaggattgcttgaggccaggagttctagaccagactaggcaacaaaatgagaccccgtctctacaaaaaaatttaaaattagccagctgtggtggcacacacctgtagtcccagctacttgggaggctgagcaaggaggatcatttgagtccaggagttcacggctgcagtgagctgtgattgcactattgcactccagcctgggcaacaaagcaagaccatgtctctaaaaataataaataaataaataagtagactgtatgcagtcagcttctaaataccaaaaaatgcacagtaatagaaaaacagttgatcagttacaaataaatttctacaggccttaacctcagacaaaggtttaaatcttaggttcaagttacttaaatagttatgtaaccttggacaagttattaatttatctaagcctgcatctgtaaaataataatgatagtaataataacacttatagggttctatgaaaattaaatgaattagtgcatctatgcggctcgatatagagtctttctggcaagtgatcaaaaaatgacaattcttacttttactacccaaatctaagagtaaaccagacatcagagtgttatcttggtatttctactgcttggaggagggataatattggaccagggccttgtgatcaaggcatggtggtggcgctggggaaatgtcagtgggggtagagctgttttaaactgggctagacagcatggcctgtgatctgctgggcagtcagatacctcattccctttgactgctcgcataggtccttccttaggaaggagttaagctattcttgccattagttgtcattttcagtaaattcagtaataagaagttaatcctggctgggcgcggtggctcatgcctgtaatcccagcactttgggaggccaaggcgggtggatcacgaggccaggagatcgagaccatcctggctaagacggtgcaaccctgtctctactaaaaatataaaaaattagccgggtgtggtggtgggcacctgtagtcccacctactggagaggctgatgcaggagaatggcgtgaacccgggaggcggaggttgcagtgagccgagatcatgccactgcactccagcctgggctacagagcaagactccgtctcagagaaaaaaaaaaaaacttaatcctctgcatggactatttttccaaacccttcatgactaccagagattaaaactgttgcagatcaagtgatcagcaccatgtctgaaagaaaagaacaccttaaaacctgctcctgctcttttgtggctctggagctttcacacttgacttgggaactttcttttactttcaggaccatagaagcccattccccagtagcacttttctggtctccaagaaagctttgctttctctcatttacacttgttaggactcaaaagtgacagagacagggtctcgctctgttgcccaggcttgagtgcagtggtgctatcgtagctcactgcacccttgaactcctgggctcaagcgatcctcccacctcagcctcccaaagtgctgagagtacaggcatgagccaccatgcctggtgtgaacatcaatatttttaaaagctctccaggcacttccaatatatagccagtgttgtggacctctggtctaaaagttaagaaaacctgagattgaggagattgagtccaggcttctgagatatttgacataacctagaatcacccacacctgacaagcaatgaaaattgtttcacccgaaaggattgaggtatatataaaatataactgttgaataatgatactcatctttaaagaaacatgcttaaacttatgtctcctatgggtattgtctatcaaaatgagtcatcttagaagactagacacttgttcctggattgttttcaatgtttaaactttatttaagaattatcagagcttgtttaggagtttcatagaaactaaacattccagccagaccactttataagcacactaatgttttacagcaaattctgttacccatctgattaattagtcttggctctgattggcttttgattcccaaagggttgtaatttgccacctagaatatacccctcctactccaaaaacagttgtcgtagaagttcccaaaatgttttaagtagtggtatttctgtaccactgtgtaatttgccaaagtgtctgctttgaagagggcagtatatatttgaatatacaaattccgtattgtaacttttttctattggtctctataatatagctcctaaaatagcatttttcagagggctaattctgacctatagcatatcactcagcccagttctttccatgacccccttccctttcattctctccatgttactcactagcatgcctcccctcatgtcagccttcttttcactgttccattgtttgcccagtgcctgattattacttcactagctgatagtatgtctgtacttcttacggaccaggtagatttgagttctattactttgcttagactctgatcttctacaggaccctattagccattctgccttttacctgagtagcaaactatttttatccccacacactgctgtaagtgggccaagactgtatttgaaaatgtcatctttgactctcagacccaaatataaccagtattttgacttgggatttacttctgtggttaaatagtctgtggtgataatgatgtcgattttttgcacataaaagtacagttgatatctttgttcaaatagtttaatcaactttaaacaaatacaaagacatgtcatagtagatgtatttgttgccatattcacaataagacccagctgggacagctttgttcgggtttggatacatggctgtggtttattcagtgaaacctttctctttcagtctctgccatccaggaccctgcccaccctgccctgcctttatgacaaaaacatgtgaatgtggacgaaccaggtaaagttaaaattacaccctaaagaagacctcagttttcacatgcatgattgacttgtgaatttctgaaataaaagaatagtaggtagatacaaataaatggtaggcatgaatagtactttttttttttcaggagtgaaagtttattaaaaagctttagaacaggaaggaaaggacagaaggaaagtacaacttggaagagagccaagtgggcaacttgagagaccaaatgtgccatggatagtacttttctgtaactagtagttccctgtgctgcccatgaccctattttgtaatcttataagtgattaagaagttatatgcacaatgagattgtgagactacccattatttcgggtaaaataccaaagtgacaaggatttttttttttttgagacggagtctcggtctgtcacccatgctggagtgcagtggtgcgatctcggctcactgcaacctctgctgcctgggttcaagcaattctcctgcctcagcctcccaagtagctgggattacaggcgcctgccaccgcacctggctagtttttgtatttttagtagagatgggatttcaccatcttggccaggctggtcttgaactattgacttcgtgatccacccgcctcggcctcccaaagtgttgggattacaggcatgagctaccgcgctcggtcggcaaggattttttttttaacctctctaagtgggtgacagaaccaggagttgaacccaggcctaaggaggctgggaccagtttcctgtgcctagcacagtatctggcatctaagagtcttttaatgaatattgttgaatgaaagaataggtgactccagagcccacccttgttccattataatacaaggtctcctacatcattagtacaaggattactgatagctgtggagtgtctctgaggcccagtaagatcttaaaatgatttttgaaccacaggatgagatgaatcatgcagattttcggtgaggtgcgtttgtttagcctttactgaacttatgtggacagccatgtggcctgagattacatgtaagtgttttgactcagaaaggtcagatcctggttctgtcacttactggttgttgattctgggcaagttgcttggtctcactgaacctcatttttcttataaagtagaaataatagtgtctacttcaaggggttactgttagccatggtgctaggcagaatggcagcataataggctagtgttagccattatgtcaagtactgcaagctgatcatttatgtacataacagtgacttttaaaaacaaaatatggagttgagatgagagtcagggatgaaataaaactcttcttgcaggagagtagactccaagtgcttaaccattaccctagaaagagacttgaagacaattgtctaaaagtactttttgcggctgggcgcagtggcccacgcctgtaatcccagcatttcgggaggccgaggtgggtggatcacttgaggttaagagttcgagaccaggtgggccaacatggtgaaaccccgtctctactaaaaatacaaaaattggctgggtgtggtgacacgtgcctgtagccccagctactggggaggttgaggtaggagaatcgcttgaaaccaggaggtggaggttgcagtgagccgagatggctccactgcactccagcctgggcaacagagcaagactctgtctcaaataaacaacaacaaaaaaggactttcttatatccttctctcagcaaaatcaggatgtttattagaacaaaactagaattagcttatttccctaccctgaagcaaagtcacatatagtatgttctaagtgctgggtctcaggataatgccattgtgctgttagtctgagtgtgtcagatctgggtacatgatagctgtcctcccgtctgtaaagtactgtggaagctccaggcagagctaggaccagaacccagatcttctaactcctcaccccagcattctttctccttacgcatgctgcttcatggaactcagagatgaaatcacataaagcaaatactcaggaatagccttcagttcctcaccactcagaaaataggaaagaaagacaggatggaaaagaaaaagaaaaaggaggagaaagaagaaagagtgggccgggcgtggtggctcaagcctgtaatcccaacactttgggagcctgaggcaggaggatcgcttaagcctaggagtttaagattagtctgggcaatatagtgagaccctgtctctatttaaaaaaaaaaacaaaaacaaaaacagaagaagaaaaagagtggagaaagggagagtaattgagaaaataagaattggaggagggagacataggaaaaagtgagggaaatgaagttagagaaaggcttagtgggttttgaggggagagttaggggccgcagtgttagtttggttgtccaacaggaacttttacactgatgctgtctttacatctattgtctttacaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccagggtaagtggtgggcacaccagctagcaatgcttgtgttcttttctggaaccttattaatgattgtcttgataaactttgattggtgtcagacttttagtcacaaagaccttgagtagagagaactggagatacgatgcttagacggtttttattattttacctgcataccagtataggtcattgtcctatataattttttttttctttttgagataagtctcactctgccgcccaggctggagtgcagtggcgtgatcctagctcactgcaacctccacctcccaagttcaagcaattctcctgtctcagcctcccgagtagctgggattacaggtgcctgctatcacgccttgctaatttttgtgtttttagtagagatagggtttcacaatgttggccaggctggtcttgaactcctgacctcaagtgataatgcctgcctgggcctcccaaagtgctgggattacaggcgtgagccacagtgcctggcctatctaatttaaatagtagattttaaaatgctgtttaaaagtaactgcttgaaaaggaccagattattatggacctagaaagaccaaaataatctttttaaaaatgaactggccgggcatagtggctcatgcctgtaatcccagcactttgagagggtgaggccggtggatcactcgaggtcagcagattgagaccagcctggccagcatggtgaaaccctgtctctactaaaaatacaaaaattaactgggcgtggtggtgggcgcctgtaatcccagctattcgggaggctgaatcaagagaatcacttgaacccgggaggcggaggttgcagtgagcagagatggtgccactgcactctagcctggatgacagaatgaggctcagtctaaaataataataataaaatgaacatatgtgaaatctaagaacatataaaactaatttttcataataaaaattagaaaatggttgcctagtggtggaaattgggggaagggacacaaattttctgggttgatagaaatgtttgatatcttgttttgggtggtggtcacacagatgtatacaattaccaaaagatatccgaaaccaatcaaaactgaatatgtaaaatatttgtgtttattatatgctagctgtacatcaatgggaaaaaaagtagaaagtatctacatgaatagaaaaaaattttttaattgtgaatataagtttatgtttttgatgttttcagtttttctcttcctctccattactgcaatctagaaatggaacagaagaatctaattttatagttggggcgtgttggcgggcgccggtaatcccaggtacttggaggctgaggcaggagaatcgcttgaacctgggaggcggaggttgcagtgagctaagatcgtgccattgcactccagcctgggcaacaagagcggaactctgtctcaaaaaaaaaaaaaaaaggaatctagttttattttctcttagtgcaatgcaattatcccctttttgctctccagagtgaatattgtcagttacccagtcgctgattaaacagcctgaaagctcactgtatttttaggtaggctgtttagtcatgatacaactctaatcgtcccagttttttcttttattgagccaaaatctgcttccctgaaatatactctctccttcgtctgcctttctctacattttatgttcctcctgggttgttcaaaatcagctgtcatatattctttccccagcgtttcctttcaggcctaacagctgtgattgcttcatttcttccctgtgaaacatgctcagagaccacacatcctcttaaaagtggctagattggcctgggcacggtagctcatgcactctgggaggccagggcaggtggatcacttgagcctaggagtttgagaccagcctgggcaacatggcgaaaaccagtctctaacaacaacaaaaaaaaaaaattagccagacatggtggcatgtatctgtagtcctagctacttgggaggctgaggtggaaggatggcttgagcccaggaggcggaggttgcagtgagctgagatcatgctaccgcactccagcctaggtgacagtacccacctctgtctcaaaaaaaaaaaaagtggccagattgttcacaacaatgccagtctttttgtgggatccacgaaaaccagtattgttcgaaactcggtgttctttgagtacattcttgagatttttcactgagacggaggactgattaaatgtgtcctgattattttccagactaaaatttctggtctgttctctgtggaatagaacttcaaggcttccatcacctattgtgaatcctgaccctgcctgtgggtgctccctccagttttatcccaggctgaaaatgggataatatgttccagcccctgtttttaatagtctcttcaagagaatgaagagttgcctgtgcccagtttgattatccattatgtcatatggatctgtaattaacaggaagtgcagaaaagctctctatcctggtacttaccaagccttttttttttttttggatctcgttctgtcatccaggccagagtgcagattctcctgcctcagcctcccaagtagctggcactacagatgcacaccaccatgcctggcttcagctgtttttagctcttgattcatattgggcttttactcagctaaatcacccaagtcttttttgtacaaatttctgtggatcccagtctcttcctccttgtttctgtttagttgatttttcaaacccagttttgaagactttttgtttttccacattagttatctagcagaatattttggccatgtaaatagtttatcttcttgaattataatcttctaggatccctttcagccttatctagagattaataagcattctttttgggtctttattcatatgttgataaaatactaaatgggttaaggctggcaacagggtcctttggttccttaatattatttaaccagctgtgactctacctaattcttctgtcacctgctcatatttctgtctctcgtgcctaggagagctttttagtatttactcagattttttcatcaggaactcaatttttttattgttacctgttctgacccttgattcttttgctcacagctttctattcattacctctgtaaaaagcctttgttctgtttgagcagaaacttagcaaagaaaagcctactagcaaaagcttccagtttccagggtttctttaccagttcattgattctacaaatatttattgtgttttctgaatctttattaatttatcaaatcagtctttattaaatgaacaaatgagttttagaacgggggaaaaaattgcatataggccgggtgtagtggctcacacctgtaatcccagcactttaggaggccaggatgggctgatcacttgagcccaggagtttgagaccagcttgggcaacatggcaaaaccccatctctacaaaaaatacaaaagctagccaggtgtagtggcacgcacctgtactcccagctacttgaggggctgaagtgagaacattgcttgagcccgggagtttgaggctgcagtgagctgtgttcacatgactgcactccagcctgggtgacaaagtgaggccctgtctccaaaaaaaaaaaaaaaaaaaagaaagaaaagaaaagaaattgcacatgcacttactggaagatgaaatgtgtattttaaaaataaagagtccttgaatcttaaattcagctaattaaaaaaaaaaaatcaaggcaggcacagtggctcacacctgtaatcccagcactttgggaggtcgaggccgcagtaagctgtgttcacaccactgtactccagctgggcaacaaagtgagatcctgtctttaaaaaaaaaaaaatctagagtcttgattatggccgggcgtggtggctcacgcctgtagtcccagccctttgggaagctgaggcaggtggatcacctgagctcaggagttcaagaccagcctggccaacgtggtgaaactccatctctcctaaaaatacagaaattagctgggcgtggtggcgggcccctataatcccagctacttgggaggctgaggcaagagaattgcatgaaccggggaggtggaggttgcagtgagccaagatcatgccattgcactccagcctgggcaagagtgagactctgtctcaaaaaaaaaaaaaaaaaaaaaaaaaaaatcttcattatagtgaaaccttttggttctgtttaatgtacgattttattttatgagtattatttttaataccttattagaaggtttctattttatttttattgtatatgtgattttaaaaatgtgatgtttttataatactgcatttattctgatcattagatcttatactctcatgccaatttttaaatttctttttggcaacggggacctttttacaagtgttttatgtaaaacctgacataaagtatgaaacctgtgcttcttgggttgaagtgaggatgggaaatccagatgtcaactcctccaccactactaccagcttagcttgtctatctcctgtaacatcaccagaggacccgcaggagcctcacagtgaatggtgttcagccacggccttatggaccagatagtgttctcttaatttagaggttgcttcactctgatgctgttcttggaatgtgctgcagaggcactatgagatattaatagtttaacaaggcttttttaatttcttcctatggtaaagctcttaggcgggtcttagagctgctgtatgaactatactcatttctgcataggtctgatcagtactctatttggcctcccagattacaggcatgagcgactgtgccaggcccgcattttgtattttcttatagattatttgtgacattttaagaacccatacatgttactaacgttttgtttttgaaattttctcttcaagtatgctattgcggcagcacctcccgagatgtgttatgtggaaccgatgtaggaaagtctgatggatttggggatttcagctgtttaaagatatgtggcaagtaaggttttacgttttcttcagttgaactaaagctgcactttatgcaacaattatgtaatagtgtgttttcttaacagggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttaggtaactagtaagcgtaaagttggctttaaaaatattattgtaaatggttggcagcagtgagtgtttaagcaatgtagaagtaagtgctagttacaatatcagaggtttctaaatattatgatcatatttatgtaggtacgttttctttcctcctcaacatatacttgtgaaaacccatacatttgcccaaatgatctctctgattcaggtattttattgttaactctggacaactgtggtgagttactgttccataggggttatgatttctcttaggagcctgtactgtaatgaacactatatgtatttataccaatccagggttcagcaagtgttgaaaacccttttcacataataggaacatgctaaaataattgtgggtgagacagagtctggtttggagacagagtctcgctctgtcgccccagctcgagtgcagtggtaggatctcagctcactgcagcctctgactcctgggctcaaatgattcttgtgtctcagcctcccaagtagctgggactacaggcgcacaccaccacgcccggctaatttttgtatttttaatagagacggggtttcaccatgttgaccaggctggtctcgaactcctggcaccaagtgatccacccgccttgggttcccaaagtgctgggattacaggtgtaagccactgtacctggccaaagaactaaaattgtaagtacaatagaacctcagccatttagatcattcaaggaatgtcagcctctgtagctaagtttcccatctagctgaggatacgaggatagcacctattgaacatcattttggatgaatatttttcttttcttttcttttcttttttttttttttgagacagagtctcgctctgttgcccaggctagagtgcagtggcgtgattttggctcactgcaacctctacctcctgggttcaagcaattctcctgccttggcctcccgagtagctgggattacaggcacctgcaatcatgcccagctaatttttttttgtatttttgtagagacggggtttcaccatgttggccaagctggtcttgaactcctgaccttgggtgatctgcccgccttggcctcccaaagtgctgggattataggtgtgagccaccatgcccggctggatgaatatttttctaaaatttacatttcatgtttaaacagagtttactgaaggtgttgtaatttttctctcattgacccagagtcatcatttttatgaactccagttactgtattacactgaatgcagtggtgcccttggcctgctgaggtttctcagactgatgccccataccaatgagcagtttgaattgttgtatctgcttgttgaagctttttgttgtttatattcttatcagtgcttttagtatgcttgcctgtctacttttagtaattccccctttcttctgatttgtggcttctgattacttgaatatagaaaccagaaaaagctcattggaattagatacaaagtaatactatactgagcctatctgactcagtcttttgggaatgtatgtctgcagttttgcaatgacttggcaacttctctcctgagtgggtgttgaaaggccatgcatttagaaaaaaatggaaagtaggcaactgagattgaataggaaaattatttctaaaactaaccatgtatcttgtgaggtaaagctagaatctttaggtttggtttccatttcatcaaaaggagagagttcacatttctttcaagtgccagcgtgaatcagtgggaacaccctacttaatcctttttctcaatctgaccttaaaattgtgtatagaggagaagtgctgtcttcttgtattttaatatacattccagctgcattaggaaagccagtcatctgttggttctctgcttgccatgaaaatgtgtttatgatatggagatcaaatgactagtaaatcaaatcccctttcggaaagcacatgagtcagttttataagaatttcacatataatgaccagaaatcctaccctggcactcatgtatcctgttggtgatgagagaagaaggaaatgtgaaatgggtaatgcaaagggacttgagcaagagaagggtagtaactggcagtaacagaccttgggatgggacaagaccaggttaagggataagagggtacctgctatacctcagcaggtatcatggaaaacctttaaggaaataggctgagttgactgagaagctcagagacaagcgtgtggctagcgataacaatgactgtcaggtttgttcagacctagcttatctatagaaagctcgcttaggtcttttgtatctcactcagtaggaaatttccatcccagagacacagcttcagtataagagactggatagagttctactttaaagatggtagcatgaagagctcccatagatctgcttcccagtaaagcaaacaaagctagggaaaactataaaaaagcaaccatcaaggctgggcatggtggctcatacctataatctcagcactttgggaggccaaggtgggagaactgcttgagtccaggactttgagaccagcctgggcaacatggcaagaccctgtatgtaccaaaaaacattttttatttacctgggtatggcggcacgtgcctgtggtcccagctacttgggaggctgaggcaaaaggatcatttgaccctgggatgttgaggctgcagtgagccatgaatgcagcactgcactccagctaggctgacagagtgagaccctgtctcaaaaaaaaaaaaaaaaatcaaccatttaaagtttctggaggctgggtgcagtggttcacatctgtaatcccccacactttgggatgctgaggtgggcagatcacttgaggtcaggagttcaggactagcctggccaacatgatgaaaccccgtctctactaaaaatacaaaaattagccaggcatggtggcacatgcctgcaatcccagctactcgggaggctgaggcaggggaattgcttgaacctggggggcagtagttgcagtgaactcagatcatgccactgcactccagcctaggtgacagagtgagactccatctcgaaaaaaaaaaaaaaaagtctctagaaattgccctaagagcatacctcaaatgaagacatatttattcaacaaaatcttctaaaactctggtaaacaacagcaagagtctgtggcattgagccctagctagttccttcctcctcccctcagctcagcttgacagatctccactcaggataagtgtggacaagaagatggggcttcttctcccctcagctcccagtcaggtttaccatatctcactgggaaggccacattgtcaacatttctctacccctccaactccaagttgaagaggctgaaattctggtgagtgcagctgagcagttagggctccctttctccaccaagctcccacttacagaatggaggcttcatcccatttgcagcagaatactggagccctaatcgtcctcaccccagctcactcgtagggcagaggttccactgagagaagcaagccaagaaggcaagaggctactatcccacccagcacccagagtagtgcctcagagacctttcccagggcgagagacagttcataacaaaagagagctccgaggtactctccaaaggaactgactttatttgaaacagtgtggggaagtacaggcctaaggacactttagaaaatgataacataccttaaagaacagtaactaaactgtaggccatctagttcatcagagagaatcagggaaaggtagctaagaggagccctcttcaggtcagaacaaatctcaaagacttacagcaaagactattccttcccaaatttaattggatcagactgctgagcaattgatgccctggaacattgtcaaaaacaatagaactgcaattaatggatccttgagactgagcgtaatccaaataaggcacacagtttaacagagagatcgggaatcaagacaaagagagccctgcttgaaacgactgtcattccagggtcagtttgtacccctaaggttgtgccatccaaagagtgacaccagcggctacatactgtagggaaaatagacttcactgaaatagtctagccaagtcacaaaacaaataaataagcaaccacaacaaaaacaagctgtggagaggggaagcagtatccagagttgctatatagctaaaatgtctagtttccaagaaaaagtatgaaatgtgcaaagaaacagggaaaaaaacaggcaacagaaactgccttgtgagagtgaccagatgtcagatttcacaaagactgtaggataatcataataaatatgttcaaagaactgggccaggcatggtggctcacgcctgtaatcccagcactttgggaggctgaggcaggaggatcacgaggtcaggagttcaagaccagcctggccgacatggtgaaaccccatctctactaaaaatacaaaaattagctgggcatgttggtatgcgcctgtggtcccagctgctccggcggctgaggcaggagaatcacttgaacccaggaggcagaggttgcagtgagccgcgattgcgccactgcactacagcctgggcaacagagcaagacttcatctcaaaaaaaaaaacaaacaaaaaaaaacaaataaataaatatcttcaaagaattgaagggaaaccatacttaaagaggtaaagaaagatgtgaagatgatgtcttatcaaatagagaatattgataaagagatagaaactagttttaaaagaggcccaaatggaaattctgaagtttaaaagtaggataaccgaaatgcaaaattcattaggctgggtaccgtggcttatgcctgaatctcagtgctttgagagatggaggcaggagaattgcttaagcccaggagttcaagaccagcctgagcacgtagtgagaccctatctctacaaaaaattttaaaaacttaggccaggcacagtggctcatgcctgtaatcccagcactttgggaggctgaggcaggcagatcacttgggatcaggagtttgagatcagcctggccaacatggtgaaatctcgtctctactaaaaatataaaaattagctgggtgtggcggcacacgcctgtaatcctggctatttggaaggctaaggcaggagaatcgcttgaacccagtaggcggaggttgcagtgagccgagatcgcaccactgtactccagcctggacgagggagtaagactccatctcaaaaaaaataataataattaaatttagctgggcatggtggcacacacctgtgatcccagctactcaggaggctgaggtgggaagattgcttgagtccaagaggttgaggttgcagcaagccatgatcatgccactgcgcttcaggtgggcaagaaagcaagaccctttctcaaaggaagaagaaaacttcattaaaggggctcaatagtagatttgagctggcagaagaaacgatcagtgaacatgaaaatagattgaaagagatttggtcaggcacagtggctcatgcctgtaatcccagcattttgggaggctgaggcaggcgaatcacgaggtcaggagatcgagaccatcctggctaacatggtgaaaccccgtctctactatatacaaaaaaaaaattagccaggtgtggtggcgggcacctgtagtcccagctactcgggaggctgaggcaggagaatggtgtgaacctgggaggcggaggttgcagtgagctgagattgtgccactgcactccagcctgggcaacagagtgagattccatctcaaaaaaaaaaaaaaagaaagagattatataacccaacggacagagagaaaatataatgaagagaaatgaacaaagcctcagaaatgtgggacacctttaactgtatcagtgtacatgtaattggaatatgaggaggagagtagaaagaagtggaaaaatatttaatgaaataatagataaaaactttcaaatgtattgaaaaacactacacatccaggaaactcagtaaactccaggtaggaaagagatccacatctagacatataataaaaatgctaaaagttaatgataaggagaaagtcttgaaagcagcaagagaaaaatgacttatcacatacaagggaacctctgtaagcttaacagtggacttctcatcagaaacaatggagaacacatcacaaccagaaggcagtaggatgacatattcaaagtgctgaaagaaaactggcaactggccgggcgcggtggctcacgcctgtaatcccagcactttgagaggccgaggcgggtggatcacgaggtcaggatattgagaccatcctggctaacacggtgaaaccctgtctctactaaaaaatacaaaaaattagccgggcatggtggcgggcacctgtagtcccagctactcgggatgctgaggcaggagaatggcatgaacccgggaggcgtagcttgcagtgagccgagattgcgccactgcactccagcctgggcaacagagagagactctgtctcaaaaaaagaaaaagaaaaaaagaaaactgtcaaccaagaatcttacatctcatgaaactaactttagaaaatgaagataaaaacaaaatttattgctagcaggcagacttgccttacagtaagtactaaaagaaattcttcaggctataagcaagtaaacccaaatagaatttcaaatccacatgaaaagacaaagagcactagtaaagatgattatgtaatcataaaaggcagtataaatgcatatttcttcttctcaactgatttaaaaaacaactgtataaaataatatgtataaaattatattttaggcctataacctgtagaagtatatttgataattatagcataaaggagatagatgggatcaaagttgtgttagaataagaaaatgataccagatcacaactcaaacctacaggaacaaatgagggaagccataagtggtaaattttgtataagaggggggctaggcgcagtgactcacacctgtaatcccagctctttgggaggccaaggtgggcagatcacttgatgtcaggagtttgagaccagcctgaccaacatggtgaaactccgtttctactaaaaatacaaaaattagtgtggtgtggtggcatatgcctgtgatcccagctactcaggaggctgaggcacaaaaattgtttgaattcaggaggcagaggctgcagtgagccaagatcatgccactgcacttcagcctgggcaacagagcaagcctctgtctttaaaaaaaaaaaaaaaaaaaaaaaagctgggcactgtagctctcacctgtaatcccagctactcaggaggctgaggtggaaggatcacttgaggctaggagttcaaggccagcctgggcaacgtagtgagatttaatccctcaaagaaatttgtaaaattacccagacatggtggtatgtgcctgtagtcccacctactcaagaggctaaagtgggggatcacttgaggccaagagttcaagactgcagtcagctatgatcatgccactgcattccagcctgagtgacaagagtgggaccctgtctccaaaaattaataaagctataaatatatatatttgttatctttttcagcttctttaatagatataacattatataaagttctaacaaagtagtattgggtttataacatatagatgtgatatgtataacaataactgcacaaaaggggagaagaatagagctgtgtaagggtaaaccttctgtatcttactggagttagtataaatctgaagtagattctgataagatgtatatggtaagccctagagggaccattaagaaaataactcaaaacatttagtgaaaaatataattaagggaattacactataaaaaatattgacaaaatgcaaatgaaaataggaaaggagtattagaataacaaaaaagacatgagacttacagaaaactaaaaaagacgaacataaatccagctataacagtaacattaaatgtgaatggattgagcaaaagcagatatttttgagttttgatttatttattttttatagaggtggaatctcactctatttcctgggctgatcccgaactcctaggctcaagcagtcctcccaccttggcttctcaaagtgctgggattacaggcatgagccactgcacccagccaaaagcagaaattttttagactggatttaaaaaacaagatccaactatatgctctcttgagatggagtcttgctctgttgcccaggctggagtgcagtggcatgatcttggctcactgcaacctccgcctcccaggttcaagcgattctcctgcctcagcctcctgagtcgctgggattacaggtgggcgccaccacgcctggctaatttttttgtatttttagtagagacagggtttcaccatgttggtcaggctggtctcaaactcctgacctcatgatctgcccacctcggtctcccaaagtgctgggattacaggcgtgagccaccgcaccaggccatggagacaatctttatagtcaaagatacaatgaggctgaaagttaaagaatagaaaaagtacaccatgtaaacagtagccataagagaccccaggtgatccccatagggtcctggaaacaggacttgtcctaaacctagtttagcagcatggatgcaggcaccaccagacattcacagagctctagtcagtcagactgtggatcatggcttctgattatttataatccccagatgactttcagagtcgacagcattccactaaagtcatccatggctacagttttagggagattcaagtctacactggagatgtggggcctgaggaaaaagaagatttattctgtgtttttgttatttgttttgaaacagggtcttgctctgtcacctagactggagttcagtggtgcgatcacagttcactgtagcctcaacgtcccatgctcaggagattttcccacctcagactcctgagtagctgggactgtaggcctgcatcaccactcctggctaatttcttgtttttgtgctttttttttttttggtagacacagggtttcaccatgttcccaggtgatctcgagctcctggggtcaagcgatcctcccacctcagcctctcaaagtgctggaattataggcatgagccaccacacttggcctttttttgacttaggcaaatcgtcgtatactttaaagcatattccagtgtctaagctgggccctgaagttgtcagaaaaggcccagtctgccagatgaagggaagatagggaagaagcattgactgcatacttccctcaactctgattctggagttgcagggcatggaggggaagaccagtgtggctagcaaatttgggagtatgaaaatgagtagttgcagttttcatttccagctcttttcgtttttattaaagatttcattcatacctgtgaaaagctctgccatgaaggagactgtggaccatgctctcgcacatcagttatttcctgcagatgctctttcagaacaaaggtaaatcctaaacaatgctagagttgttgccatcaatgttttctttaaaatggtgattatgggaggggaggaatcaaaataacctcagtagattaggtatgggaagtggttgtggcactcaaggtccagaggcctatagtgggataaggcaaatatacagatcactctaccaaatacaggtgtgatagtctgaaaaggggaacagtagcactgttgcaaggagtcagccaactaagaagttagaggaaacacagtccatatgaccacccacttgtggcaccaacttttgataccaattgaaagttcagtggtccctaagaccacctgcgaggcttgataatttgataaaaggactcaccgaacttgctggtggttacactcatggttagagctttactacaaggaggttacagttttattacaaggaaaaggatacagattaaatcagccaagggaagaagtatgtaggacagagtccaaaaaaataccaaaggtggaacttcatttgtcctttccctgtggagtcaggaaagtattactctctccgcttcagtgtgtgccagcatacatggaatattgccaaccaggaaagttcacccagacctgtgtgttcagtttttattggtgctctattgtgcaatcatagttgactgcccatgtggctaatctcagtctccagtctctcccgaggtgtaccgataccatgtgacccaaaacccctgccctaaaactatccagtgtggccagcctgctcctaaatcacgtaattggactatccagtgactcaagactccaggcaaacaatgacacttatatcaggcatggcattccactaggcttagagattacctctcagaagccaagcacaaaggccagactctctttaagtaaggtttaattcttcactgtacatctgttttgtcagtttctactttctggtgaaagcctggatggtttttatttttcttttttttttttaattttatttatttattttgagacagagtctcactccatcacccaggatggagtgcagaggcgcagtcttggctcactgcagcctccacctcccagattcaagtgattcttatgccttagcctctggagtagctggaattacaggtgcatgccatcacacccggctaatttttgtatttttagtagagacgggattttgccatgttggccaggctggtctcaaactcctgacctcaagtgatcctcctgcctcagcctcccaaagtgctgggattacaggtgtgcaccaccactcctggctaatttttgtatttttagtagaggtggggtttcaccatgttggccaggctggtcttgaactcctgacctcaggtaatctacccgcctcagcctcccaaaatgctgggattacagacgtgagccactgtgcccagcctaccttggatagttttcatcagactttatgttataaaaagtcttcgggtgattcagcttggggaacacactgagtgttgatttatcctgctctttgacctacttagtcattttagtgtatatcaacatttgtcccagtagagtacaagccagggtggagacagaattgtgaaccgttggttctgttaaacacaatgcagggtctggcagcatctgacttgcgaataattctgaggatatagtccataaatgggaagctagtttaataggaaaacttcagaaaaaagggaaaagtagtataatttacatgttacaaaagttgtgtaatcatatatgggttttttcctgaaagaaattacaatatacataggataacagaggcatttttgaatgtcaggtatgggaccacttttgtactttgtaaatactgtattaaagactgagatgctgtgatttggcaatcataaatttagtaatgcccagagatgctctttgtgatctgtgtgactgaaaattgtaagcagggttgggacatgtaagctggaagtggctgctgtcagttttcttcattctcccacaatccctctttctatctctacgttttcttgcttctcattgactctttgtcctcactccctctaatagtggactccatggcagtgagtgtattcttgaaaagctatgtgtaagttgaatttttgcaagtagaagtccttaaattgcaggaggagctcactgtcaatacaaactctgttaaacctgtttgacaaagtaaaaaaaaaactcttcaaaaagctgataattggctgggtgtggtggctcacgcctgtaatcccagcactttgggaggctgaggtgggcggatcatgaggtcaggagattgagaccatggtgaaaccccgtctctactaaaaatacaaaaaattagccaggcacggtggtgggcgcctgtagtcccagctactcgggaggctgaggcaggagaatggtgtgaacccaggaagtggagcttgcagtgaaccgagattgcaccactgcgctccagccagggcaacagagcaagactgtctcaaaaaaaaaataaaaaaaataagctgataattatcacctcattgtttaactagatttttcatgaatatggatttttcatgacatggttttggtaatggaatgggcttttccacagaagtgagttttctagataaataaaacatttcttaaaacttcaaaggttgttttcatttcatcactttggtgggattctgataaatgtatgctgtgtctatgtcttcataaagcatgctatatttaagtctttatggtaattcatgtgcaggaatttatgggagttctgcctttcctgacaattgtagataaccactcctgcatatcatttcttccatataatccagtgttcactgatgggagcattaactcagtttcatgagtcacttttgctttatatctgtagagagcatatagggaactttttcatatcatcaatcccagacacctcattttttatctgaaatgtatattttccagccaagaaccttttattgcttagacttcttcacatctgttatcaacttcagtagctgctttttttttttttttcaggataatttttacgaagaggggacttttaaagtcatttttctcatttctgagtacatggcaacctgtaaatgacatcaaagccaaaatcagatgtagaagccgggcagctagccagactcattctaccccaagtgactgacttccttcccacacaccatcatcactacacacgatttttaggatcatgccttagcaaaattacgtgatagaccttttagaccactcacatgtagtggaaaccaaactttagaggccaaaccaaagatcctgctttatttcactttgctgtagttttgtgatattatcaggtgtgctctgaagtgtgtagagccgtttgtccctgcattaaatggtacagattgtcatctgttttcaattcttatatctgctttttatggctttttctgtctgtacccttgtttggtgatgacttctctttcctttgcatgcctttagcagccctctttctatttagattttgtaattattagtctactgtgaatttggagaccagaccacaaaaattgttagaattgtattttcatgaaaagtctgtaagcctggagtcctcttgtgagtaaagctcattcatatagggattaggctcgctccagacatggcaagtgaagttggtgaataagtgactatcagagaagtatgggatatttgggatattcttgttacctatggcattatattatagttgtattattttagttattcctaaagtagttaccatttctttttctttttccataggagcttccatgtaccagtctcaaaagtgaaggtatgactggggtggggcatgagggaatttctggggtgaaagtgtcgtcactctgaatcttgttagggagttgggttatgtatttgtcaaaattcagtgaaggcatacttaagatttgtggtataactttcacctcaaaaggaaaaaaatataaattgaattctaattgatgaaatgctgaaaaatataagctaagtgcactcatgtctacagcttgctttgaaatgcattaaaaaagaaaattagtgggtaggtagaagaatggatatgtatatgaaaaaatatgttaatggtagaatctagatatgggcatatggatgttcactgtaaaatactttgaactttttttctttttccttttgagacggagtctcgctctgtttcgcaggccagagtgcagtggcgcgatctcggctcactgcaacctccacctcccaggttcaagtgattcccctgcctcagcctcccaagtagctgggattacaggtgtccaccactacacctggctgatttttgtatttttggtagagacggggtttcactgtgttggccaggctggtctctaactcctgacctcaagtgatccacccgcctcggcctcccaaagtgttgggattacaggcatgagtcaccacaccggcctcgattcctgtttttataaccgacacatactgttgttgaagccattttaaaacctttttggaaaagtgatggaagataaggatatgcaaaataaaaggtcttactgtagtcagaaagaaagctgtattggttaggaagcttctggatgcaggtaacaaaacccaagaaaaagtgacttttacgataagggtgtttactgccacacctgataggatatctggaggcagaacaagtccgagattggttaattttagctcagtgattttgaagacttcaatttggcttctctgtggttttcttgattttctcctcgtgggtatgttagctgctgcagcttcacacattgggtctctgcccaacaacatctaaacaaaatccatgaagagagtgttgttgttctcttcctatgtaagagcaaggaaaacagtcctgaaaggttctcagtacactgtgtccaattcttctgcctaaacctgtaactagcaaagtgaatggaattaccatggtgggtaaaggtacacaacatccacccctggaactgaggagcacactggctcccagtttctgaacaaaattaaggctgtctttgcctgaaagagaagagtggccgtttgggaggtacccagcaatatctgcctcaaaaccgtatttaaacttttggttcagtgtgccatctgtatcaaggaaaaaaagtttggttattaaaaacataatttgggtccaagcctggtggctcatgcctgtaatcccagcactttgggaggccaaggtgggcggatcacctgaggtcaggagttcaaggccagcctagccaacatggtgaaaccccatctctactaaaaatacaaaaattagccaagtacagtggcgcacccctgtaatcccagctactcaggaggctgaggcaggagaatcacttgaactcaggagacagaggttgcagtgaactgagatcacaccattgctctccagcctgggcgacagagtgagactccgtatcaaaaaagaaacaagaaaaacataatttgggccagatgcagtggctcacatctgtaatccttatgctttgggagaccagggctgggggatcacttaaagccaggagttcaagaccagcctgggcaacatagtgaggcactgtctttgcaaaagaatttttaaagttagccaggcatagtggcatgtgcccatagtcctagatactcgggaggctgaggcagaggattgcttgagtccaggagtttgaggttgcagtgagctgtgattgtgccattgcactctatcctggtgacagagcgagaccctatctctaaaacaataaaacaaaataataaaaacataatttgaaaaaatacaaaattaatacacttatgaagtttaaaaaaaaatatgaagtgaaagatgaaaatttgccctctaatagtagtttgttagttagggtttcagatctttttccctattcatacagatgtataaacatgccagcatagttttgtttttccctagatttaggcttatactaaagatactgtctgcagcttattttccctcactaatatctcaaagacgtatttccatgtcagtatgcataactcttgttcttgcagagtattccatatgtggatctgccttgtcatagttcaccatgacccttttggtggtcatttaggttgtctccagtttttccccattattaataagcaggaaccgtcctgtcccactttttataactttatgatgcaaaatttcaaccatacgtgaaagtggagaaactggtataatgaatccccacgtacctatgacctgtcatcatcagttgtcaacattttacctctcgttttcatccatccctccttccctacattttatttatgctgaagtactttgaaaacaaatctcaaatatcatttcacccataaatacttcagtggttagcccactttttttttagttgaaattcacataacataattaaccattttaaatgtacagttcagtggcacttagttctttcacaatctagttccaaaatattttctctgtcttacattttttcttcttctctattttatctttctttttcttttttttttttttttttttgagacggagttttgctcttgttgcccaggctggagtgcagtggcgcaatctcagcttactgcaacctccacctcctgggctcaagcaattctcctgtcttagcctcctgagtagctggaattacaggcacccaccaccatgcctggctaatttttttgtatttttagtagagacggggtttcaccatgttgcccaggctggtctcgaactcctggcctcatgtaatccgcctgcctcagcctcccaaagtgctgggattacagtcatgagccaccgtgcccaacctttttttaaattttattttaaaaatatgttgagacagggtctcactttgttgaccaggctggtcttgaatgcttggtctcaagtgatcctcccatgttggcctcccaaagtgctggggaaaaacattttcgtcaccctgaaaggaagccctgtattaattaagcatttactccccactcagtcctcccccaggtaaccactgatctgctttctatctgtatggatttactattttcgaatacttcatctaaatggagtcacaatatatattcttttgtgccctgcttctttcacttagcatgttttctaagtttatcatactgtagtatatatcagcacttcattcctttttatgattgaataataattcattttatgaatatacattttatccattcactggttgatggatattagaattgtttctactttttggctattgtgaatagtgctgttatgaacatttgtatacaagtttttgttccaatacctattttcatttctttggggtatatacctaggagtagaattgctggatccaatggtaatcttgtgtttaatttttttgaaaaactgccattctgttttccacagtggctacaccattttatattcctaccatcagtgtatgagggtttcattttctccacatccttgccaatacttgttattttctgggtttttttggtttttgtttttttgagatggagtcccactctgttgcccaggctggagtgctgtggcgctatctcagctcactgcaaactccacctcccaggttcgagtgattcacctgcctcagcctcccgagtagctgggattacaggtgcccgccaccgcgcccggctaatttttgtatttttagtagagatggggttttaccatgttggtcaggctggtctcgaactcctgacctcgtgatccgcctgcctcagcctctcaaagtgctgggattacaggcgtgagccaccgcaccgaccatttttggggctttttaaatcatagccatcctagtgaagtgatatatcactaccacatgatgtgatgtctctgatatctcaatgttaggttttaaaatctatttattgtttaagacagggtctctgtcaccttgactggagtgcagtggcagaccacagctcactgcagccttgatctcctgggctccagtggtcctcccacacgagcctcccaaatagctgggaccacaggcatgtgccaccatgccctttgcttaattaacttttaattaagttttaaaaacttaatttttaaaagtttttccagggctgggcgcagtagctcacgcctgtaatcccagcactttgggaggccaaggcaggcggatcacttgaggtcaggagttcaagactagcctggccaacaaggtgaaaccccgtctctactaaaaatacaaaaaattagccggcatggtggcaggcacctgtaatcccagctactcgggaggctgaggcaagagaatcgcttgaacccaggaggcggaggttgcagtgagcaaatttttgtagagacagggtctcattatgttggccaggctggtctcaaattcctgggctcgagcaatcctcctgccctagccacacttaaattttcgatagaaacacactcagccagccttccatatccatgggttccatatccatggattcaaccaaccacagattgaaaatattcaaagaaacaaattacatctgtactgaacatgtacaaaattttttctcatcattttctaatagcatttacattatatttggtgttataagtaatctagagaagatttgaagtataagggagggtgtgcataggttatatgcaaatattataccattttgtataagagacttcaatatctgtggattttgatatccaagggaggtcctggaatcagtcccccatggactccaaaagtttgtacacccatctactaagatgagcatggcttctcctccacaccttaaacactaccgttgctattttttttattttttgagttttaaaggtgaaaattgatattttaatatgcattttcagctgggcagagtggcttacacctgtaatcccaacatttggaaggccaagatgggaggctcatttgagtgcaggaattcgaggttacagtgagctatgttaatgctactgcactccagcctgggtgacagaaagagaccctgtctctttaaaacaaaacaaaacaaaacaaaacaaaaactgatggccgggcatggtggttcacacctgtaatcccagcactttgggaggtcaaagcaggtgaatcacctgaggtcaggtgttcaagaccagcctggccaacatggcgaaaccctgtctctactaaaaatacaaaaattagccgggcgtggtggcgcacacctgtaatcccagctactcgggaggctgaggcaggagaatcgcttgaacctgggaggtggaggttgcagtgagccaagattgcgccattgcactccagcctgggcagcagagtgagaccctgtctcagaaaaaaaaaaagaaagcaaaaaggccaggcgtgttggctcacacctgtaatctcagcactttgggaggccatgggaggtggatcacctgagatcaggagttaaagaccagtttggacaacatggtgaaaccctgcctctactaaaaatacaaaaattagctgggtgtggtggcaggcacctgtaagcccagctacttgggaggctgaggcatgagaatcacttgaacctgagaggtggatgttgcagtgagccgagatcacaccactgcactccagcctgggcgacagagaaagactccatctcaaaaaacaaaacaaaacaaaaaaaactgcatttacattattacaattgtattattactattgtattctttgagcctatagttactcaaatatttgttgtatgaatgttcatatcctttgtctggttttttttttctttttaatttgccacagcagatgctacatttatgtgtgacaagcggtgtaacaagaaacggttgtgtggacggcataaatgtaatgagatatgctgtgtggtaagtggacttattaggcataatcagattccattcatccaggtgctgggcttctggaagcctgagccatgtggagaatgcagcccggatttaaaagtcactgggacaggcccctaagcagcagtcagagagctctcatagtccccataacctctctgcaaagagacagactgggcctttttagcctcacccaggttaagaagtcagccagtggcatctggtagcaacacagaggaagagaaagagataagagaaggtctcacaccccagagcccaagacccctagatgagcacacagtcttcggcagaagattgtgtgttgtcccaacacaaactggcctggacttagcaacttgggcttcaggtttcatgtactgcttaggtcaggtcagtaggaaaaattattaggacattttttaaaaagattttttaaaataaaatatttatttaaaatatttgcttttatggaactaattaaatcactagctggctatttgtactctgttatctcatatactcttttatatataaaaaatataacgtatgctatatatgacataacatgtatatataaatgtgtatgtatgtattagtccattttcacactgtcagtaaagacatacccaagactagggaagttacaaaagaaagaggattaatggatctacagttccaagtcggtggggaggcctcacaatcatggtggaaggcaaggaagagcaagtcacttctcacatggatagcagcaggcagagaaagagagtttgtccaggaaatggccttagaaagccatcagatctcatgagacttattcactatcacgagaacagcacaagaaagacctgcccccacgattcaattacctcccaccaggtccctcccacaacatgtgggaagtcaagatgagatttgggtggggacacagccaaactatatcattctgcccctggcccctcccaaatttcatgtcctcacatttcaaaaccaatcatgcctttccaactgtcccccaaagtcttaactcatttcagcattaacgcaaaagtctacagtccaaagtctcatccaagacaaggcaagtcgctttgcctatgagcctgtaaattcaaaagcaaattagttacttcctaggtccaatgggagtacaggcattgggtatatacagccattccaaatgggagaaattggccaaaacaaaggggctacaggccccatgcaagtccgaaattcagtggggcagtcaaatcttaaagctacaaaatgctctcctttgactccatgtctcacatctaggtaacactgatgcaggaagtgggttcccatggtcttggacagctccgcccatgtggctttgcagtgtgcagcccccctcccagctgctttcacaggctgtcattgagtgtctgtggcttttccaggcacacagtgcaagctgtcagtggatctcccattctggggtctggaggacagtggccttcttctcacagctccactaggtggtgccctagtagggactccgtgtgggggctgcaaccccacatttcccttctgtactgccctagcagaggttctccatgagagccccacccctgcagcaaacttctgcctggacatccaggcatttccatacatcttttgaaacctaggcagacgtttccaacctcagttattgatttctgtgcacccgcaggctcagcaccacatggaagctgccaaggtttggtgcctgcactctgaagccttggcccaagctctgtgttggcccctttcagctacagctggagtggctgggatgcagggcaccaagtcccgaggctgcatgcagcagggggaccctggggccagcccacaaaaccattttttcctcctgagcctccaggcctgtcatggaaggggctgccatgaagacctctgatgtgctctggagacattttccccattgtcttggggttttacatttggctccttgtcacttatgcaaatttctgcagccagcttgattttcttctcagaaaataggattttcttttctctcacattgtcaggctgcaaattttccaaacttttatgctctgtttcccttttaaaactgagtgcctttaacagcacccaagtcacctcttgaatgcttcgctacttagaaatttcttccaccagatacccttaatcatctttctcaagttcaaagttccacagatctctagggcaggggcaaaatgttgccactctctttgataaacaacaagagtcacctttgctccagttcccaacaaattcctcatctctatctgagaccacctcagcctggacattattgtccatatcattatcagcattttgggcaaagccattcagcaagtctctaggaagttccaaactttcccacattctcctgtcctcttctgagccctccagactgttccaacatctgcctgttacccagttccaaagtcacttccacattttcgggtatcttttcagcagtgccccactctgctggtaccagtttactgtattagtctgttttcacactgctgatagagacatatccaagactgggcaagttacaaaagaaagagttttaatggacttacagttccaagtggctggggaggcctcacaatcatggtgggaggcaaggaggagcaagtcacattttaacatggatggcagcaggcagagggagagagcttgtgcagggaaactcggccttataaagccattagatctcatgagacttattcactatcatgagaacagcacgggaaagacctcccccaccatgatttagttaactcctaccaggtccttcctacaacatgtgggaattcaagataagatttgggtggagacacagccaaactgtatcagtgtatatatatatacataaacaaggtaacacagtaccaatagcaaggtagtacgtgtgtatgtatgtatatagcatacataattattttttaaatttatatatttaagtgaagagtgatgaattgtgcaagtattataaactagtgttagaaggcttaaagacttcctcttattataaaaaaatttgcagccaggcattgtggctcacacctgtaattccactttttgaggccgaggtgggtggatcttgcttgatccaaggaattcaaggccagccttggcaacatggtaaaaccccatctctgccaaaaatacaaaaattagccagtttcataacccggtctctaaataaatagatttaaatgtaaaaataaggctggatgcggtggctcatgcctgtaatcccagcactttgggaggcaaaggcaggcagatcacttgaggtcaggagttccagaccagcctggccaacatggtgaaccctgtctctactagaaatacaaaacttacctggacattgttgtgggcacctgtaatcccagctactcaggaggctgaggtaggagaattgcttgaacccaggaggtggaggttgcagtgagccaagatcgcaccaccacactccagcctgggcaacagagtgagaccctgtctctgtctctctctctcacacacacacacacacacacacgatgtaaaaataaaatatatttttttaaaatttcaaactggctcatgcctgtaaccccccagcactttgggaggccaaggtgggcggatcatgaggtcaggagattgagaccatcctggctaacacggtgaaacctcgtctctactaaaaatacaaaaaaattagccaggcatggtggtggatgcctgtagtcccagctactcaggaggctgaggcaggagaacggtgtgaacctgggaggcggaacttgcagtgagccaagattgctccactgcactccagcctgggcgacagagcgagactccatctcaaaaaatatatatgtatgtatcaaatatatgcagaagcagagagactactagtatagagagtcccatatacacaacatccagtttcagtattgatcacctcatgacgaattttgttttatcttcatccccacctactctcccttctgtggctattttgaaggtatttccagatatcattttatccataaatgtgtagagctttgtttttattaatcttgttgttatttatggaaaatataaaatgaagaccattttatgaacaaatataaatctcttttcccaggataaggagcacaagtgtcctttgatttgtgggaggaaactccgttgtggccttcataggtgtgaagaaccttgtcatcgtggaaactgccagacatgctggcaagccagtgagtgtctttactgtatagtttattagaagagttttttagaaattcagacataatatactttgagagattgatttacttagaattgtatggattcttgaactaagccttcgtatttccaatatgttgagactttttttaaagttacttctaatgctgtgttgtagtccctgaatgtgcaaaacttgggatatgaacagtgatcctgagatggggcctagttcgttaatagattccttctctgctacatgcctcatatgtgttattgacctaggttctgtcctcaacaatcttctttctctatattattagcagcagtttgcaaactttttggttgtagggctcatttacattaccaaaaactatcctaaagagtcatttttatgtgaattgtatttatctttatctaccatattagaaattaaaactgagaaatttaaaaaataattgattagtatatttaagaataataatatacctcattgcatgtaatcacaaaaatttttttaaataacttttcaaaaaagtagaatagcggatacttggtttaatagaaggtagctggattcttgtatctacttctgcatccagtctgtcgtgatatagttgaggcatatgaaaaaaatccagccttacacagatagccttacacaggagaagggaagagtattttaaagatgttttcaaataattattgatattctttgaaattacaccaaaattcaacctcattttagaaaggacttgactcggtgtttttattctctgtcacaaaaatttattggactttcttgtactttgaatggatctttttacccgtgcatgattttataatagcccacattgatcatttggaaaataattcttcactgagttatgtgatctttgaaatgttgataaatttcctattataatattaaaaactcagtcattaatataatctccagtctagaaatatgttgggaaaagtattgggaagttgtcagggtcatagtaataaatgaaacttcatatctgttcatgcctttttcaccagcttagctttaataaaataaaagtttaataaaataaaaacctcttttgaaaaaagtagcacccccataaattctcctctaaaaatacaagcaaaaatgtgtgtgtttgtgtgtgttagtatgtacttgcacatcccaaactcagaaaggattcttttgttttacctgctgctccaccaggttttgatgaattaacctgccattgtggtgcatcagtgatttaccctccagttccctgtggtactaggccccctgaatgtacccaaacctgcgctagagtccatgagtgtgaccatccaggtgagtaccaacttgtcttcacacttcagcctgctcacaccatgtcatttaggatcctgctgtgttactgtcttcactgctctagagtcatgctgtgatggctgccccttgctcccggctcaggggctggttctctgaaggtgggtctgtgatctgggccacagcttggaatcacagtgccctccattggtttactctagggatgtcaaacacacctaaaaacgttggaagactccccagctgatcttatctctcaagaacttttctttctttgtggtctccactttggtgcatgttttgaaatttagcatctttttacaaaattaaaagtgacttttttgttgttatagaagcaatatatatttatcgtattaaaattaagaaaatagaggccagggccaggcgcagtggctcatgcctgtaatcccagcactttgggagagcaaggaggggcagatcatgaggtcaaaagattgagaccatcctgcccaacatggtgaaaccccgtctctactaaaaatacaaaaattagctgggcatggtggtgcacgcctgtagtcccagctactcgggaggctgaggcaggagaatcacttgaacccgggaggcagaggttgcagtaagctgagatcgcaccactgcactccagcctggcgacagaccaagactctgtctcaaaaaagaaaatagaggccaggcacagtggctcatgcctgtaatcctagcactttgggaggctgagatgggcgggtcacttgaggtcaggagttcgagaccactctggccaacatggtgaaaccatgtctctactaaaaatacaaaagttagccaggcattgtggcgggcacctgtaatctcagctactcaggaggctgaggcaggagaattgtttgaatccgggaggcagaggttgcagtgagccaagattgtgccactgcacttcagcctgggcaacagagtgagactccatctcaaaaaaagaaaagaaaaagaaaaagaaaaaaaaggccgggtgcagtgactcacacctgtaatcccagcactttgggaagctgaggcaggtggatcacctgaggtcaggaggttgagaccagtctggccaacatggtaaaaccctgtctctactaaaaatacaaaacttagcctggcgtggtggtggacgcctgtaatcccagctacttgggaggctgaggcaagagaatcacttgaacccgggaggcagaggttgcagtgagccgagactgtgccattgcactccagcctgggtgacagagtgagactctgtctcaaaaaaaaaagagagataaagtcaaaagtttgaaattaaataatctattatatgtcacctccaaagaattataccttatatgtatttctcagggtcttttgccatgtgcaaatatatatgtttgcattttttccccaatgtaaaagtgggatcctactgaacttaatgcttttaactagctttttttcccactcttattattatatttttgatctgtccccttgtaagtatttttttacaatataaacttttaatttcaattgagtgtcctgttacatggatgggccataacttattcagtcagtcttgtgttgctggacattttagtgttttcagttttcctctgataaactgctcagataccaggccaacaaccatttgacatcactcaatttccgtatctgtcaagtctagttgctggcttttctctagcaccataccgggcccatcatttcattttaccaaataccagaggcaaacctgaagtaattcaggggaccagatttgatacccacagttagtctggcagtatgattcagacttaaaactagaaaaccaactcttgattttttaagttaatggagtaaaacagaacttaacaaattcttcattaagtggaatgttccctccttccttggggatcttaggatagccctcccagcgtagtttgcaagcccctcctgtggcattcataccagcatgaagtacatgcccaggccagtccccaccgattgcctcctttacacttaacctgcagatgaattccaaatgctgctgggcaaggtccatagtaagaacttcaccatttgtgaattgtgttgttttagcctattttgttccccattcatttccattttcttaagtgtttattgtatttctaacatggtgtcagacatagagggaacttcagaggaagagaaaaataccctgtgaccttgaggttcttaacattctccgagaggaggaggacagtagttcaatacacatgatacaaccacccttcacatgaagatgggctaaataatgtggcagcaacccatctgcataggaactgagacaccaggaagtgtgagggagcccagacgagagtgtggtagccaaggaaaggttcattgtaggaggtgagttttgatgaacctccccttataggcagtaatgaaattggaaggagtcagcagaagcattttagatggaattaatagcaaagatatctgagcagaagtgagcagttgcggttaaagtagggccaaaagaatgacgtagtagaattggatggaccatatggctgtgctgcaagagatgagatgggaaagctgcctcatctgcttctgttttggcatgtctcttcctccttggttgggtttctttttctcactcatgcttgtccttcaacactttaacataaagcaaggtactttttactttcctgtgaccgtttttcaaaagtactcccagtttctgaatttaaaagtttcatgccgtatgccacttatatgatgtataatggtttacatggctttatttagaaagtattcctaaagttacctttctctttctgcagtatatcattcttgtcatagtgaggagaagtgtcccccttgcactttcctaactcagaagtggtgcatgggcaagcatgaggtaagttttctctctcaagtgctcattgttccaggcagaggttcatgattttattacttaagaattgttagtctcatcgtctgtcaaagtaaatacactcagaagtagaagctttccattgcttaaaaattttttcttaagatataatttgcatacaacagaatttaccctttttattgtacagatccatgagttttagcaaaagcatacataccatcaaaccactaccacaatcaagatatagaacagttcagtcacccccaaatatccttcatgcccctgtatactcaatgtcccctacttccaacttctgaaaaccaatgttgtctgttccaatcattttactttaaaataccaaatttttttttaataacctccttattcctgcaagaatggcaataatcaaaaaataatagatgttggcgtggatgtggtgaaaagggaacacttttacactgctggtgggaatgtaaactagtacaaccactgtggaaaactgtggagattccttaaagaactaaaagtagatttaccgtttgatccagcagtcccactactgggcgtctacccagaagaaaagaagtcattatatgaaaaagatacctgcacacgcatgtttatagcagcacaattcacaattgcaaaaatgtggaaccagcccaactgcccatcagtcaacaagtggataaagaaattgtggtgtatctatacgtaccatggaatactactcagccaggaacgaaataatggcattcacagcaacctggatggatttggagaccattattctaagtgaagtaactcaggaatggaaaaccaaacatcgtatgttctcaattataagagggagctaagctatgaggacgcaaaggcatgagaatgatacaatggactttggggactctggggaaaggacgggaggcgggtgagggataaaaaactacacactgggtccgagcacggtggctcatgcctataatcccagcactttgggaggccaaggcaggtagattatgaggtcgggagttcgaaaccagcctggccaacaaggtgagaccccccccatctctactaaaataattagccgggcctggtggcgcatccctgtaatcccagctactttacttgggaggctgaggcaggagaattgcttgaactcgggaggcggatgttgcagtgagccaatatcgcaccactgcactccagcctgggcaacagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaagaaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaataagaaatgcatatttattgtacagttgagaagatttaattctgctactgagaaagaaatactctaccattctggcatataaaccaccagacgtggtacacatttttccttgctgtggttaagatgatactgtttgctacattccaactgtcctataccaaaaaaaaaaagatattgttttgtaacctgctttttttgcatcatgacgtattggccaacatttcatgaaactcttgacatctataacaacatgctatattcttttatcttcatggacgtatattcctccactgatttcctgtgggtggttctcaagtccttggtatttattcttttctatatgtctcaccttttccagtttatccattctaaaacatcaatgtgttatcttcgtactgatggcttattaagacttcattcaacagatatcgagtatgagtacctactatgtgctaggtaacaggctaggtttgggtgctttggaagtgaacgagactaacccttgcccttatgaagccttcactttgggttaggaggcaggcatgaaaacagacaatagcagtaatgcgggaaatacagagggctaaggaggatggaagggctctccaggtgttctggaaaaattaacatcctaaaggatagtgagaagaaagtaatgtggagaggatgacagggcagagcatgggcaaaaattatcccctttgccctggtagtagaatgggtaagtgtttaatgattgagaactacattctactaaaatatggattccagtgcgatgggaaatatgtatgtcctagatgttggaagtctcttcagggggagaagttgtgtgtcactgcagtagaagtatatccctcatttcgagggttcaagactagcctttggtcctacgagagtaaaatttcagcagctttttcctatggtgaggaagcgtggaaacaggccatttttcaagaaaaaaaaaaagaattgggggttctatcccctgttgtctcttaattttttaaaggacaggactgcgtgaagctgtggagaccatgagttgggagacatgaggagagttaagtatttaattacagaaaacagcctcctagcctgggcaacctagtgggatcctgtctctacaaataatacaaaaattagctgggtttagtggcatgcctgtactcccagctacttggaaggctaaggcaggaggatcacttgaactcaggagttcaaggctgcagtgagacacgattgtgcaactgccctccagcctaggcaacagagcaagattctgcctcaaaaaaaacaaaacaggccaggcgtggtttctcatgcctgtaatcccaacactttgataggctgaggcaagtggatcacctgaggtcagcagttggagaccagcctggccaacatagtgaaaccctgtctctactaaaaatacaaaaattagctgggcatggtggcacacacctgtagtcccagctacttgggaggctgaggtaggagaatcgcttgaacccaggaggtggaggttgcagtgagctgagatggcgccaccgcactccagcctgggcgacagagcgagactccatctcaaaaaaaaaaaaaaaaaaggcaaaataaaacgaaaaaatggccctgccatcagtctcagaaccctgggctaaggttgccctccaccccgcatctataagaattagtctattgactctgctttagcagttcagaaaggagggaaaagatcatctgcccctgccagttagtcatagcattttcaagcactccctagttacctagttacatttgtttgttgtcactttggaaagtttatgttccagatcacatttttggcttctgctgcaaatccttttgagtcataacagggattattaaataaagttaaggtttgttttcttcatctcaaactaacctttcagactttgaaaatcaaactgatttcttttcagataaatagagcttttttaaaaatacagcttttaagctggatgcagtggcatgtacctgtagtcccagctaatcagaagactaaggcaagaggctcacttgagcccagaagttcaagtccagcttaggcaacatagtgagaccctgtctctaaaaattaaagtaataataatccttattttaaaaactgagctgagtgtggtggttcatgcctgtaatcccagcactttgggaggccaaggcaagtggatcacttgaagtcaggagttcaagaccagccatctggccaacatggcgaaaccccaactaaaaatacaaaaattagctggtcgtggtggtacacacctgtaaccccagctactcgggaggctgaggctggagaatcacttgaaccctggaggtggaggttgcagtgagccccgagattggcgccactgtactccagcctgggcaacagagtgagacttcgtctcaaaataaataaataaatacaaactgttattgccagatgcagtggttcacacctgtaatttcggcactttgggaggcctaggcgggtggatcgcttccactcaagagttcgagaccagcctgggcaacatggtgaaaccccatctcttaaaaaaaaattcaaaaattagctgggcgtggtggcatgcacctgcaatcccagctacttgggagactgagatgggaggatcacctgagccccaggaaagtcataatcacactgttgcactccagcctgggcaacagtgaaaccctatatccgaaaacaaaacaaaaccaaaccctgccataagcttagaaatgtttaaagagaaagttaaaactcaccccaaatcccacatggagatgagaatctggctacttctgtctctcctagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtgggtatttctggccacagatgcagcattgactgtagttctgaggctactagtgaatccagaactgtctacagtggcccctgggcatgcatcttaattaagggtcattggttgcaaataaccacaagttagagaaaggtagagtaagtcatacaagtttctgcctgcccaacttggtatggccttttgattcagcaggtacccactgccaccggaccacagtctgtgtctcccttgggtgagattctcaatagtcactgattgtttactccatttatttaataaatgtataaatgtcttttgtgcaagacatagtatgaggtgctagggataaattagtgaacaagagacacatggttcctcacaatctgataggacagatacttgattattacttagataactaattatggctgtggtgtcatgagggagtagtttaagccttgtggagggggctatgagagcaggtaaatgggaggttaagcctggtctaaaggatcaagtgtggccaccttgaggatgtggagttggcttggagttggctaggccacagttgggcctagggcaagtgtctgtctctgatggtacaaacttcatcctaggcctgccccttcagccaggattaagaacagaggtggtttccaaaagggggcattgtggacggggcaattctttcctagcatgtcaacaactgtgtcagtttgcatgtgtggttagcttcttccagcttggagagtggccacccactgactctctagtctctgctatggtttaagagaggatttaagagtgaaaagtgctttattcacatagttccagtgtgctaaaagtcgttccatgttcatctgacttcaggtagagctacagtgtgaatgtggacgaagaaaagagatggtgatttgctctgaagcatctagtacttatcaaaggttagtgttacttaaatgttaacaactgatggcctaggtgaaacagatacatgtgttttgttttgtttttaaagctagtcaagtgaagcagtgggagtggagaagaaacaaagaagtctgtaactgttgtaatcagttgtaaacaccactgcacagatacatgtgtttatcatagtatccttgcaacttttctaaaagctggaaaggtttttttgtttgttttgttttgttttattgagaggggtctcgccctgtttcccaggctggtctcccaccttggcctcccaaagtgctgggatcacaggcgtgagccactacacctggctggaaagtttcttacatacatttttaaaaatctggtttctctagttcaaagaaacagtgctgctttatataccttttcttccctaactttagtgtgtaaaataactttgaaatttctccgcttcctccttcctctttctttttttctctcttttggtcgtattacattgtgaaataagaagggaagatgtcctgaagttaggtgaattgctttcacatcctaccatttgtcattgacacagccagggctaagctctgtgctcctctggtgtgagggtttctaattgttctgtgaggtatctctgcagcctcctgaagtcttgggacctgtgtagccgtacagggatctgagtgctgagatggaggtgttagagaatgaatggttatatatatatatatctggttagatggggagaggtgccatggatataggactttaagaggatgcacacatcagattggctgtgtttgaatacctactaagtgccaagtgttgctctaggggatactgagggattgagtcacctcatcgcttcccatgtagctgctttgaatataattgaagagatatgacataaatatgtaggtagttcatagtagccgggcttccaaggccacaccagttttcatctgatagatttgctttttttttttttttttttttgaaatggagtttcgctcctgttgcccaggctagagtgcaatggtgcaatctcggctcactgcaacctgcacctcccaggttcaagtgattctcctgcttcagcctcctgagtagcggggatcacaggcacctgctaccatgcctggctaattttttgtatttttagtagagacggggtttcaccatattggccaggctggtcatgaactcctgacctcaggtgatccacctgccttggtttcccaaagtgctgggcttacaggcgtgagccaccacacctggcctagatttgcttttaaagaggtcttctgtatcccaagtataaggaggttcttgtgaaactgcaatgcctctttttccctttcttttttatatttcagaatagctgcaatctccatggcctctaagataacagacatgcagcttggaggttcagtggagatcagcaagttaattaccaaaaaggaagttcatcaagccaggtaatttttaaaatgcatatatgtgccttctttcttcaattagacttcaattagagggcagagattattcatttatctcaatccttcatagtagagccttgcatacacaataagtattcaatagacaatttgatgttgagacatctgctccatccccaatgaatcctactcaggagatggctaagactaaaggagacttttccaggcctcacagtaaccgaaggaagcagagacctataggtgtttagcttaacccatatgagaatagagaacccagagaggtggccatctctggagagggagattgggctgttaagaggggcacctgtggagcatttggggctgagcagccagggaacactctgaggccactggaggactcctagaccccataacagagaggccatcatcccacctgtccttcagagggacctcatccagccattcctggattggggtccctggggaaatggtatttctagggcaaggttactaatggaaactgaagagcaggtggcctcacaggctgcttcctggcctgagggattgttttttggcaagagtcagctgtgcttccaggttgactgagacttccttttcttgctggatgggagctgtacagtctgtattctgactttaattttttttcatttgcttatcaaggctggagtgtgatgaggagtgttcagccttggaaaggaaaaagtaagtagttgcagctgcttttttaatctccttgcccttgagctctgtgaaattaatgggagggagcaacccttcaaacgtcattcactcagcactgcgctgcgtcttttaccgttatcaaagagcaagagaaatgccgttaccaagaattgaattgtcttaaggataaaccactcaggtgatttcagcatattgagaaacatgagctgtgtggttttgggcatgatataaacatcacataacacagcatacttattcagggactggccaacttcctgactcagagataagaggtttaaaacaatgtttagttaacttttcgttgaagtttagcatacatattgaagattggaagtgtgcagatcagtgaatcgtcactaaatgattacagttgtgtaatcatttgtgtcactaaatgaatacagttgagtatggatacaggtgaaaagataattaccagaaccgtctcttgtactctacataaaggtgaaacctctatcctaatttctctttagattagtttttgaactttatgtaagtgatgaaatcatgtagtttgtattatttttgtctggcttctttcgttatatttttgtgacattcactcctgttgttgcatgtagcaatgctttattcatttttattcctgcatgattttttttgtattactattcatttacccattatactgttaatggatatctttgtattaactgttagactattacaaataaaactgttaagaattcttttttttttttttttttttgagatggagtttttctcttgtcgcctaggctggagtgcaatggcatgatcttggctcactgccacctctgcctcccgggttcaagcgattctcttgccttagcctccagagtagttggcattacaggtgtgtaccaccatgcccagctgatttttgtatttttagtagaaatggggtttcaccatgttggccaggctggtctcgaactcctgacctcaggtgatccacctgcctcgacctcccaaagtgttgggattacaagcttgagccaccacgcccagcccagaacattcttaaacttgcttgctctatatttctgtacatttctgttggatataagccagaagtagaattgctgattaatagggtttatgtgtgttcagcattagtagattctgcccatgtccaaagtgattgtaccaaattacactcccaccagctaaggataattcccattgctgtacatttttgtcagcacttgaaattgtcactttttaattttagccattttgtagatgtgtataacaagatgtcattgagcttttaatttctattttcctgatgacttaagagattgagcacctttcttgtagttactggccattggatagcctcatttttgaagtgcctgtacaagtcctttgcttatttttttgtgctctttttgtattgattagtaggaattctttatgtattctgaatatgagtcctttgttggctctatgtatacattgtgagtactttgttgcactctgtaccttcattttttactctcttgatgcctttttttaatcccagaagctaaagaactcttgttgtcttttgataaacagaaatttttaatgttaatattatccagtttatttgagtttcttaataagcacttttcatgtcctatttagaaaaatttgtctatcctgaggcaatgacaatattctgttattatctagaaactgtgttattttacctttcacattttaaatctacagttgacctgtactgatttttttgagtatggataaggagagtttacaattcagcttttttccacgtgaatatccatttgacgagtaccaagattgtccttttcccagcactctgcagtgccacctctgtcatacatcacatataagcctgggcaacttggcaaaacctcatctgtacaaaaaataaaataaaattagccaggtgtggtggtgcacacctgtagtcccagctacttgggaggcttgaggtgggaagattgcttgaacctgcgaggttgaggctacagtgagccatgatcaccagtctggactatacttttggtgacagagtgaaatgctgtctcaaaaaaaaaaaaaaataataagccgggcatggtggctcaccatggccgtaatggtggtgcctataatcccagcactttgggaggttgaggtgggcagatcacaaggtcagcagatcgagaccatcctggtaaaaccccatctctactaaaaatacaaaaaattagccgggcatggtggcgggcacttgtagtcccagctactcgggaagctgaggcaggagaatggcatgaacccaggaggcggagcttgcagtgagccgagatggtgccactgcactctagcctgggcgacagtgggagactccgcatcaaaaaataataataaataaataaagtatatcaaatatatatatatatgtgagtctgtttctgagctcatcctgttcaactgcactagtatcacactgtcttaattactgtacctttataacaagtcttaatatctggtagtatatatcctcaaccatgacttttcttcaatattgtctttgattattctttattcttagccctttacatttccacttaatgtctttttcatttatgtatttatttattgagataggatcttgctctgtcacccatgctggaatgtagtggcacaatcatagttcactgtacccttgaactcctgggctcaagggatcctcgtgcctcagcctccaaaatagataggactacaggcacacaccactacgcctggctaagattttcttttttttttttttttcttttgtaaagacagggttttactatgttgaccagggtggtctcaaacttctggctcaagcgaacctcctgccttggccccacaaagtgctgggattataagcatgagttactgcacccagcccatttccacttatatttcacaattggcttgttattataatatatacccaagaaacctgctgggattttgattgagttggtatttaacttgtaggtcaatttggaatctttacaatgttaaattttctagtccaagagaaggtgtattcttgcatttcatgtcttctttgatttctctcaatgatactttatggttttctatatataaattttgtattctttcagtagatttgtttcttgctttttgatgctgctatagatgggtttatttttcttgtattacttgtaattctttttttgagacagagtctcgttctgtttcccaggctggagtgcaatggtgtgatctcggctcactgcaagctccacctcccgggttcacgccattctcctgcctcagcgtcccaagtagctgggactgcaggtgcccaccactacacccggctaattttttgtatttttagtagagatggtgtttcaccatgttagccaggacagtctcaatctcctgaccttatgatctgcccgcctcagcctcccagagtgctgggattacaggcatgagccactgcgcctggccaacttttaattttttttaaattattattattatttaatgtgacaagtgttttgtttattttgtttttgaccaggttgacatcctcaaaaaaaaatgcaaattacaaggacttcattttaaagcaaatgctcattttagaaatgtgttacagaagatatttatgtgcttcagcaggcataaaaatatatcacagataaggcaaaaaaattctgtgaatggcttgatttttttttttttttttttttttttttttttttgatacagagtctcactctgtctcccaggctggagtgcaatggcacaattacagctcactgcagcctctacctcctgggttcaagtgatcctcccacctcacctcccaagtagctggaactgcaagtgcatgccaccacacccagctaatttttacatttttttgtaccacacccagctaatttttttgttttttttttggtagagatggcatctcgctatgttggccaggctggtctcacattcctgggctcaagcaatcctcctgcctcagccttccaaagtgctgggtttacaggcgtgagccaccacacccggcctaaattggtattttctaattgcttgttgctggtatttagaaatacaattgataattattgacttatttagcaacctcgctaaattcacttatttctgatattgtagattattttggattttgtatatacacagtcatgtcttctaataatagtaattttatttattgtcaattcctgttatttttttcctttcttttttcttttatcttttttccttctttccaattcttaacttttatttcttcttcttacctcattgtattggttagggccttcagtatattgttgaatggagggtggtaataatagatattccttggccgggcgcggtggctcacgcctgtaatcccagcactttgggagactgaggcgggcggatcacttgaggtcaagagttcgagaccagcctggtcaacatggtgaaaccctgtctctactaaaaatacaaaaattagccgggcatggtggcagacgcctgtagtcccagctactcaggaggctaaggcaagagaattgcttgaacctgggaggcagagggtgcagtgagccgagatggcgccaccacactctagcctagacgatacagcaagactcagtctcaccaaaaaaaaaaaatagatgttcctgactaatcctccatctcatggggaaaactttaagtatttcaccattaaatatgatgtctgcagtaagttatttgaggatactctatcagatcaagaggcatttattcaacaactgacaaactttctgattctagcaaagattgattaaattgaatagccctgcaaattgttaataattggagaatttaggtgaaggttatatagaagtttatggtaatattctcataacttgtctttgaaatttgtttaagataaaaagttagacaaatgcagacaaagtatagccctattttaccttgaagtttgactttcagcaattttaatagtacctctttacatattaagtgtgtagaaggtaatatgatgactagtagtgctgtccaaattttccttggtttgacccttataataactttctagtgagtgccgttcaaaacccttgccctttaggaaccgtcagtcagtgttctcagctgcagaatgtaaattaggagtcctaggtattcagaaatgctatagtgaatacacagaaggtctccaaacatggaaatgtacttttggtggttgaaagacatattgtatactagttagagccagagctctggagtcagattgtctggatttgaatcctggcttcacaaatcacttagctatgagaccttgggcaagtcacatattgtctgtaagccttaggtttcttaaaaatctagaaatgatgacaataacagtatttaccttccagagttgttgtgaggattaatacattaaaaatgatactcataaagctcttggcacaagagcttggcacatagtaggtactcagtaaatgttattgattaaaactagctatttttgaaagccttttgaatttctcctcaatcttggtgatgacataatgacccttactggatagagtctttcataaatacacacaaacctaagagaaaaaaatgcaaatttaaagaaaagtccatctaaagttatatctatatatacacacacatatatacacgcatacacctgtgtgtatatatatgtatgtgtgtatatctctattgtagaaataaaaacctagcaggccaaattcagcccacagacaggttttattggtgtttaaatttgaattagtggccaactaaccaaaacatcaaaagatcttcccctagaaattctcttgaaaatttgaaaagtaagtgtcttttgaaaaattggaaatctagcagtgtgaaccagattcttgtgggcactaagcttgtaagtgactcttggtgcagtgtaaatgaaaattgtactaagtgctaagctgaaatctagctttaaaaaaataaaataacttgaatgttggtgagatgccatgagattcagacactgatggctagggcactaagtggcatttctggagaccacttactccacattgatcaagagtcttatgtccactccatgtaccccacaactggaaacattttcaaagctttttgcacagagatattaattgtgtcgtatataatattgagaaactgaggaactgttaaagaaacctaaatgggaaatgattaaaatatgggaacataattagaagactatgagccatgaagacagttaagtgtgaaaacaaaataataatatgagaaatgctaacaagataatgctgagaggcaaagaaacaaggtttttttaatttttaaaatttttttattaaataaaaatggtatatatttatggtaatacagcatgatgtgtatgtatacattgtggaatggctaaatcaagctaattagcatatgcattacctcacattcttatttttgggggggtgagacaattttgaatataataatggcggtacttaaaattatagagaaaggctgggcgcagtggctcacacccgtaatcccagcactttgggaggtcgaggcgggtggatcacctgaggtcaggagttcaagaccagcctggccaacatggtgaaaccccatctctactaaagatacaaaaattagctgggcatggttgcgggcgcctgtaatcccagctactcgggaggctgaggcaggagaatcgcttgaatccaggaggtggaggttgcagtgaaccgagatcatgctattgtactccagcctgggcgacaagagcagcctgggcgacaagagcaagactccatctccaaaaatatatatatatacacatagagagaaacgttatagtgaaaaaaggggcccgttacagcggctcatccccataatcccagcatttgggtggctgaggccagcggatcacttgagctcaggagttcaagaccagcctgggcgacatagcaaaaccctgtctctacaaaaaatacaaaaattagccgggcatggtggcacacttgtagtgccagctactggagaggttgaggtaggaggatggcttaagcccaggaggtggaagttacagtgagctgagatcatgccactgcactccagcctgggcatcaagagccagacccagcctcaaaaaaaaaaaaaaaacaattagaaaaaagggaacacttacacattcttggtgggattgtaaattagtacagccactatggaaaacagtatggaatttcctcacattaaaaatagaactaccatatgatccagcaatcctattacttggtatctctacagaggaaataaaatctgtagagatacctgtactctcatatttgttgcagcactatttacaatagccaagatatgaaatcaactgaagtggccaacatggctgcatggataaagaaaatggggtatatatacagaatgaaatactattcggccataaaaaaaatgaaaccctgtcatttgcaacaacatggatggacctggaggacatcatgttaagtgaaataagccagacacagaaagacagacaccacacgatctcactcatatgtagaatatttaaaaaataatacagaagcagagagtagaccagtgttgtctgactgagaagagggacagggtggaaaagggaggatgaggagaggttggtcagtggatataaagttacaaatagatggtagtaataagttcctgtggttttttttttttttttttttttttttttgagaaggagttttgctcttgttgcccaggctgtagtgcaatggcgctatctcagctcactgcaagctctgcctcccgggttcaagcgattctcctgccccagcctcctgagtagctgggattacaggcatgcacaaccacacctgactaatttttgtgtttttagtagagacgaggtttctccatgttggtcaggctggtctcgagctcccagcttcaggtgatccgcccgcctcggcctcccaaagtgctgggattacaggcgtgagccaccgtacccagcctaagttctcgtgttctatggcacactggggtgatgatggttaacggtaaggtgtagtattttacaaaatagctagaaaagaggcttctgtgtattctcaccacagtgaaataataagggcatcaggtgatggatatgcctaatacactgatttggtcattatacaacatagtatatatgtaccgagacatcaacatcaaactgcttcataaatatgaagcaatgacaatgggtcaataaaaataaaataataaagaaatgtattattattattattattattattattattattatttttagacagagtctcactgtgttgcccaggctggagtgtagtggcacaatctcggttcactgcaacctctttctcctgagttcaagtgattctcatgcctcagcctcctagcagctaggattacaggcacgtgctaccacacccggctaatttttgtatttttagtagagacagggtttcaccatattggccaggctggtctcgaactcctggcctcaagtgatccatctaccttggcctcccagagtcctaggattactggtgtgagccaccgcacccagccaagaaatgtataaaaatgaagtgtatatgttaatggaattctttacttttcagatttctatattaattttaacatttgtatgtctattttatgtaccttatctttaaacaaagcctcagagaaagtcatcccccattgaccattctcagtgatcccacacccccaaactcctcttccccaaataatctaagtccccagtgttcagcctatgacttgctcagatccttatagatctgtttattttcttttatgaagacaataccacctcatgtcccaagttgttgttattctctccttaataatccagtttaccaaaatagagataaataatgtgtaaagaatttaggatatagtaggcactcggggttactgcaagatagtttccctcccactccttttatttgcatacctctctctctctttcaggagattagcagaggcatttcatatcagtgaggattctgatcctttcaatatacgttcttcagggtcaaaattcagtgatagtttgaaagaagatgccaggtatgtaacttgttacctgctttcttaattgtggcttgtcagggtgtttggtcttttgagatgtcataactaatatgtactcctcctgtgattaagccagttcaagtttgtttgtttatctattgtaagagattatgtgctgtttaataaatatccttctcttggtttctcgaaactgtccccttaaagaactgaacttggggtagggttgagataagagtttgggtggggtggtggtaagagtttgggcctcccaagggctggactagactaaattggaggatctctgggcttcattccacttctgtccaccccagtctcacattcacatgcgttctcagttggagctataacagctcttatttttctcctggagtccctggcctttcagtggctacttctcctttcatcttctcatttcttatatttttctcttttgttcttccgtcagtcatccttctgttttctgacaattcctgatctctgcagttttactgccagcattgtctattgtctacgctttacagggagaggatgggtgaaaggggttctcagaagggcagggacagacaaaattaactggtgatttctcatttcaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcaggagaattccttgaacccgggaggcagaggttgctgtgagctgagattctgccactgcactccagcctgggcaacaagagtgaaactctgtctcaaaaagaaagaaagaaagaaagaaagctctgcagtcagctgtaagtaaatgccaggcacggtggctcacacctgtaatcccagcgctttgggaggctgaggcagcaggcggatcacttgagtccaggagttcacgaccagcctgggcaacgtggcaaaaccctgtctctacaaaaaataaaaaattagccaggtgtggtggtgcacacccataatcccagctactcagggggctgaggcaggaggattgcttaagcccaggaggtcaagcctgcagtaagctgaggttgagtcactgtactccagcttggatctccagcttgagatcctgtctcaataaaaaagaaagaaagaaaaagaaaataaagatgctggccaagtgcctaagaatggatgaagaaactctgggtgagggggctcaatagtgatagttgagtgactgtgtgggacacttaggaagacactctagcccctcagatctttgaagggctattgtatgctaggaaagcccactgttctttataattccaaaggcaggaatgtcccctttgggaaggatgaaagttgtatgactacagctggagagcagtgggatagactccttcagaagagggagacccctgtcctggaggcggccagggatgtcacggaggtagctttaagtggaaaagtcttgagtttagtcagaagcccccagcgctgcattggcttcctcccccttccatcaggggggacggtgagtaaggacaagatggttgctttagcccctgtatctaatgctggtggttttccttcccagtctccttaccctcttcccattcccctcctttcctcccttctgttaccacttcccagcagaatattaacatgaaggagaaaatggaatgcattattcctctcctaattaagaaaccccaacagatgtgtttctctgcttgtgtgtctgtatctgaatactcacgatttttaaagtagaacatacttttaaaggaaataatattttcttgttttgtaagtctttagtcatttttggggaatatcacccactccccagttatggaacccatcaggaagaaccattatgctgtctacctaagtcgcagttcacttaccctttgtccctaaccctgtccagctgcgactgttgtggctcacagagtaggtgaaagaagtgcatcagtgcccatcttcccaaacccctccaggcttgcttggcagttagtaaaatgctctatgctgtgggcctctaaaatcacctcttattgatccctgcaattcttgtgtggtaagattagttgtaagcattttgttttcagaatgatatgatcaatcagtcatcttttccctcaatacagggaaagaatagtaagaaaagccacagcttccctcccatgaacagagaccaccgccggatcatccatgacttggcccaagtttatggcctggagagcgtgagctatgacagtgaaccgaagcgcaatgtggtggtcactgccatcaggtaggtcaatcccgccgtcagaggaagaactcctaagcagggcaaactggacccaagaagcagggtctgtcaatacttgtctttcttactaccactctccctcttggaaaagtagaaggaaaatctgcttctctggcacttcccagataatctaaaggcctgagccaaagagcaaaacctatgcctcgacccacagggcagatgcactcaaaatgcacaagtgtcacatctgcctacagtcatagcagatgctggaagcagcatttcttcaggcaagggggcctgcccatcatatctgctcttttctccttctgtctcctgttcctctgtctgtcctctccttggctctgtcctcttggcatggggaaaacagaaagaatgctggactctggttcgaggcatcccctgtgaatggtgtttttgccatcagaggaaactgaagcaataatgtgaccaggaggggacagggaggacctaggatcactctcagaacctgggaataggaagaacttgccagtgaagaaaacaagtctgacatgaagcaagccacgggcctggcataggtgggtggaagggacagggggttaaatgcaggtggccatgtctgagagcagacagttcataccagagagtgctcagtagtgtcatagtgccaaaatcaagggctgagtttctagctttctgtccatctccacaaacaattctcacttttcaatgcttggtgttttgacttttatcagggggaagtccgtttgtcctcctaccacgctgacaggtgtgcttgaaagggaaatgcaggcacggcctccaccaccgattcctcatcacagacatcagtcagacaagtaagattctccagctgctttccaaggggacctgtctgtccagaaaagctagcaggggctgaattgtcctgagctgcaccagccattggtggcctcctcaggcctggccttggggtaccatgttcaaatatgtaatgtttagttagggtatcagacacgtttgttcccaccagaggggtcctaagtttgttgtttgtagtgcttgattctagagagagcagtcactggacataatttccatggtgtagatggtgacactgggaagtggattcagtctgtcataccagatagtttaagactgaaacatcgtgtagttaggaatagttactctgggccgggcgcggtggctcacgcctgtaatcccagcactttgggaggccaaggcgggtggatcacttaaggtcaggagttcgagaccagcctggccaacaaggtgaaaacccatctctactaaaaatataaaaaagtagccgggtgtggtggcgggcacctgtaaacacagctacttgggagactgaggcaagagaatcacttgaaccttggaggcagaggttgcagtgagccgagatcgcaccactgcactccaccctgggcgacagagagacagactccatctcaaaaaaaaaagaatagttactctgaagatgcaagtgggtgtgggggtgagaattgccggtgacgggggtggatagtactttcttgttttgctctgtctgcttctatatggtttgaataatttttataacaaacatattcatgatttaaagagaaaagaaaaccaagttggcaaggggcaagtctgccagatgttttctcagacaggagcagggaaggagctctgagagttgggtgactgttgggctttatttggagaaaccagaattgtgggctgaaaccaactttagagcacttggtcatagccccagttgtcccagttgtttgtcacttgtcagggagaggaagggaaggcaggatggtgctccttctctgctgccctagtgtaaccaaggcagtgtggctaaaagttacttcaaagcccagaaggagaggggtgcctactcctgttctggctttccacagacaagtcctagcagtacctcctctgtgattcctgcacaaaacctctgaagggtggttacggcagttcacaaggtcaccatgaaggtcacagcacttagtgttcctgtgggactggacaagaagacagctaggtgttgcccattgagctcagactcagccaagagcgtcctggtccccaggaccagcccctctccactcctgggagccaggtgtcctaggttctggtcagcacagtctgcaaatccatatgggcggtcactttggaaacatgaggggttttctcagaaactgccagagtcgggtccagtcctgcttagacacaaccatgtggagttattggcccgtttatcccatgctatcttttttctttttttctttttttttgagatggagtctcgctctgccgcccaggctggagtgcagtggcgcgatctcagctcactgcaagctccgcctcccgggttcatgccattctcctgcctcagcctcctgagtagctgggactacaggcgcctgccaccacgcccggctaattttttgtatttttagtagaaacggggtttcaccatgtgttaggatggtctcaatctcctgacctcgtgatccgtccgccttggcctcccaaagtgctgagattacaggcgtgagccaccacacctggccatcccatgctatctttttaaaaacccttggcttgctttatttttgtataaaactctattatggaaatgttttagagtagagagaatagtattactatcataaatgcccatgtgcccattaccaaatttcaaaatcaccagctcatgtttgtcccactatcaaaacttcacaagtgagatgctcgcttggcttaagctgttaactgagcattcattgaactgtgaaggcagagtaaaatcatcatcatatatgaaatcctgtaaatagattgtgaaaggttacctctaaactgtaaagtgtaaatagagaatttgttatctcacagaataaaattccccatgtaatatgtaaatctagaaggaaacacaaaagttaaaaaaattgctcacaaagggcagaaggaaaaaaagtaagactaaaataaaaataaaataaatgtttaagattcacaaatggtaaatcagctgatccttaactttctgaagtcctgtatctgtttcccccaaagaagaaaagactgatcattctttgtttgtttttcaggaatcctgggagcagtaatttacagaaaataaccaaggagccaataattgactattttgacgtccaggactaagaagatcatgatgcacttagataaaagaatgattaggtatagtggagacttatttgccagcagataaatcatgcccgttcccctctgcctggcagaatcacagtctcacatactgtcttgtactgacacatccaaagcatgagtgtgtcagaaatcccttgtctattcctgtctgtataaagtgtttcattatgaccagatctctgattgtatggtcactaggtatgcaatcacgcattcaaagaggctctttacaccatcactgtgattgctctgagagttgagggactattgggctttatttggacaaaccaaacttttagcctgaaaccaactttatgccactaagtcatagcctcagttgtcccagttatttgtcctcctgaaaatgcctgaaacatcagacagacattgcttgctttacccaaactgatcaaaatctttaggagcacaaatgaattttttagtctgaaataccaaataatgaattggtataccatatccggaatcacacatgttatcttaaacccagccatcatacctaagtcttttgccaaaacctctcataggtatatctagctgaacttattttggcattttcaatgtgatcagttctagacctagaagggggtcaggctgctttacagaattctatttccttaagtccctggcacttctcataccacatcactgaacctgttcagtaacaatcagtttggccgtcccccatgatggtaggaaatatagagagcaagttcttctgccagggtcacactgtggtctctgaactgaccagtatatccctaactcctctttgatagagaaagagtctcaaatggacaactgtcctgtgttgctttccctaggccttcagcagcctattggctctccctgcctctgagctctggactctgtttgaatattccaagtagtatatggacagtccagggcttatgcccagcagcccactggaggcattcttcaggctcctttaaggcaggtgcattgatagttccattagtgtgacccttgcattggcacccctccagcctggaggccaggcttccagcaacttccttctgccctagagcaagccatgagccccagagcagtagcaggagacttgagaagtagagtgacaaaaacaagcacttaattaaattataaaatttaactttatagggctgccttttggtgttttcatttttttatttcttttcattttttttcctcaatcctcctcctcctgtagcagggctgtcctttggtccttacccagtctgcttcaaaagggatcaggtacagcagcaggaacaggtgactggagggaagtgacacaaaacaaaaccacctctctctggacccatgtagtgcaggtcagtggccccacacacaacaggaagcccatgagcatctgttacctctttcaagcagtgggttcagtgggtgaatagtacgtgtgagagtatctcagaatcagcaaaaggcaggagacctgacttcagattctagctgtgccacataatttgccgcttgatgcgatgaaagtttcactgacctcattagggttatgaagattaaaggagtaatacacgtggaggtacctgatcctcaaagttcataaaaatgatacttagtatctagaaaatatgtacacatcttcctccataatactagccaagtagaaggtgtggaatgctaaccaggcctcttctggtgaatatttgcatgcctaccctgtgccagccttgtgccagggctgtgggaagcagcctggtttcgtacatttagtaatccagggaggacacacgtgaacagatgttctcagtggaattggctagtctgccaccaacaggttgttaatcggttattaaaagctgaagagtcctaagaggaatattttgtgaagttgcggtagaaatgggttagctctgggggtcagagcaggacacgtgtgggaaagtgaaatgggaggaagcatttgagctgaggcttgagatggtaggctgccatttggaggaggaaagaggcccatgctgagagaaggtaaacagcaggagacagggctgggggaatggttgagtaagggttgtccagagcaggcagacaactaggggcacaggtgatgaggctggacaggtggacaggggtcagctcgtggagagccacagggagtgacaagaattctaagcag

SEQ ID NO: 15643 - DNA, 13615 bp, Human
agttttgagcagaaacaaaagaatagtgaaaataaaatttacagagataaatgtccttctaatccaatgaaagagcttctcttccaatctttttccaatattattagcctgtctattggcttctgaagtcttatcccctttctaacgtacttcggctttaaggagtttaaaggagtatttccatccagtgaactccctggtggaagatacattttgttattggtgctaatgccctcttccccaaactcagcagataaggccatatcatcccaaagctgtgacctggtctggtttcctgttgatctctttatggggtaccattccaaaatccctaatagcagtgtccagcccaaactgcccacatacctatttgtattctattcttgtgagatacgtagtggccaaagtccagtttctttctgaaggttgtgctttgcctgtgattagagacgataacagggtaggccagataatccagggaattgttcatcttctcttcctagtctcacttcagaaatgaggtacccagactcctctgtgaggtgcctagctgtccccatgacaagctgtcatagttacccagttatgacatcagggacaggtcccgggaagggagtaggagcagcagagcatggctggctgcctctgggcttgtgtttttaatgctaacctcggctcaagtcaagatgaaggtcaaggaactcgaaagctttccccgctgcttagaatgcagatgctgccagccaacaccagaaggaaagaagtggtgcaccgggaggggtgggcaggcacggggtggggtgagggatacagaaattccagccttggttacacatcttgggctatcagctaagtagtctccactgcaatagctcccctgaaggtgcaagaccacaagttttggaggaggagaaagttgaccctaatgataatcggatccaattccttttgcaaatgaggaaactgaagaccacagcagcagcaacgttactcaagaaccaagttggtggcagggctgggctcaggatgtggggttcctgaattcaaggccaaatttgcccttttgcaggaaggaaactgccagtttttcatggcagtaggggagggcagctttcctccagtacagagactatcttttgtacttagtgggagttcaggaaatgctgagtggcttatggtgggctggcatctgctccaggaagggctgcaggagtctgatttatctccaccccagcacagggtatagcacccactgggtgctcaacgcatttgttgatgaaggactaacacctattgagtgctcgccatgcagtgctgggtgccttctttgaatgtcacatttaacccttccagcaaccctagaattaggtaccattactatcccgctttttttttttttccctgcaaacaggctcaggttaagtaattcctcagaattccaaacctgactgcttttaagcacgacgatgactctcaatgaatgttgaaagcagatgcgccccagagtagggcttctcagactttgaccgtagggacctcctggggtccgtaaaatgtccactctgatccagcagggctgggctggggcggggattctgtcaagcgcccgggtggtgcctccactgcagggagccgctcacgagccgaacccggcggtccctgtaatcatgaaagactgaagcgacccctaggtgtacctccgccacgaaatgtttattgggccctgcatttaattcagggaaggaagttaccgcgcttgccagtttacaaagatacacaaacggcctggaccgggatggggcgaggacccctgagactccagggcggtggcgtcttccccccgggacgcgcccaggagtggcgcgcggggcccccgcgtcacggcgcccgcgctccgcagctcccggagcccggcgggcccgccccaggggcgggacggggcggctcccggcgcgagcccccgcccagctgatccgccgctctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtgagtccctttcgcgagcccggccccgccgtccctctcgggacgccccgcccacccgaggctggggtcggggtgtcgcgagtcttgggttgggggagcccgggcgcgatggcccctccgggagccacagcgggggcttgggaggggcctggagtcgacgcctacccccgcgcgtggggccaaggaactggaaccctgcctggccgggcgcggcccttccccgtggcggggtgcacggagcccgggtggcgcctgcccgggtcccagccgccacccgcttggggcttggccttgggcggggtcggggctaccatgttcacttaacaggtgaccctcggtcgcccggccggtctcctgcccgcgcgtcatgtgacagctgcctggttctgcagtgaggtcaccgcggaatgtctgccttcgccgccatggcaacgggccgacgtcacaattcgggcatggaattttcccggcccggcagtcccggatcagggaacctaaacaccccaaatgagcgagtccggggagctgggccgggatttccaggcccccaccttccagatgtgatttgatttacaggagattctagaacggtccagtgataacccccctaaggacctgagccaccacctagaaaaggctcttgacctttcacccccaggctctgtcacccaggctggagtgcaatggcgagatctcggctcactgcaacctctgcctcctgggttcaagcaattctcctgcctcagcctcccgagtagctgggattacaggcgcccgccaccacgcctggctactttttgtatttttagtagagacggggtttcaccatattggccaggctggtctcttggccaggctggtctcaaactcctgacctcatgatccgcccacctcggcctccaaaagtgctgggattacaggcgtgagccaccgcacccggacagtaagagattttttttaatttaaattttaaattttttttctagtaagaatgtctaatcagcaggaaagaaccagtgttaacattctgagatgtgaaataggagcctcaagaaagaatatattagcatgcctgtacagccttggaaagcctcaagttggattttcacgatactctgaggacccagttaccaaaatcctaagcttcatggctcagcccaaggatggcatgttgaaaactcaaaactaaccctcctcccattttacagaggaggaaatggtggctcagagtgtgtgagggactacaaggacagggtcaatgtcttgttcatgtatgtatttcctgacctccgctatgacctgctgtttagcctgccaaggactgccacggaaatgggggtcatcatggaactagaaggggtccatcaggccccagcctcatggggacagttctcatccattccatcattcattcaccagtctgagcacctgctttatgtcaggcactgtacaatgttcattcatagtagagatagtaataatgataattgtaaattttttgaatgttgaattattaatagtattagaggcctggcacgatggctcacgcctgtaatcccagcactttgggaggccgaggcgggtgggtcacctgaggtcagcagttcgagaccagcctgaccaacatggtgaaaccctgtctctactaaaaatacaaaaattagctgggcatggtgcctggcgcctgtgatcccagctactccggaggctgaggcaggagaatcgtttgaacacgggaggtggaggttacagtgagccaagatcgtaccgttgcactccaactgggcaacaagagcgaaactccatctcaaaaaaaaaaagtattagagaagggagatgaatgggagtgactcttcaaagtgtttttttctatcagccactgcttcacagtcttgcgcggtgtcctaagcaggaataaacagagtcccacagtgtcagccaaaggcttcaggaattggaaagctctagagacacccttcctcttgcaccaagcagcaagcaggccttgttagcctcaggaatcccgcttgcttgggcaggttggccattcagctgtcatcacttcccaagtggaaaccaaggttgtacacgtctggtgtagccagagtggcaattgctgatggccactgtagaaaatacatcccttgccctctaagcacctctgaccttgacttggccaggggtgtgggggttcctcaacagggaggatcagtgagcaccaagcaccaagaggatttgggctccattcccttaacaaaatcagggccgcagccacgtcctcacaaggcagagccagagcctgtgtgagccacatgtgccaggccttgggggttttgcagcagatgtgggcatgaggggcagagtgaggtggaagatagagcagggctggatgtcgggagaaaggaggtcttctcccagatctgccaccagcagcacacggggcctgtgcccatccctctgctcatcctgttgggcctgagttcaagctctgttaagcagggatattgccatccttgttcctcacagggctgctcgcagtgggcaagcaagatcacacaggaggtggcattttataaagtataaactgctatttggactgggatgttttgtgagatgaaataaaggggccttttcaccattcagaccaattattatttttattttattttattttatttttcgagacggagtctcactctgtcacccaggctagagtgcaatagcacaatctcagcacactgcaacctccacctcccgggttcaagtgattctcctgtctcagcctctgtaatcccagagtagctgggattacaggcatgtaccaccacacccggctcacttttgtatttttagtagagacggggtttcaccatgttggccaggctggtcccgaactcctgacaggtgatccacctgcctcggcttcccagagtgctgggattacaggtgtgagccactgcacccgaccttagataaattattttgtaacctcccatagttctgttggggccacttactccccaagtactaaatcacccaaaagagctttggaaacgtagccagtggaatgtggcaggtaggatccctctgggggcagggagggggctgcctggtacgtgacaaatttattcttttgcactcattcaccgcttatttattcagcacctactatgtagcaggtactatagcagatggtggggaaacagacttaaagcagacatggttcctctctcaaggagctcacagtctggatgtctaaacacagaagcacaatcaagcattagaatcatagtgctcactaccgtgtccagctctgtcaatggaatagcccatttaatactcataacaacctcaaggagaaggcactgttatccccattttacagagagggaaactgaggcacagaaaggttaaatggcttgcttaaggttgcctggctagtacctgggcaggatgcagacccagttagtctggttccagagcccatctgtaaccagttggctatgtacacccccaccacagcttagggagcatggggccaaatggaatggaggggagacaaacactgcggagggtgtgaaagatgagagggcgcatttctccagagaaggtgggaaagagcattccagacagaggggacagcatggctatgaaaccaccagtctatttggggaagctgctggcaattcgatatggccagagtgagggaagaggtcataagatgaggcaggagaagctggcaggggccagagcatggagggtttccttgctttgctaagaggcttaaatccttctccatcttcctccccctggggctgccatttggttggttaatcatccccaccactgtctcctgtccaggtctgtggctcaggacatccccaagctgcagaaactaggcatcacccatgtgctgaacgcggctgagggcaggtccttcatgcacgtcaacaccaatgccaacttctacaaggactccggcatcacatacctgggcatcaaggccaacgacacacaggagttcaacctcagcgcttactttgaaagggctgccgacttcattgaccaggctttggctcaaaagaatggtaagggacctcccaccaggaaaagatgggaggcagctctgactggactgtccctctggaaaacaggcccacaacaggtctcttcttagaaactcccttgtttcccatcttctggggtgaacgacagagctgtaggtctctctctgctcacctggctggctgtcaagtggccccgtgtgtcacaggatgtgcaactcattcacaccatggcagccccagggtcctcgcgtttgactgcactttggctggaggttggtttccagttgcttacacgtcccccattcaaacagctgtaacgatgaggaagatgtgttaatgtgttaatgtgcatggcaagaagtcctgaggtgaaggagcatgggggctggttgattaaggggctgcttgattcagcagctccatggtggcctctggaccaggccctttccctttctctcttctgccacctcagtgttgggtgctcccgtcatggtcccaagatgggatccagtcaccacatccaagcaggacaaagtacagcagatgaggccctgcagccatctcttcccactcttttttttcctcttctctctctccttttttttttttttttttttttttagatggagtttcactcttgttgcccaggctgaagagcaatggcgcgatcttggctcaccgcaacctccacctcccaggttcaagcgattctcctgcctcagcctcccgcctcagcctcccaagtagctgggattacaggcatgcgcccccacgcctggctaattttgtatttttagtagagatggggtttcaccatgttggtcaggctggtctccaactcctgacctcaggtgatccgcctccctctgcctcccaaagtgctgggattacaggcatgagccaccgcgcctggccactctctctctcttttttaaagagacagggtcttgctatgttgtctagactggtctccaactcctgggctcaagcagtcctctcacctcagcctcctgagtagctgggactacaagcacgtgccaccatgcccagtctctctctttaagaacaagtaaaacatttcccagaaatacccctcacatctcattggctagagattcacgtgattgcctggcaaggagaaaaggggtagctgcggtcagcttaggttggcagtcagcaaaccacagcccccctggccaaatcttccagccacttacgaaacacttcctgcagcccccaaatataagataagactgaaggagaactaccaaggcgctggcagtcaccaaggcattccagcaagaaaccctagaaggccacaaagcagacatcagctgagcaggctgggccacttgccctttctccctttctgcttttagctgtttctctcagctcctccctttacctcttcgtctctccccaccccaaaccctcccagcggaggggacccccatgaggtgtgaacagccttggctgtactacactgatgactcttgggcccagcaggctcactgtctgaatgatttccagtaaacagaattttctagaccactggacagtgaacgctcagggctcagagagaagctttactgtggagtatctgcagactttgctgacaggcccctcatggtccttcctggtcactgtcaccccccaaccctgctcacctcctccactccagctgtactgagttcctcaccctgtgtaaacataggctgggcgaaggggaaggattttgttgttctcgtataatagcaattggttattcattcagggaatttcaagctctctgactttgtttcctctttccaaacaactaggaacacgccctttttttgacctgtctcagtccaggtgtgctgggtctttagtctgaaaagttctctctgcctctccctaccccttcctctggcaaactccaccttgtccttggcatggtgtcctctcttccatgaagcctgccctcaggctgggtctactttgttccttgtctgtctccttagcacctgatgtagcatcaggcacatagtaggtacactgcaaatgatgaatgagcaagtgatgaagaattccatgggctctaatgccaagtataaatgcttctaagaatgagtggcgaagtgagtcaacagaaacatgctggcctccaacagtgtgtggggcccagggacccatcactgagagctgggtgggatggctgagggtactcaagagggagcagtcacttctagctgggaaaacagcttcatggaggaggtggcatctgggctgagcctagaggaatgggaggttgaactggcccctttcccagtaggctctgtgtgcactgggcatgcagagtatgttctagatggtaaggtggctgctctgcagagggtctcattcctagggtggggcaggggaagccccactctgaatatttcgggcatacaggccggagggtgaatgggcaagaaagtggaggactcctgcttcctgatttggaaggcattgggaaaatagagtggtgttttgggggtagggtgataggagcagaagagactctgttggactctgggctagcagattccttgccaaacaatggccttatagaggtgttagtaggtaataattcactcagctagtcagcaaatatttattgagcacatagtgtatgctagagattgtaacgcatccaaaaatcaatgccccacatttcttgcctttttttttttttttttttgagacggagtctcgctcttgtcacccaggctggagtacagtggctcaatctcagctcactgcaccctccacctcccaggttcaagtgattctcctgcctcagctttctgagtagctgggattacaggcatgtgccaccatgcccagctaattttttgtatttttagtagaaacggggtttcgccatgttggccaggatggtctcgaactcctgacttcaggggatccgcccacctcgacctcccaaagtgttgggattataggtgtgagccaccgtgtccggccatttcttgctcttaaagaattcgtcctctgggagagaaaagtcaatctgcgcatgtctggcaatgacacaggaccagggctgctgtagttgagggtgtactaggtgctaccagaggatgcccagtattgggtaacatttattgagtgcacatggatgccaggtgctaacctagaggattcatgtgtcctctcctttaatctaaccaccttgtgcaatgggtactattggccagataagaaaactgaggcaccttgaggttaggtggatcatgagttaataaccagtgtattggtcaggattctctagaaaaaacagaaccaatagaatatacagtcggtcctccatatccgtgggttccacatctgtggattcaactaacctcagtctgaaaaatattaaaaacaacataaaaagatgttatgtctgtactgaacatgtacagattttttttcttgtcattattctctagatgatataatctaataaatgtttacattgtcttgggtatcataagtcatctggagatgatttaaagtataggggaggatgtgctgtgcagaggttatttgcatatatgatgtcattttataatcagggacttgagcatctgtggatttgggtatcggcaggaggtcctggagccaatctgccctgtggatattgagagatggtgtctatttatatatatatatatacacacacatacacacacacacacacacacacacatatatatacacgcacacacacactatattaaaataaccccatctctactaaaagatacaaaaaaattagctgggcatggtggcatgcgcctgtagtcccagctactcaggaggctgaggcaggagaattgcttgaacccgggaggcggaggctgaagtgagccgagatcgcgccactgcactccagcctgggcaacaagaaggaaactccatctcaaaaaaaaagaaacaaaacactaccagcaccctggaaagcacccccagtctctatgctccaccacccccatccccagctcccagggcctctgccacgcgggcttctttttttttttgagacagagtctcgctctgtcacccaggctggagcacaatctcagcacaatctcacctcaccgcaacctctgcctcctgggttcaagcaattctctggcctcagcctcctgagtagctgggattataggctcgcgccaccacacccagctatttttttgtatctttagtaaagacgggatttcactatgttggccagtctggtctcgaactcctgaccttgtgatccagttgccttggcctcccaaagtgctgggattacaggcgtgagccactgtgcccagccccttgcaggcttctgacagcacagatggttttgcccgctttcctactctgtgggctcatccacctcatatgtgtgtgctgcctccgtgttgcttctgctaagtggcagtctggtcattctttgtatttgtcctttctactgtggatgggcctttgggggtttctaactgtgggccatgatgtgcagtgttgcctgtgaacattctggcccatgttcgtgaatgtgaatgcgtatctctattggacctgggcctgggagtgggattgctgggccagaggggatgcacgtgttcagcttgaggagataccgccgtgccgcacagctttccaaagtggttgtgccaattcacgcctcacctcccccagccacgcagaagagttccagttgccccatatcttcaccagcactttgggttttccatccttttcattttagccattctgacaggcacacagtggcgtgacattgtgcttttaagtggcacttcacggaagagtcttgaccaacgccatggtgtgatgggacgcccccagctcaccacgtctcccctgtttcttacaggccgggtgctcgtccactgccgggaaggttatagccgctccccaacgctagttatcgcctacctcatgatgcggcagaagatggacgtcaagtctgccctgagcatcgtgaggcagaaccgtgagatcggccccaacgatggcttcctggcccagctctgccagctcaatgacagactagccaaggaggggaagttgaaaccctagggcacccccaccgcctctgctcgagaggtccgtgggggaggccgtgggcaaaggtgtcccgagctgccatgtttaggaaacacactgtaccctgctcccagcatcacaaggcacttgtctacaagtgtgtcccaacacagtcctgggccactttccccaccctggggagcacataaagaagcttgccaaggggggcgtccttgctccccagttgtcctgtttctgtaacttatgatgtcttttccctgagatgggggctcagagggggaaggcctgtggcctgcatgcttcccgatggcccacggcaggaggtgtgtggaagtgtaaggcctaagatgctcacagaggtccctcatgacctcccttccccaactcccgaatcctctcttgagtgtggacctcaacaccttgagccctagtaaaggaactatgcaaatgcaggccactctccccaccacgtctgtgccccgcactgtccccacagccttccacaccctgtgcataggcagccctctcacgtcttgaggtccgaagctggggtgggggtgtccgtcagttattagtggatggagattcccacagcaaggctgcatttgaatgatttccttaggatgaatggtccctacacaaagaggccttgtgggcaaacctggagaaccctcctaaatccatagagttttcaaaatgtgaatctttggaagccttgagttcagaatctgctgctctggaatatttcccttcgatcttatctcagtcacttcgtttttgagaagagtgatgccttgggcatgcttttttttttttcttttttagaaaacagggagttgaagtccaacctatttaaaaaccccaccatttggagaattacaagggttttgtcctgaattgtagtgttggcaagcccaagccactcgtgctaactgctttttgtctcggttgctattccaagaacagaaggaggaagttggccaattacagcgtgtgtgcatggatgtgtgtggggggcgtgcctctcagaaacgcggccagaagacaagcagggaagtgaaaggtcccaggcacacaccctgcccattgcaggtggctcttacagctctctggtgccagcacgggatccctgaagtgactcagccaggcagacatgagacatggcggagtgtccaaatggatcctttattggtggtagagcaaaaaaacccaaacacgataaacctttcaaaagactttctaaggatgatattggaatgcaccagccctcacatgtgtatgcacatttgccagaatataagagttttgttttaaatacagtcttgttaggattttacgttattgttattatggaaagtgattgtgatgctatttatcttcagggtcactctgggcaaagagaaggtcctcagccatgcccccagcaccttgcacataggtgtctgataaaagtttaagaaagtaaacactttttgagcaccaaatatatatagggcattgttctggtgggtgtgtcacgctcccagaagactgaattcatggtaggatcactcgcaaggccttgtgaaggagtcttacctaaaacgaaagaaatatcagggacttttgttgactatttacaactcagttttacatttaaattcaggcagtgttaatatgccaaggtagggaatgtgcctttttcagagttggccaggagctcctggctgggacacggagaggcaggtgtggcgtaaggcctcactcccggctgggaaggtctctgatcacacagaagcagccctgcccagcctggtcatttgctgtccgcttttctctgtgaccacagcagccctgaacaaccagtatgtgtcttcttctccagatagtgaaaaaggtgtccagataaacccacctaagtgaaatggccatcctctaaactgggtacctcactgcacagcttctaggtagccttccaacttaatctaacttgagcctcacagtaaccctgtaaagttagtagagcttgttcttgtattgtgaccttttttaaaaaaaaggaactgaggttcagaatgattaagggcctggcccccagggttgtccagctccataaggtggagctgggcaagattttgggtttgctgctccctgaagctggattctttcatacgatactctttctcaagaagggggctccctgggatctccaggtgtactgcacttaccctcaatccagccccggagaagcaagtgaaaagggtgggtccctcataggctagaatgtgcagctctttctccaggtgggat

SEQ ID NO: 15644 - DNA, 15695 bp, Human
gctgtgggcgccccccgagcctccccggacgccgggggcacctccgggcaccctctccgcggccgcacctcggccctccctcgccggcgaagcctgctagttcccccgcgggtctggcgaggtcgctctcggcgcccgcccgcccgcctaggctccgagccccgccgccatccgggcggctgcgtgtctccctgccccggcccccccccccttccccggcggcggcagcagcagcagcagcagccgccgccgccgccagcaccaccaccaccacccccctcccctccttccttccctccgcctcggccgcccgggtccccccagctcccgcccctcctcccagctgccccccgcggagcccgcccgggcaggctgtgggagggagcggagccggcgaggcgggcgggctggcgctcgctccccgggggtcggtgtgcgctctacggggaaggacgcgctcgctgccccgcttctcccgccccccctcccgctcctcctcctcccttctccctcctcctccccgctccggcggctgaggctgcggcggcggcggggggtgtgcgagctgaggccggggccggcggcgggcgggctgcctgcaggcggagggcgctgtgctttgtgcttttcgccgcgaggagcagcaggcagcagccacagccgccgccgccgccgccgccgccacagcagcagcagccgccgccccagcgccgccgcctcgcccggaggaggagccgctgccgccgcgggagggagctgcggctgtgcccggccgagcgggggagggcgccgccactcagagccagggagggagccgctggagcgggaagcccggaggccgcgctgcgccgggtaaccgaggcggctgaggacgcgcgctggggtcggggccggacggcgggagcgaaccgcggggtgcggtgggcgcccagcggggacccgaagcgaccaccgagcaggcgaccgggcgcgagcagaccagggcacttgggaggacgccgagagccgggggaggggaaggcaggaagcgaggcctgagccgagccccggccgctggcggaggagcccgcgcttctcggagccggcaggcgcagttctccccggccgccggagggggcggcggggccggtgagcgctgcgcccccgcctcccggccgccgtcctcccgccctctccttggctcggctccccggaggccggggcgggggcgccggcggggctgggccgcaggctcgggggaggaggcggcggttcccgccgcggtcgcgcctctgtgccgggctcctccgtgcgcgtcggggtggctgggcggtggcggcgcctctggccggggtgggtggctcgggggcggggggcaggctaggccgcttctctccggctgcttgcccgcctgtgcgggcggggacggcgaagggagcccgggaggggggagcggcgggaatccggatccggtccccgggggcggtgcggccgctccgctccggggctggcggcggctgcgctgcgtccgggtccccgccgggttgcggaggcggggggaaccggccggggggaggcgggaggaggagactggggcgcgtgcccgcttccgtggccgcgcgcgccctttacccgcccttcctcttcccccgccctccagcctggggcctccccggggcgggcgctccgaggaggaggagattttttctttttttttttttttggctggggttgggaagcggggcggagggcgggcgctcgctgcacgcgggagctaggagcaggccctcgcgtggccaggggagggcgcgcgccgcggagccgggctgcaggggctgggggagggggtcacgaggaagaggaggggcgcactcccattcccatagaccccttaagtctaataaggtcatggctgagtctctcagagtgtggacctgcccccttctactctgggcggttagaaagtcgttagtcgttcacctctcagccttcctgagtgggaactggtatgtcttccaaagggtgaggtggctttgaccccgggttgcccggccagcacgaccgaggaggtggctggacagctggaggatgaacggagaagccgactgccccacagacctggaaatggccgcccccaaaggccaaggtaggggcatccacccccggccctctgaaacttaaaccctctttccctcgtggctgcggggctcactcccttcttcaagggctttttcagtctgcatacactgaactgggggagaaagtgccttgagtatttatgaatcaagcatctcccacacttggggtttggctgaatccaaattatttggcctggagtggctcacctcccctctctccctgtccctcaccctctgtgttagaggaggcctgccttctggggttcccattcagcctgaagtgtgtcccagcccagtgtcctggaatgggaggaaggatgagtgtagaggaagggtcaggaaggggttggggaaggcttctcaggctttttaggaagaccatgaggcttttgtagaggcaggtggagaaaagggctgttttggtggttttaggccccaagccatgggatatatgtactcaactagatctctgcctcattcagcagtgatccagtctagatggggatagagagtaggatgaagctggacagctggccatgcttgtgggacattgaggggagaggggattatgggtccacgtggcccattctgcagaatctctggcccaggttaccagatgcaaatgaaaatggagagcccttttgacttctggccttgggtggctattctcccagcccatccacagtggcctagagctctctggggctgcatttcagtggctgaaaaataactgttccagacctgttcttgcttccctgggtagttgggctgacaagacagcttgtaattctgggggttctccctggagcagggccctgagagtttttgtgcacctgcctaccttgcctcagagctgccctgtatcctgcttctgcttctgtttcctttttcttatttgccagaaattctcccttgatctgctttaaggggctagggggtggtgggtgtctctaacattggtttccagctgtgcaggagagacatctgcatggattttccttactgtccacaccccattctcagtcgttgcacatttagaatatccactcagaacttgaacttggcagcacatttagatatattgcctccctgcttccctccttctctgacaagctacctcgtttcccacaaagccctgaatcactgtaccttcatttccacccctcttccccttacagcaaatagctgcccgttgcagcttggcacagtagaaatgataatagccttgaagcaagccagacttgagttcgagcctggctttctaggtatagcatggtctggactggagtccctgccctgatccaatatggccacagtttccttagggctgagtcatatcttgtctgtgcgttcagatgggaagcaaccaggggctgggatgccctagggaggaagagttgagcactcaagaactggggaacagatcggggggatagcatgagccaggcatgatggcctctgttactctttaccagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtaactgatcccccttttctgacatacacacataccccccactcagcgtggtgggggaagtgaaacaggctgtaaacaggaaggaaagagaccaggagaggcattcatgtggtctcccgttagctctctacctgcccctttgcattttgggaggtggcacggttgacagcactggcttaaagttatgccactttctatctgagtggtcttgagccaaacagcctgagctgtgctgagattgacggaggtgctagcatgctgagattgacggaggtgttagcatggacaaccaggttgaggtcagttagtccccttgttgctggcctttggtgtgtactgactgcctgggcctctgcggtaggcatgggccagtgcctgggtgtcatgctgcctgcttcatttggctgttggcctctgctcttctttggtaaatttagtctagtaaagagtagaagagacccgttataagatgggggtatactactgtgtggcattttccttttcccaacttccccttcctcccacccctcttcctccaggtgaggaagttccgtacattgacagaattgatcctcgatgctcaggaacatgttaaaaatccttacaaaggcaaaaaactcaaggtgagttactaggaggaggagcatgaggggtatgggaggaaaggtccaaagaagggatgtatttgacctccattgtgtccttgtcccttcttccagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaaggtggggggaggagagttaaggtgggaggaggggagaggctgggagcagctggtgtggtgtgggtcagttggaggtaggccttggagaaacctggcatcagggatgagggtgagtcagcacagcagaataggtcctgggcagccacacctgattgccccttcctcggcccacacatggtcaggcacaggcaccatcacagatgtaaaccagacagcaggtgctcagaccaacctttccccctacagaaaacccacagcattctgtttcaagctctctctcccccatacacccatcctcactgttaggctccgcagcacttcttcaccctctatgacgtttcccgtcatggtctcatttgatacttgcaatgtctttataaaggtaaccctaggaaaaggttatcccagttttgtgggcaaggaactgaggtgcaggagggttaagtgtcccgggtgacacaactattgatgctagagcaggatttagtgccccagagtcccagtccagtgctgttactgccacgtccacctgtgaagtgcacttcccacgcacacgtgttcactcaaggacacacattgtccctcctggcctcatactgttccttgcagaggtcgggcactgtcccagaccatcaaagcattaactctgggtggagggttgcctaagcctcccaggcagggctcagtcacagagctcaggaggtccctcccagagataggcagcaaaacattggaggagcctgcagatgggacacgaggaagatgggatggggacagaggacacaaagaagagacacgggacaaggagacagagccagggatagatggggaagggcagcaggaaagacaagaagcacatctgcttggagaggaaacaaagtcatacacagccagttctcaaaagggggcactggccgctgccatgctatgagtagccctttttcctggttggcataccctggctgcagactcacatgcccttggtgctgtacccaaaaaagaagccagctgtctgcaaccactgcccaagcagagaggggtatggattgctggaactgttgacccctttgatgaggatgttggacagttgactgcacacacccaaacactctcatgggatgggagggagaggccaagctctagagtcagagccagggaaggccagaagaaactggtagagtggacaaggtgctgtcctgggggacacaagacttgggcctgttctcctggctctgccactgaaccgctgtgtatggggcctttggtaagtcatttcacttctgtgggcctggtctttatgtgaggtgagccaggtctgtgtggtccccttcaggtctaaaactgttttgtctgaggaggactgagatgggggaagaggaggctgagctctgcttctggttttctgtgggaactgtgggaaaggagcactgcctttctatgcctggtgcttctataagaggcaggggttgggctcagttgccatgagctcctggcacctgccagtgccactcttgtgagcccgcgaggatgaaagaagagatggacattgtgtgggagccaagagagaaggtcgatgaggaagagaaagagacacattggaaaggaggaacaagaaggagactatggagaagtggggaaagatgcagggagggagtgaggtgagagtggggaggctaaaaagggggtgatgaagggaagggaagccaagtggtgggaaagaatgagtgggctgagggagggagggctggaggggccagacagccaggatcctggagaaagagaagaaggtgatggtgtgagaactgggcaggaagatgcagggtagctggctgagacttgtattggaagaactcgctctgggttcccctccacacaatctcccctcatgccttggaaacaggactcagcccagccctggccatagatgtagaggctacgtacaaggggacagactaatgtcagctgccacagacagtgagaagagggagtgacaggagcaaggcctgcacccgacgccactgtgagagttctatggtgttggagaaacgagtgggggaggctcagcgctgccactgcgcactgtgtgaccgtgggtaatgccatggcccccttctgggactcttgctcagaaggagagaataggatgtaggattcagtgtctgggcgacccctgcagctcccaccatctgtggtagaagccagcaggtctgctctgtggtgagtcccgccaggaggcgggcagggcgccagcctccactccctgcatcacagcgtgggaggcagaagagccagcgaggaggggtctgggtggccttcatagctcagggtgagatacccttgggtcctgagtgaccccatcccctcctccccccagatgaaatatattcaggacttccagagagagaaacaggagttcgagcgaaacctggcccgattcaggtaaggcagtggagcccagaggagggccacggggcactgggggcagcagaataggctaaccctggccagagccttgagtttgccatctctgaggcatggaagaggatgggtcacatgtgagccctagtgtgtcatgctcagggacagagacaggcaggcagccaccgtcccactgagccccagctgaaaggcccaggaggcttggtgggtggggcagctagcttgagtctgccctggcagcgtcccctgctgatccttgctccccgtgtcctggctagggaggatcaccccgacctaatccagaatgccaagaaatcggacatcccagagaagcccaaaaccccccagcagctgtggtacacccacgagaagaaggtgtatctcaaagtgcggccagatgtgagtgtccggccaagggttgggggtggaggatgcacggcggtggccaggggggagccgcgccaggtcggccgggcacggtgcaggggagcaggagaggaggcccctccccaggggtgggctgcatggacagggcccgggccagctggcgtgcaagcgtgtgcgtgtgtgtgtgcgtgtatgagccagtccccttgcacccaggcgggatccccgcctctccgccttcccctcctggcctgtgggggacactgatgtgacctcccatggcctgagggggcgggggcctctgtgcccccttcccccttcccccctccccctgcccctggctgcctgtgcgtgtctgacggcttttggtttgcaggccactacgaaggaggtgaaggactccctggggaagcagtggtctcagctctcggacaaaaagaggctgaaatggattcataaggccctggagcagcggaaggagtacgaggttaggcttccgctgcgctcctccccgtccggctcttcacgagcctctgccctccgactccgtggccaccgcactctgcgggaggtgtcactccccatccctctgttgagggaggggccttctgggcccctcacctctgcccctaccttccccaccccccacccccatgagatctcaggctagggcagggcagggcaccacgtctcgtgtgacaccactgacgcgcagccacccccagctttgctccctgcctgccctccccagcggctctccccctgcccctgccctagctaactccacaccccattgccctccgtccccccacctggctctgcaggagatcatgagagactatatccagaagcacccagagctgaacatcagtgaggagggtatcaccaagtccaccctcaccaaggccgaacgccagctcaaggacaagtttgacgggcgacccaccaagccacctccgtgagcgctgccctgggatgggtgggcgagtgggcagctgggaagttgggctgggctctgcaggtgagaaggcctgctgccctgctcgcttacgggctgcacctctctccccgcggctctgataggaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcaggtgagctgtggcaggggccaccctgccttggggttttgaagcatgaggtctgatcccatcttgggccagtcagtccctggtggcgtgtgccttgggtacctgcctccaatacagtgtggggctgggctgggcttagcaactgagcccgtccaggcagggagtccagcccacacccaggctctggaggcccgctgaaggtcactgtcctccgagtactgcagggtctgtggtgacactgtctccagactgatcctgactccactcactttcccagaaaaagaaagattacgaggtggagctgctccgtttcctcgaggtgagtgttcctccggtggggcagtgggcagagaagactgggacttggcaggcagagccctggtgagcccctggagatagggcaccatgcagtctgggtgccaggcatgcagccccgtgctcctctttcctgtccagagcctgcctgaggaggagcagcagcgggtcttgggggaagagaagatgctgaacatcaacaagaagcaggccaccagccccgcctccaagaagccagcccaggaagggggcaaggtgggcagagggtgcggccgcgcaggcgggggtgggcaagactgggctccctggcagcacccacggaccccgaccctctgcacctggacagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggtcaggctgcctggcggagcgctgtgcccccaggggggctgccagggccccctcttccccttggcgggccgtgccacctcgcccctggccgcctgagccacgcggtgcctgggctgggacgtggggccggcgcccagcagccggaaggcgggaagctgtcagctgagcgccgcagaccaggcgggggcgagccccaggcgggagacatctgcaccagcccatgcttctgcccgccggcgggagcgcctgggctgctgcgcggggagcgcgcgccccctgggggtgggtggaaggctgacgcccgggccatccccgcaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaaggtgacaggggtgggaaagggtagtactgcagcctctagccccgggtgacccctcccacggctgatacccttattggtccccagaatgaccgggtgaaggccttgaaagccatggaaatgacctggaataacatggaaaagaaggagaaactgatgtggattaagaaggcagccgaagaccaaaagcgatatgaggtaggaatggggctggggccaccccattcattgaaagctcgggaactcccctttggttgggcagctctgagcaagaagtcccagccttggtctgtgactctcagcaagtctcagcttccttctctgaacctctgtctctcatcagtaaggtgggggtgacattgctaacctccaggctgactcggaggatgcgagcagttgtgaaagcacttgtaaactgtggtgcctgcctcagacgtgagctgttaggaagttgctcactagctacctgtttctcctcctccctggcacagaaaaagacagccagctaaggtgctgatggcatgaggcagaaggcagcagtattttgggggtgggactggggggtgagcgtgacctttctccctccagagagagctgagtgagatgcgggcacctccagctgctacaaattcttccaagaagatgaaattccagggagaacccaagaagcctcccatgtgagcctgggggttggagtctgccctggaggtcggggagggtcagggctggatggctgctttgttggggtcctgaccctccttctaccaacccacctcccaggaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaaggtgagagggcaagggacccttggaaggaacagagaggcatcagactaagccagcaccatcctagcctggcccatccacccacttgtgctggctggtctcattcatgatttcattccatgccctcgcaatccttcaggataacggtcactatcacccttttatttttattttttttttttattttttgagacagtcttgctctcctgcccaggctggagtacagtggtgtagtctcggctcactgcaacctccacctcccaggttcaagcgattctccttccacagcctccagagtagctggggctacagacatgtaccaccacacctggctaatttttgtatttttagtagagatgggcaggctggtctcgaactcctgacctcatgtgatccgcccacctcggcctcccaaagcactgggactacaggcttgagccaccgtccgcagccactatcacccttttaaaaataaggaaaccaaggctcagagaggttaagtaacttgcccaaggtcacacagtaagtagaagaatccaaatcagactgccttttcctcccccatctgggaccacgggacctctcctagactcctggcctttgtgcttcccctctgtgctttggttgagtagtcagatctgtaaagtggagagaatcacctgtgtccttcccactcaccaaggcaggttggccaaggacccaggaagactgtggggatttgctgtttcaggagtttggtgagccccactgcctcatcgatggctcaagggtttggtgttggggtgtggttgatgatgccaggctgactcatcacgggggcacttctttggagtgaggaagactgataggagcttccatttgcgaaaagcaacagggaaaatgtgaaaaccaatagtcttagtggtttagagaaggactctgggtatcagaagcagaaatactagggtttgggccagcgcagtggctcacgcctgtaatcctggcactttgggagcccaaggtatgaaggatcacttgaggccaggagttcaagaccatcctgggcaacatagtgagattgctgtctctacaaaaaattataaggtagcatggtgtggtggcacatgcctgtagtcccagctactctggaggctgagttggaaggatcacttgagcctgggaaggtcaaggctgcagtgagctgagattgtgccactgcactccagcctgggtgacagagcaagaccctgtttcaaaaaaaaaaaaaaaaaattagagctgtgttctcagatcccaggggctctctgcagagacccaaaatctagggagcctgggaggggtaagatggggtgatgatatataaatgctcagcccactgcctagcactgggccagcatgctcagtcagcagtagttggctatgttccaacccttgccgcttctgtctcccccagagcctgtctccccaggaccgtgcagcatataaagagtacatctccaatgtgagtctgggagcagagcagcagtggggtaggggtgggggaattcaggggtgtcgaactcatggctgccacctttgtgtccccatcctgcagaaacgtaagagcatgaccaagctgcgaggcccaaaccccaaatccagccggactactctgcagtccaagtcggtaaggagcccctcccagatgcaggggcgtggggcggggggcactgcctggaatggttgggcagagaccagagaccactgatgtgcctccatccctccaaggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgaggtggggcagacagggcacagtgggaggggaggggagtcctgccaggagggccacctggtgactccacatcctttctcaccccccagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttatttttttgttgactaaatttggggggttcttttttatggtcatgtcactgacctattaaattggggcttggtgcttttccaccttccccctctgaatgaaagccaaggaatgggggaagagcgggaactctgccacggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtttgactgctgtctggtcactggaatcaatgaaggttcacaggggtgacccaacaggtttgatctataaaaatgcttgaagccaatttgccttttcttcctagaactatcttcctcttccctaaagattccataggcaacctaccttcacattgttctgtgctactgttcttgcccttttctcaattccatttgttcaccttgggttgtgagaccactaaagattctgagaagttggagaacaaatgcattttcacccaaagtacatggtcttggggaattggaggtgatgagctactagggtcaagggttcgccctgggcatgcaagccttcctagtgtagggcttatcgtggggagttgagggagcacgctctcactttgagccttcagctccatcccaggttaaaggttaagggttaaggatgactttcctaggaccatcta

SEQ ID NO: 15645 - DNA, 13261 bp, Human
acacttaagaatggttaagataggccgggcgtggtggctcacgcctgtaatcccagcactttgggaggccaaggcaggtggatcacctgaggtcgggagtttgagaccagcctgactgacatggtgaaaccctgtctttagtaaaaatacaaaaattaaccaggcgtggtggtgcatgcctgtaatcccagctacttgggaggctgaggcaggagaatcacttgaacccgacaggtggaggttgtagtgagccgagatcactctggcctggacgacagagtgagactctgtctcaaaaacaacaacaacaacaacaacaacaacaaaataaaccccaaaagaacatcatgtgccctcatttggagaaagagcaaaaaaacccatcatgactgcccctggcaaactggaggcaggagaatggtaagagggacttctacacgtgaggcaagagcaagatgatggaggagggactgaaaagaccaaggttatactaacatcggaatgtgttaatatgctaaaaaattggaaagatacagagaagattagcatggccactgtgcaaggatgacacacaaaaaataattgaaaaaaaaaagtaaaaaataaaaagaccaaggttgaggtcccagaagccaagaattgaggctgaggctgcgtaaatgtaagatcccatgctaggagtcaggatctctcaccagtctccagggtgtcagacaaggctctttcatctcctcttcctccacctgtggtgacagagggtccctgcctgctgaccattttcagatgtgggtgcaaatctgaatcaatgtagagacatcagcaatccactggcagagcatcaggtgaattgagcaggtaggcagagttggagaataggtgtgagtgagtcctgggagggatgttcctaagggcagatggagaaattgggtagaggccctttaataaacacagaaaggctttatgtaggagttgcggattccagcaggtgaaggggaaccctccccccaccccgccccgaaaatcctggaacaggttgaatagaggaacggagcaggtgggagcagggacgtgagaggaataggaggccaagggcggtgggaaaccagactatgccttcatttccccccacccccggggagaagctgcaaccagttttacaggacactcctggccttgcccgagatcaatgaccccattcagagagggttgatggcacaacgcggcaatgccggcagccaaggggttaaccttaggccagctggctctggggtggtgcgagggggtgggccgccacaccctccggttgccttggcaccattgtaggcgcctgctctgctgctgggaacctccgcagagcccaaggcccttcgttgccagtctgctccccactctctgtcccaagtggttccaggcgctgagcccttaggcttcgtctggattcccatcctccaccccaggagaggttggctcggcctggctggtgcaggcgggtccagcccaggcacagacatgcagatgcgcagtctctagggctgctccttagcctcctgggttagcagccgggagccatctgcgctttctcgccgagaaagccgaggctgaacggatagggggcagggaggggacgggggtggggggtgggggtcccggaggtgaagacctcctttcccctggcggcagggggagatcagagacaccacggagcacaggtcagaaacaagggagtagagaggtcggagccagagactcgaggcgaggcgaggcgaggaggagcgaggagtctcgggcccagagtgtgggggtggagggcaggccccctgctcctccttccaatctctgcttctcccgggtaccccctccgccctccgtggggcccgggctctgcccctcccctcagaccctgcaccctctgcggattggtcctcggcctgctggggggcggggcccgagggccctgacgtcactggccgaggggggcgggcggctggaggagggggtgacggggccccggctcagcacctcggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggtgggcaccgctagtgggcgggggctggggtggtgagggagaggggttggggtggactgcggaaacccggactgagcgctgccgcggagaaaagggaggggagaaaagggtcgagaataatgcgtccactgtccctcccaggcccagaacccagagggaggctgcagtctggtccctacccttctaggccaagccaagcctatgcccgggcctgggcctggggggtgaggggtgtttaattggtactgtagcttcctgtgagaaccaggaagtgacactgtgtgagggggaagggggtggggatggctggctcccttgctgggaatggggcaggatggacagaggggaccccgtggggggatgaatgccctccaagcataccctcattgacacccatgtcaaactgacctctctggggtggggttctccaatgctcagattctggagcagggatgggcagggtcaattgggcatggggtcagagcccatgaatccttccagggaagggtgaggggcaccacccaagacgtgggaaggaccaagagcctgggttccaggttcaaggggagaagatcgggaggacagggccactggtctctgagggtggaacggttgcagggttgggaagattctccgtgattgcggggcccaggaagtgatcctgttcacttcaacctgcagtgactcaccctccctgccctgccctgtcccaaaaccagggcatggccagctgctcagccactccccctgcagcccacacctgcactctcctctggtgctgggatcccctgtcagctgcaacctcccctggcccccatgcctatcaggtgttgccccctcagtgcagggtgctcctgggggcagggctcactcttccctcgccagccccacctgcctgccacataggcctcagctctgctgaagcccacctgatgccctgaggcccactagtgcccacctgatgccctggctcctggctcccatagctccttcccggttcctgggcacgcactccaccacactgcatctgtctcccagcactagtgcccagcacagtgctgtgcacatcagacctctgcagaaatgcctggaactttaaggaaggagagagtgtagcaatggcccagcccacagtgcagggcactgcctttaccctcatttcccccaacccctgccagtgtgttataaaacaaagatttctgtccttggggccagaaggtcctaggttcaagctcttactccatcagctttagctgcgccaccttggggaggtctcttaaccactctgggccttgggtgccccatcatccccattttagatgtcacagccacaccaaagaatgaaaatggcaccatccatgtaggagcctagctcagtgtctggcacacagaaagagccctgtcctaatgacgctcttcctgtccctctctgctgtctacctgctaggttcctctttttctcttgcctgccaaggtagctgagcctcttgagtacatggggggaatgagggaactctccttgacataggccagagaaggagaagttgaagggctgaaggtggtttagagctgggagggaaggatagagttttggggggtcagggacataacaaaggctcagtaacccccaggcccctactgcctcatcactgtcacatggtttgcctccagctcccagaacagctccctttagcaggccatgggctcccctgggccctggcctccctgtctccatggtaacctgcagcagccactgcatctcctatcagggagcacaccacagggctcccgggggcaatgaccacctctgcggcacccctgaggacagataccatatggctgccatgctgaacccagtccaggccccatcatggtctgacccagatgaccaggggaaatcaagctggcaggagggtgcgcatagtgaagctggaataatgccccaaacacaggctggctctcagcagggccagccttcccagccacgaccccgctcctcaccatccctgcccagcggccctaggcacctaccttctcccaaccctgcctgggctctcaaccaaaatgtaatgaggcaggtacgattgttcccatttgcatttgacaagaagggactcacagaggggcccaaggccacgtgagtgccacagggaaacaggatttgaatccagcaggctgcctccctctagtgcaaccccaagactgacctggctctgatctcaaggcagttcaactccaagttcaaaaggaagggggacgagggctcagctgtgcaattggcctgagagcctcagaggtcagtggtccaaggctggagacttgcagagtagaggacaaagggcggtggagcaggggctgctccaggccttggtcatcacaacagctgccaggaggccacagatgtagcagaaagagcagaagcttcagaatcagaatcagacatacctgcttgactactcataagccatgtgactccgaacagatcagtcaacctcttggaccatcaatttctttacctgtaaaatggggatgagagtaatactaagaggacctacctttcagggctgagcatgggtaagggaatgcatgcaaagtactgtgcttgccacattatagggcttgataaatataagaagaaaaggacatttccaagcagctcccatttccctggacaccccgcccctgctctgccacccacagcagggaaatcatgggatgttaggaactgtgtcctcatccctgccctactccattgcagggatggcagggggagattgcaggggtagtgactgcagagggagcctgaggcttagacaggactggagagggggcactgcatggcttcagtccttcagccccacaggcttcccttagtcccttcctcccaaagaagccaggcccccaagccccttccagggatctgctgccaatgccccctcctgcccagtgtctgtgtcaggcccataccccgcacctccccaccccacccccgcccagctctgcactgcctggttctgggcagctggtgtgtgggaggccaagccgggaaggaaaggggggaagggggtatctgtgtactgggagcccacctggccacctgcgcatgcccacactccatgtgcacagtgccaactcacatgccctggtacaggtgacccccatccccaaaagggactgaaggttgctccagcaatcacagaagacagctcaggtggggcacacactggcttctaacacctagttgacccaggcctcgcacacacagaccctgaagggtggtctatggggaaggggctcctggaccgcccccggcttgtgcctcatcttcctattttttcagtccctctcaccccttgctcccgaagcttcctttctctggctgtcacctctcctgtcacccactttgtcaatcagtctcccacctgtcacccttcctccccatctgccaccctctcactccacatgacacggtacctctatggtcactgtagtcttgcctgtctccccactcgctctgccccccaccacatccatgcccttcctgacctttcttctctgccggttgctccctgtctctccctccatcacctgtttcctcacctgacaccccactgccccatctccccacctcgccgcccaggttctctgtgaaaacgctgctggagaagtacacagcggagcccatcgatgactcatcggaggagtttgtcaattttgcagccattttagagcagatcctcagccaccgcttcaaaggtgggcccagcgcccctcccccagcggtccctcccccagcgcccctcccccagtggtccctcccccagcgcccctcccccagcggtccctccccaactcccaacctttagctcccagccacctctttctgatatactccatggactctgaaccccctcattgaccctggcccccattctgggccatgcacagaagcttgtgtacagatctgggaagagggagaggcctttggcctacaatccccatcatgggcaagcgatatgctggggtgcccactgcacacgtgcatgtgtgtgcacagatctttgtgggaggaggctgcttatgcttatgcatgtgagtgcctcactacatggaccctctccaaactccctggtcttgctgagccccctccctgccctggctcagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaaggtgaggggcctgaagcaagcaactgctctctgctctggacacagggggcctgcctgtttcttggtttttgccccctgtgcacagcccaggggagaagggcccacacctgatgctggacacatgagtccctctggggcagcaagtaaaggtgaacatgatttccagggccgggcatggatccgggtggcactgatggagaagcgcatgtcagaatacatcaccacggctctgcgtgacacccggaccaccaggtcagacttcccaggcaactcagaccacaggtctcagagtgcacctgcattgcccaaacacagctgatccttaagttcctgcagcatccttcagttcctggactacaagtcccagcaccagcacacatggctgatttccctcttccagcctggcctgcagtcccaggacgaactcttttttttttttttttttttgagaaggagtttcgctcttgttgcccaggctggagtgcgatggcgcgatctcggctcactgcaacctccgcctcctgggttcaagcgattctcctgcctcagcctcctgagtagctgggattacaggcatacgccaccatgcccagctaattttgtatttttagtttctccatgttggtcaggctggtctcaaactcccaacctcaggtgatcctcccgccttggcctcccaaagtgctgggattacaggcatgagccaccgctcctggccccaggacaaacttttaccaccaccaccaccaccacttgcaagtcaaatctaatgcccattatttgccatcaatgcccagcacgctccacccttgcacacctctggatgagcctcagccatgcaccatctcaagtgttggcttgctccatgatctacaacacagcccttctgtctctccaaacaacgaaagcagttctgtacttgctattcacggacacagagtccttatatggggagttcaatccctgcactgtgggttcacagggaggttgggtgcctgaggcaaggggttacaaggaggagtgtgcctgtgtgggcaggtgcatctgaagctgtctgggtgtggcggggggcatatacctccccatcccaattggccatacccagcctgatgtttttactgaattccattcctcagtctacacgtttcaagttaacacgttttttgcgcacctactgtataccaagcactaatgattaagacttgcttcctgatatgaaggatctgggtaacccagtacttgatgaggaaggggtagctcagagggaggagtcggctcagggaacacccattctaggtgatggggccacaggtgcgagccccaggctgaagggggagagaggctccaggcctgcgtgcagatcaggaaggagaattggccttccttcaggatggggtggcagtaagccaacaatagcagctcggggggggggggggggcgctccaggggcctgctgcatcctctggccctctgcctccccacagacggttctatgactctggagccatcatgctgcgggatgaagccaccatcctcaccggaatgctgatcggactgagcgccatcgacttcaggtggggtctgcctgacggcagtggtggagggggctgtttcccccataaatgtcctaccccaacccctcacacccacctccaaccctgtggctcctctgcctcagcttctgtctaaagggggaagtcctggacgggaagacccccgtggtcatcgattacacgccctacctaaagttcacgcagaggtgagcggctccatgactgcggcggggcgggggacggggcctcgggacatcctggggacgtcctggtcccaccgccctcagcggccagcgcagacgcgcggggggaggggcgggaccggccgtgcccactgctccctctcccaagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaaggtgcgcgacgccggcgggcccggggggcgggcgggccgggcgggggatccgggcatcccggggcggggcggggatgggggccgcggccgggacgtcctcccagccgcccgggctgagccggcgccccgcagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgtgagcgcacggcctgccctaacccctgacccccgccgccccgaccacatcaccgggtgaaccccatcttcacttccatcgactctaacatcacccgacacgagcacccacctctccagcatcaaccctctgatccagccagccccaccccgagatgcccacaatgatcttctaacattgcccccagcataagatccagtgacttccaacagccagagcccacccttcaccttcagttatcttccgctagagtggccatccaaccttactgcagggaccccacgtcactcacaaggacctgcggtgttgctctgcaaccttcaacacgattgcattcatcgcctcactcacctgcaccacaggctcactgaccgtcatcatccgccgtgacccccgacctcacccctgccgatccctgtaacacttcttctctacgcctttccaccaccctgatcttgcggcaagatccccaagacgatcttacacttcagggattcccacactatcctccactgacgtccccatcaccccagctgaccccaacaacactgcaccattccctccaactcccaatatttgtgcacgaatccctgtcacccctccaccccagtaccacctccacttcctcccgggatctggcccactgaccccaacaccgtatccccatttttgccgctcagatttcattcctgacccctccctcatccccttgctgaatctcccttcctcacttctcctacttccagccaggcctgactcctcctccccctcccaggacaggtctgatccccagtgaccacgcccctctggcccagggttccaaggagctcactacacccctggtcaatcaatggccctcactgggaacgcttaatggggccgagggcgccagcaactccaagctctaccggaggtaagccccagccaggtggggcttgggcctgagagcgggtcgtcctggggaagaagggcttcctctaccggcgcaccagctctcgctctgccgcagacacagcttcatgagcacggagccgctgtcagctgaagccagtctgagctcggactcccagcgcctgggagagggcacgcgggacgaggagccctggggtcccatcggtgagctcccccaacccaacacccagtacccctccagaaagggctgaggcaaggccctgaggcctcaaggcatgtcctcattcattctcttagtctttttttttttttttttttgagacggagtctcactctgtcatccaagttggagtgcagtggcgcaatctcagctcattgcaacctctgcctcccgggttcaagggattcccttgcctcagcctcccgagtagctgggattaaaagcgcctgccaccacgcgcagctaatttgtgtatttttagtagagacgcgcggctaatttgtgtatttttagtagagacggagtttcgccaggctggtctcgaactcctgacctcaagtgattcacccgccttggcctcccaaagtgctgggattacaggtgtgagccactgtgcccggcctctctcagcctttcttgagggtttagcacagcaatcgagagcttactttgaggtggcagaacacagcatatgcagaacccagcataaatctggctgtgcctcctctgaccatgtgagcttggtcaatcactttacctccatgagtctattctttgtaaatggggatgttgataatcaccaatgttgtcacatggtgagggctcagtggttttttagtgtcatgacatcctcgggggctcacaaactctcggggaactccttagactaatttgctcttatctcatgcacactgtgaactacttgcctgaccattgtttcccccttctctttggctgccaggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatgaccctcacggggagacagagacatcaactgacgattacaatacagtgtccccagcacggtgcctggcacaggcaggtgcttaaccaaagtttaactgaaaatggcaaatgctgtggaatatgccaaggtctcctggggggtgacttgagggctgccccttcactgcccacccctctaccaactcccacacatgtagactggtcgcttggcctcacctgccctctctccccagggaaggaccccacgccctccatgctgggcctctgcggctccctggcctccattcccagctgcaagtccctggcgagcttcaaatccaacgagtgcctggtgagcgacagtcccgagggcagcccagcactgagccccagctgaggaacagcatgggcagtgccagccccacctgccaggggccatggacacctgccacctttcttcaacaagagtcccccaatccaggctacccttccagagaacgctacccacccagccagggttctctcggggaagatctcgtctgctcaccttagctttctgccttggcagcacgggctgcggaagaaagcacgctgggccaggaggcaggggtgcccaagccacagggagcccctggggaagcctgctccattcttctggtgaccttggcgctccttcactcatctcccctgccccctcaggaactggtggcccagcttccacacccccacctcccagtctctagcctctccatctgtctgtgtatggcctggagtcactccttcctcagcccccagggcaagagagctcaaataaaaaccagaggactgagggcagccttgtatgtggggggctggggaagggccccgtcctgaggtctgaaggaagtggagtcagtgcctgaccgaagaccaaggtcaggcagcactagcatgtgccctgtggggacaggcaggccagcactcagggagggggtagcttctgtgtccaaaatattaggtctgcctagggcaggcccaagacatgcaactgccccccaacccaacagcctttaagaacttgctcaaaaccaggctgaggcggccgagcacgccaggggcaggatggaggcacaccctgtagggccagtgccctgtgctggcctcagcaatggtgctttggcccaaagttgcagacccctctgttaggccagagcctggcagttaagcaaccctcactcctctgctgtcgcttaagtgtgcccttaaggagaggtgttaccatcccccattctttttttttgagatggagcctcgctctgttgccaggctggagggcagtggcactatttcagctcactgcaaactccgcttcccaggttcaagggattctcctgcctcagcctcccgagtagctgggactacaggcgcccaccagcatgcccagctaatttttgtattcttagtagagacgaggtttcaccgtgttggctaggatggtctcaatctcctgcccttgtgatccacctgcctcggcctcccaaagtgctgggattacaggcgtgagccaccgtgcccagcccctaccacccccaattctaaccctaacatgggggggaggtcccaaagggacctcaccaccagaatgtctacttgtggtcccttacactctaggtcctcaccccgactctcgccaaactggagaggtcctcttcataggtgccactctgggcagccaaaccagcaccagggtccctcccaagcctccctcccagccaccccaggccccagagggacaggcaccaggcagaagttcatcatctttagacttaaggaattaacaagggtcagggagactacaccaggctgagggcttcttggttcctggagacatgcccagctacagcaaacacagggaaacacgaagggggcagctggaagatttggtcttgaacttggggggtgggtaagtgatgatccccacgactggagcagcaggaagaagttgtgtctgaggaagtgctgggccgcccagaggga

SEQ ID NO: 15646 - DNA, 11835 bp, Human
tgccgctgctcaagaatcacggctttgacgattagactttgtgatatttgtttcagtctgtttaggttttttttcttctacctgtatttttttctggttctgggtggttgtaattagtaggttattgatcgattcacctaacatttcatgaaagtttcatgtgtgtgtgtgtttcaatagaagcataaactatactccctagtctcaagatacacaggaaggaaaataagcacaaatgtgtcaccagggcacagactagtactaggtcctcagcaggccaggtgtcttatccgctgtctgggtctgctctagctccaggcttagaacccctgccacacgactccacagctcggttggcaccctttccctcctccgacttctgctgcctcgagcttggttagccatccccctgcccctgcctcatcctcagctccagttccttgctcaggctgcagcagtctccatcccctgtgcagacactgccgttcctccacggcccagtatcaggctttccctgggcctctcctctctcctggcccatctcccatcatccatctctgcctggcccaggccctttggcaccaagcaggctgactcttgtcactggctaatctgttctgtggtacattttctctcctcaccctcccatatcaattcctcgaaggcagggccgatctggagactaggaagccacttctctttcgacagcccccaccacagcccagcccgtgccaggcacccagcagctcctgaagcccactggcattgaacatggcattcaatccctgccaagcctgcccttcccatctggtttcccagggctcttcccaacacctcctcctccacctgccagttaaaatcttcccagactcagctcaaggagatgctcctaaggtggaatgaaatctcttcttccccacctggagacaatctacttcctctccctacacctggcaactggcgcacaaccttgtatcttaaattagattcagcctgagactgtctcccaccaatccctgctccctgtcctgctgagcaccttgaggaaagggctttggggctgtttatctttgtcctggaaaccatccttcaactcactctggggcctgcctagcatgtcaaccgagtttggagaatagggcagaatagggcaggacaggacaggacaagacagggcaggataggataggagcgagccagctcagtagctcacatttgtaatcccagcgccttggggggctgcggtaggagaatcgctttgggagcaggagttgcaggccgcagtgagctatgatcagcttgggcgactgagcgagaccctgtctctaaaacaaacacacaagtccgggcgcggtggctcatgcctgtaatcttagcactttgggaggccgaggtgggcggatcacgaggtcaagaaatcgagaccatcctggccaacatggtgaaaccccgtctctactaaaaatacaaaaattagctgggcgtggtggtgcgcgcctgtagtcccagctactcgggaggctgaggcaggagaatcgcttgaacccgggaggcagaggttgcagtgagccgagatcgtgccactgcactccagcctggcgacagagtgagactccgtctcagaacaaacaaacaaaaggatagaaaggcgagcacaaatattcccaattcataacactccctcgcactgtcaatgccccagacacgcgctatcatctctagcaaactcccccaggcgcctgcaggatgggttaaggaaggcgacgagcaccagctgccctgctgaggctgtcccgacgtcacatgattctccaatcacatgatccctagaaatggggtgtggggcgagaggaagcagggaggagagtgatttgagtagaaaagaaacacagcattccaggctggccccacctctatattgataagtagccaatgggagcgggtagccctgatccctggccaatggaaactgaggtaggcgggtcatcgcgctggggtctgtagtctgagcgctacccggttgctgctgcccaaggaccgcggagtcggacgcaggtaggagagcggccgcgcagacctctcgcctgctcctgcccaggggcccggccagggccatgtgagcttgaggttcccctggagtctcagccggagacaacagaagaaccgcttactgaaactccttgggggttctgatacactagggggagttttatgggaaagaggaagcagtaattgcagtgacgccccgttagaaggggctttctacctccccagcattcccccaaagcagggaccacaccattcttgacccagctccacccctgtcggtaggtgctggcttcttcccctctcctggtggtggtgggtggttcccgcggcggcctggagccggaggggcgcgcgaccctgggctgggagctccgagggcctgggaacgagacctgagaccttggcttctcgaaggtagtagggacttgggagtggtgactgaacctggtctggctcctccttacttcctcttgttgcgggtgggacgagctagcttccgcctctcccagccactttttcctgctcatttgcagctaggttggctccccttttgggaatttcctctccccttggcactcggagttggggggtgccacctagtggaagataacggagctagggtcttgaagaggctgctgtcccctctggctgttttggcggtgtagggtggcatgagagactgcgactcgcctcctcatccctgtttctgtatgcgagtgcttgtattcagtagaagcatacactatactccctcaatttagggtaaacaggaggggccacatgcacaggtaattcaccagggagccgaacactcctgtgcagacagactccccttcccagcaagccatggcagcggacagcctgctgagaacacccaggaagcaggcggtgccagctgcaggtgctttgcctgggagctgtggggctgaggagagggtccactgtccaggaccagtgaacttcatccttatctgtccaggaggtggcctcttggggatgctgagttaggggaggggcacttgaggaaagccaggtggagcagagaggatgtgagtgactgggtgggtgagatttcctgcccctccccccgcagtggtatccacacctagactcgtggggtaactgaggcacagacagagagcaacttctcaggccctcacagttggcaattctaggattaggacccaagtgcgattttcaggcagtccctgtaccctgtttctgttgtacctgttgcaccattcccaggcactgcccatcgtgccactagtgatatgaacccaggtccaatacgctctggggccatcaaagcctgacgtcaccatgacctgatgtgtgacgtgttataggtgtcccttggtatcttcacggaactggttccaggaccccaaaatctgtgggtgctcaagcccctgagataaaatggtgtaatatttgcatataacctatacatactttaaatcatttctagattacttatacctaatacaatggaaatgacatgtcggctgggcgtggtggctcatgcctgtaatcccaccactttgggaggccgtggcaggtggatcacctgaggtctggagtttgagaccagcctgaccaacatggtgaaacccccatctctactaaaaatacaaaaattagccaggtgtggtagcgcacacctataatcccacctacttgggaggctgaggcaggagaattgcttgaacctgggaggcggagttcgcagtaagctgagatcgcgccactgtactacagcctgggtgacagagcaggactccatctcaaaaaaaaaagagaaaaagaaaaagaaatgccatgtaaatagttgtgatcctgaattgtttagggaataataagaaagaactatctgtagatgttcagtatagatgcacccatcgtaagcctaactacattgtataactcagcaacgatgtaacattttcaggggtttttttgttttgttttttgagacagaatctcagtctcactctgtcacccaggctggagtatgttggcgtgatctctgctcactgcaacctccacctcctgggctcaagcgattctcctgcctcagcctcttgagtagctgggattgcaggtgtgcgctaccacgcatggctaatttttgtatttttaatagagatggggttttaccacgttggtcaggctggtcttgaactcctgaccttgggatccgcccacctgggcctcccaaagtgctgggattacaggcgttagccaccgcgcccaatatattttgatccctggttggatatggagggctgactgtacttaacatctctaagcttcagtttcctcctttaaaataaaggtgtggctgggtgtggtggttcaagcctgtaatcccagcacttagggaggctgaggtgggtggatcagctgaggtcaggagttcaagaccagcctgaccaatatggtgaaaccccctctctgctaaaaatacaaaaattagccaggcgtggtggcgagcgcctgtagtcccagctacttgcttgaacttgggaggcagaggttgcagtgagctgagatcgtgccactgaactcgagcatgggcaacagagcaagactgtctcaaaaaaaaaaaaaaaaagggggtgagcagacgtggtggcacgctcccacagtcccagctacttagtaggaggccaaggttggaggattgcttgatcccaggagtctgagtccagcctgggcaacatggcaatacctcatctctaaaaataaaataaaagtaaaggtattaattactactttggatggttgttgcaaagaaatatatataaaataatggagagtcttgtaactggctcccaagaggctcaacagacattactgtttttgcttcttcattatgagttacctctctggccaccccactgaactagctgggctagctgagcctgggagaagagttgtttaggaagtgagaggctgctctccacagagactcaaggctcagttcctcctggtgactcagatgggcagcccagtgggcacacgtggtctctctccacatgtggctgagtttcacttccagaatagatggagaggcaagggcagggtttagcatgcttgaggaatctcagagggccctggtggtgtgggggaccctcagaacacaggtgtctcaagggctgacccagcttctgtgtccttttctctgggtgaggaggggacattcatgggcagatggtgacctctggggaaggcagcccagactccactggccaccatatttcctttttcacaactttctcacccctgtggtttcccatgtcatcatgtggccgcttcccgcaaggccttagcggggtgcaggtatgaacatagtgtcaggcaaggaggcatctggaggggaaccctggcttttcctggggggactccctccctgcaccctagccctgtcctctcccatggctactgatgccttcccctcaccccagaggtggcccacatctgcacagatcagacccacaaaaatcacgtcttcctgactctcataagcctgcccagtgaggcccaggcattaggccatgtgctggggactcagacccacacatatacgcatgtcagcattcatgcttacaggtccgcacatgctggggcaagtgtcacacacggggcgctgtaggaagctgactctcagcccctgcagatttctgcctgcctggacagggaggtgttgagaaggctcaggcagtcctgggccaggaccttggcctggggctagggtactgagtgaccctagaatcaagggtggcgtgggcttaagcagttgccagacgttccttggtactttgcaggcagaccatgtggaccctggtgagctgggtggccttaacagcagggctggtggctggaacgcggtgcccagatggtcagttctgccctgtggcctgctgcctggaccccggaggagccagctacagctgctgccgtccccttctggtgagtgcccctcagcctaggcaagagctggcagcctgggttttcccaaagggtcatcttggattggccagaggaggacgccaggcacaagtctgtggtttatcattttccctgtctttctaggacaaatggcccacaacactgagcaggcatctgggtggcccctgccaggttgatgcccactgctctgccggccactcctgcatctttaccgtctcagggacttccagttgctgccccttcccagaggtgagcgtgccatcagcccagtggaggggcttaggtctgcatttatgcttttcctgcactctaccacctgcagataaaagggccctgccaatgcaggtttctctgtgttccacaggccgtggcatgcggggatggccatcactgctgcccacggggcttccactgcagtgcagacgggcgatcctgcttccaaagatcaggtgcagctggggtgtgggtgcagggcaggcagacgggcagcatgtggagtctggaacccaggagcccagctggcgggggcagccctgattcctgcccttgtgccctcattcatgtggcatctgtactaagcaacagccctgctgtggacagaggggcagcactggggataggagggtgcgggagaaagtgcaagactccaggtccaggcgttgtgggggtggggagaggtcgagctgggccggtctaataccaacccatggtcagtgggtgccccttccccatgccatcttgctgagggagggactggattgtgaggagggtgagttaggcctgcctaggagatcactgagccttagtgtcaccctcaaaccccagtagctgggcttgcaggccctggtgccaccagctccttgtgtgatgggggagtcagtcaccttccctgagtgggctggtagtatcctgggtcatcttgtccacaggtaacaactccgtgggtgccatccagtgccctgatagtcagttcgaatgcccggacttctccacgtgctgtgttatggtcgatggctcctgggggtgctgccccatgccccaggtacaaatctgggggagatggggatatgtggagggaagtgggggcagagttgggggccaggggcagggggtgaagacggagtcaggaccattttttctcaggcttcctgctgtgaagacagggtgcactgctgtccgcacggtgccttctgcgacctggttcacacccgctgcatcacacccacgggcacccaccccctggcaaagaagctccctgcccagaggactaacagggcaggtgaggaggtgggagagcatcaggccaggggctggggcggggcctcattgactccaagtgtaggaaaaagtttcctccatcctggctgcccctcacgtttgctcctcttccagtggccttgtccagctcggtcatgtgtccggacgcacggtcccggtgccctgatggttctacctgctgtgagctgcccagtgggaagtatggctgctgcccaatgcccaacgtgagtgaggggctggagccagcttggctgtgtgcccccagccacctggccctgacacgcaccttacaggggctctgtggcatggggctggctggctgcttgctgggagcctggctgatgcagggttcatgctaccccctagtgggggattggggcagtgccagccatcagcctggctgctccctgtgtgctactgagcctggaagtgacaaagacccacccctgtccccactcaggccacctgctgctccgatcacctgcactgctgcccccaagacactgtgtgtgacctgatccagagtaagtgcctctccaaggagaacgctaccacggacctcctcactaagctgcctgcgcacacaggtaccagaggcagggtgcagatacaggggtggggccccctttcctcccttttaggcctggccttaggatcactgcaaggtggtgtaagcggtaccctccatcttcaacacctggttccagctgtggagccggcaaagggttgatacccctgagggtccccagtgccacttctgacctgtcctctctgcttccctcacagtgggggatgtgaaatgtgacatggaggtgagctgcccagatggctatacctgctgccgtctacagtcgggggcctggggctgctgcccttttacccaggtacccaggggtggcgggtgggtgggctgagcacagtgtggcaggcagccgggccccagtgcccacctgcccttcttcatctgccctaggctgtgtgctgtgaggaccacatacactgctgtcccgcggggtttacgtgtgacacgcagaagggtacctgtgaacaggggccccaccaggtgccctggatggagaaggccccagctcacctcagcctgccagacccacaagccttgaagagagatgtcccctgtgataatgtcagcagctgtccctcctccgatacctgctgccaactcacgtctggggagtggggctgctgtccaatcccagaggtatatgggaggggacagcatcttggcctgggcaggtgggtggccaagctcctattgctttctgccctccgcatagcccataggtgatacccagctctgacagattcgtccccagctggaggtgctgtaagcaggagaggcgggctggagtaggtaggggctcggcactgcgccccacatagtggctacctacaacgccctttcctgcccaccccccaggctgtctgctgctcggaccaccagcactgctgcccccagggctacacgtgtgtagctgaggggcagtgtcagcgaggaagcgagatcgtggctggactggagaagatgcctgcccgccgggcttccttatcccaccccagagacatcggctgtgaccagcacaccagctgcccggtggggcagacctgctgcccgagcctgggtgggagctgggcctgctgccagttgccccatgtgagtgcctccctgcctgcccctggataggggagctaagcccagtgaggggacaggaacataatgccattctgtgctcccttccccgccaggctgtgtgctgcgaggatcgccagcactgctgcccggctggctacacctgcaacgtgaaggctcgatcctgcgagaaggaagtggtctctgcccagcctgccaccttcctggcccgtagccctcacgtgggtgtgaaggacgtggagtgtggggaaggacacttctgccatgataaccagacctgctgccgagacaaccgacagggctgggcctgctgtccctaccgccaggtcagtgccaacccccatcctggggctgggtatggccagggaccaggtcccacctcgtccaaccctctcgcccccctctgaccatccagggcgtctgttgtgctgatcggcgccactgctgtcctgctggcttccgctgcgcagccaggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctctccctaaccaaattctccctggaccccattctgagctccccatcaccatgggaggtggggcctcaatctaaggccttccctgtcagaagggggttgtggcaaaagccacattacaagctgccatcccctccccgtttcagtggaccctgtggccaggtgcttttccctatccacaggggtgtttgtgtgtgtgcgcgtgtgcgtttcaataaagtttgtacactttcttaacagtgtctgatttgccgccctgcctgccctccccagggccccagaacaggggttcacgtccactgccaacactcccctcccctaccccacagaaagacatacacagccttaacctcaccagttttatatttgctgctgcccacatcggctgtatcacattaccccctagtccccagagctgtcccagccaccagccctgtgacatcgtagcccagagatgggctagtcagcaagcagcaccccctcccctcccaggggtccacaaagaacgccccctcccttcccagccctcacactagcagctgaggctgggtcacccctcctgctttcccacaatagagctttctatgtacagccacgtctacacaggcactgcttccccccagccctcctccccggcacctccccgtgggggtctggaccccccctcctccccggcttggaggcagacacagggtcccttgcaagacacgacccagcaccaaccacggaacagctccaaggcccctgggcccctctccggcctggggctgggagctacgcgcgagggcccccgcgggcccccggggcgcgcaccctgggtgcgggcccgcgcgggaggggcggtgccaggccctgcgcgggcgctacttgacgttgaacaccatcagcggccgctcctcccgccgctgccacgggctcttcttgtctcccgcctcgtcgcccacctccgcccccagctcgtcctccgggctggtgagcgagtcgcgccgcagctcgctggcgctgctgcgggagctgtccccgcggctgcggccccgcccccggggtaccgtggccgcccggccctcgggcgccgccacctcgtccagcagcggcgtcagcgagttgtcctccggagagcagaggcccgtgcggctctcgctgctgctgggctccgtgtcctcgctgagcgccaggcgcgggggcgcgggcggcggcggcggcgcggcaggcggggcgcgctcccgctcctccctcgcgggccggcggcgcgcgggccgcgcctcgtggacatctacgcccgagtccaggctggcgtcggtgctgcgtgccccgccgcccgcctgcaggtcgatgtaagagtggcgcacttgcgagttggagcgcccgtcgagggacacgaaccaggcgcgcgggtgcggcttcacgcccagttccagcagcttcttctcggtcagggcctgcagctccccgttgagctgcgccatggtggactcgttgaatagcacagggatggtgactgagccactgacgggcgccgcgcgcccggccccccagccctcgccgccgcccccgccgccctcgccccccgggcccgagtggcccggcatctgcgggcgctgggggtcgggctggggaaaagcgcgcgccgggccgggtgccgtgccctccggcggggccggctcgtcgcccacgccggcggcgcccgcctcgccgccgaggcgcacgtagtgcgcggggatcaccagggtgggcatgacgttgcggtagacgttgtccttgaggtggtcgatggagccgcagaagatgagctgccccgcctggcccagcgacggcggccgcgccagctggtccaccgactgcgacagcaggaagtcgggggtcttgccctcggccgcccccttgtggcccaggtagtggtcgaagggcggcggcggcgagggcggctcgtgcaggaaggccgcagcccccgagggcccccgccggtgctcctctaggccgggctccagcccgccggggccctcggccgagcgagcgcccttgagcccggcgctctcgcccccgcgggcacccgaaggctcggcggccgggcggctggcagagcgcggcttggtgcggaagaagtcatcccgggaggaggccaagtcccgggagctggagaaggccgagtggagggggcctggaggcggagcctcggggtcccccgacggggcgggttccaggggtcccccacagatgaggtggagctgggacatcgaggt

SEQ ID NO: 15647 - DNA, 29574 bp, Human; identical to SEQ ID NO: 12650

SEQ ID NO: 15648 - DNA, 101951 bp, Human
tcttgaactcttgacctcaggtgatccacccacctcggcctcccaaagatctgggattacaggtgtgagccagcgtgcccagcctcaaaagttcatctgtgagccacatttagaaggtagataaaaaattttgactaaacacagcttagaatctataaattgttaaacttcagttctgttgagaatctttgagatccatcattctctaaatgttttctaccagagaaacaggacaatggcttgcaaatattggttatcagtatttactctatagctcaagcaaacaaacttatttgcacttaaaatacaaatattacctaccttgatttgagtgttgttgttctctcttaaatttcatttcccaaaaatgatggcaaaagtactgtttgttttaacttgacccatcttttgcaacccagcttaatcatttcacagattcccttttgaaataaatgggctagatgatcagacaatagtggcaaatgtttgtcatttcaatgacatatgcaagagatacctttagtgaaatttgtatatcaaatttccctttgtgctccttttttccctagtgaattcagcattaaagtgtttataaatatttttggtttattatttattaattcaaagcaaagaatgccaatgtgaccataaatatctcatttatatatcataaatatctcattatagaaatatgtttagagacatctgttttattattttaaagaagagtacatattatatattaaggtaaaaatagtactaaaaaagagaaggtagtaaataaaaaaattctaatgaacataaaacatcataaaaattaacttaattaaaaatcagccaggcacagtggctcatgcctgtaatcccagtactttgggaggccaaggtgggtggatcacctgaggtcaggagttcgagaccagcctggccaacacggtgaaaccctacctctactaaaaatacaaaaaattagctggatgtgatgggacatgcctgtagtcccagctacttgggaggctgaggcaggagaatgccttgaacctgggaggcagaggttgccctgagccaagatagtgccactagactccagcctgggcgacagaaagagactctgtctccaaaaaaaaaaaaaaaagtataaagataaaattttagtatattgtgaattaattactagactcaattgttataggaagctttgtttttctggagctcttatattaaaattattaaaatcctcactgaaaagtataacatgtgttttctttaaaagaaagatattctatatctgaataaagacaaactttgaacgagtggtatatgccttaataaatattggagaatatctattctccaatacttagagaatgacgacagcatcctccacatggcgttttcattgccagtcacaactttcctccacctagtgttctctagactgagacagaccaaggaacaattccctagacctcctttgcagagctaggttatgctcagaccatttgcagcaccaaggacactgccattcaggtcaccaaaaaaagatcatcttgtgagccctgtctaaaccaggccccttctaaaatcatttcagtgtgaaactgagtccaggtgggtcttcatcagtattagagtggacctgccagatgtatgcttgcagatgatgcaacatcaaagcaaatgccctgggcaagagaagaaaggccaaagcaatgggcttactggtttctagctttgagccactcttcatagtgccaaattcccattttagggtccctttatttgtattaataaaaataaattccctgggtgtaagttcctgtaaagtactccctatctgtattcctgggcatgaaagggtgttttagttccaattctagttttcccacttagaggttcacctttctgacattaataattaaccagattatctgaattcttcaagttcagtttatttaaaaggagactatcctcaaaagtgttatatccgtggtttcctgctacctccaaccatgggccttttgggaatactttgttttttaatcttcctggggaaaacctggggacaggagcaaacgtaagtaaaacaagctatcttcatttttcaatgcatcttagttatgacgaatgaagagttaaatttaacagattctgttaacttgaaaataacttgctacttctgagaacagcaagtgaatagtatcatctctgaatgagaaagtcatggaagcattttgatttgatgagtagctaacaacatgacagcttttatggaattgttatttattaaaatttacgtaagtgattattcaaattcctcttcaaaaaagcacaaaagaaactccagataataaactttcttgacattttttgcttattttaacttggtgtttagttttctttgtgtttttcatagactatacacagttaaaccagggttatttaggagtcaatctaatactgtgatctgaaaatctgttgttgtagtgacttctaccatacatttatgagctgacttttcacaatttttagtgtcattattgagataatatgcattttaagtaatgttttaaaaataatgatcttatatctagaaatattttaatactgaaaagtaactgcagatcatctaatcaaacctattcattttatatatgagaataagtccagataagggaagtgactgaccaaaggtcacagttctagagagagagaaacaggatttttattaaggtctcctgtttatcacttcaatttttttcattttgtcataaatgtatacatgtaaatatattatatataaacacatacttaggatgtcattcttttttagcaccctcgtatttctgatctgtgatctttttacatggccacaagcactcaactaccttagcatcctgcctttattctttttgaaagacgagcagctaaggcttagagagactgaaattaagtgacttcaaattggtggcagaactagggctaggacctgggttccatgattcttgtccagacttattctgaattctttctactagcccttaataaaaattatttcctcactttctctgaagaagtcagagtgtaccatttacaacatggcaatcaatcactttaattaattggttgattgattgattcaacaaatatttattgagcatctaaacatatgataggcactgcagatatagcaaacggtaagacaattcctagagcttgcattctagtgggagaagcaagtaatgaatgaatgaaccaatgaaagaatgtgtaaggtcaggtaggtagtattatgaagaaaaaaataaagcagagtatgagaattaaaaaataattatggggcactattttaaaatgtggccaggaaaggttctcttaaggaggctgcactcaaacagagcctgaaggaagtgaggaagcaaaccatgcaaatatttgaggaaagagcattccagatagaggccaaaataacattcttgcctctctgcaagctcagtaacctgatcctctgcagcaattgaaagacaaagaaaactatgaaattatttatatggatagattatgctactgataagtcaataagaaccaaaatctttataaagggtggttccagaatattcttttaggggcttctaaacactatgtatttttgcttgacggctaccatcacatagaccagcagtccccaaccattttggcactagggacaggttttgtggaagacaatgtttccatggaccaggattggggtggggatggtttcagaatgaaactgttccacttcagatcatcaggcattatattctcataaggagcttgcaatctagatccctcgcatgtgcggttcacaatagagttcatgctcctaggagaatctaatgccaccactgatctgacaggaggcagagctcaggtggtaatgctcctttgccccactgctcacctcctgctgtgtggcctggttcctaacaagccatggactggtatttgtccatggcccaggggttggggacccctaccatacacaattcaaaattaaagcaatactaaacttaaaaacataaagcttctataaatactgaaattaaagtagctttatatccctaaatttttctaattacaaaactctttataaattccatttagtacaacagttgaaaatgttaattctggaaacgggctgctcaggttcgatttctaattctataatttgtgaattatagaattcataaatcctatatgtgtggccttgggaaaattaattagcagtttcttcaccttaaaattggagtaatagttcctcacagagtggttgtaatgacacaatgagtttatacaaataaagtattcagaatagtgccttatcacagggcaaaatttcagtaaatatatcttattatcataaaaactgaactcctctcattttctgccatctcctactaggcatgtggggaaggggaattcagatgatggttggaaatctggaaattctttcctctcttttgtaatttgcctgtaagtggatccaaattaattgtaatgcaggataactgtcagatgctttaaaggatttaattgctgataaattaattccattgttactaaaaacttcctgcttttaccagactcttaaaatgtcacaatgttggcaaaagcctggaataattctgccaggtggggtggtgggtgccctccaagcttgttgggccacttgaattagtcgatcactatgcccttttgggttaaaacacttttttttcctatgtaatagcgtatgtagttctcgctattcaaattagatacttttgtgatatacacttagtaatccagtttatatttgtaagtttttaaataaaataatttttaaaaatcactcaaaagcatgtatagactcacttccattattgtataaatcacatgaaaagtaaaaataagagaacagtctatggttgtgaataacatataaacttgacctcaactgtacacataacaactgagaactcatataaaggcctcccccatttacttacaaaccgtataaccttagccaagttagccttttaccacttgcaaagtacgaataatgatagtaccagcatcattggcttattgtaaaaattaacaagagctgtatgtaaagtgctgatacagcctctgatatgtggcaagtacttaattaccattattgtttgaagatgatgatttgctcttaaaggaccatcatcactatttccatttccaaatgcacttcccagctcactcatattctatcctttccgttatccgtttactagtataacatagtatttctaagatcactccctttaaactaatttagtgagattaataaatcttaacatgtattgagtactaagagtgctagaccttttcatatatatgttcttatttaatctttaccagagcctggtaaagaaggtgattattttcacagtaagttattttagcctcagaaagacttagtgactttaccacggtcactcagccagcagatgccacagctggaattcaatcactgcttttttcttcattgagcaaaaaatattgaccccatttacattttctggtcaacatgattaaaagtcttccttggctgcagtagctaagagaaagtgctgctatcaccttaactttctaaatgtaaactaaacctccagcttctcaggtcttaattccaaactacttggaaattatgctgaagttatggtgggtcacaagtacattttgacttattagtatcatttttaagtgaggaaatatatgtattttaaatggaatctctcaagtgagagaaaaaaatcaaaagtaaaagaaaatatgtcatataaagacattgagccttatcttttcctttttcaacagatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacagtatgtatttatcctttattttctttatatatatatacagaatattctcaataaaaatgtgtacaaagtttgaatattgataacatatagatttaatcatttacatccactgtgggattattagatgatgtcagtcactaatgataatgtaagtgaaaattctaacagaaacagaaaattctaaacagaagttatgtctgctttttgagcaatgcatgtccattttcacattcttattggaaaataaagttgtactaatgtgaaaatatttggagataattgaaaatacttgtttgctatgaaaattactattagaaagaaattgagaaatatgagtatgattttatctgtagtacattgcccacaaaaatccatggatattattgaacattcgattgaactctaatattctacaattatagtttcaaaaactaaaaaatttgtgattactaaagtgaatagctctcattgacaacctgcagttaatagaaagaacaaccttgatcaaataactctcctattaagatattgtagtatagattgcttagagacatacttgcaacttatttttactaaaaattctgatacttaataaagaaaatcaaagaatatcagacgtaaaatgggctctgcagttcatttagaccagagtttctctaaagtgagttctttataaagaaattaaaaatggaaatttaataaagagcttaaaattcgaattatattgattttgtaacattttgaatttattttataaatttgttttgagtttttaattatacaaaaatcataagcataagattgtaccgttttaagtttgtatatatttaagtatctttgtatcaaaaattattttgattatgttataaataataaaaagccaatgctgagggtcctccatgacttttgtcctttaaaaggactatgcatattactcaagtttaagaaacactaatctaaaaaatttctagtcaaacataggaattctttaatgttcttagcagtaaatgctcatatctcttaacaaattcttccacttattaggtttgttaacaattaaaattcatttattaaaagtgttacttttatggcatatgcctgtaatcccagctactcgggagactgaggcaggagaatcgcttgaacccagaaggcggaggttgcagtgagccaagatcgcgccactgcactccagcctaggcaacagagtgagactccatctcaaaaaaaaaaaaaaaaaaagaaagtgttactttcaaaagacactcttttatctgatacaatgtatttgtggctcttagttttaaatttaaatcaaacaaatttaactgaaattaaaaatgcagtatctcagttgcactagcaacatttcaagtgttcaaatagccccaggtagctattggctaccatagtaaacagcatagatatagaatatttctgtcatcacagaaagttctctgaacagtgctgacctatatgattaactgaaaaactagattaaggtggggcaatcatagtcaatacatattttaaccatttaattttatcatagcaatatcatgtatctttatttgccaattgtttaatgttgtaccaaggtcttttaagtgtgggtctatggattgcagtgtcaaatctcatttattacgtgctacaaatttaatggatcatctttgttctatagtttcttttttgttgttgttgttgttgttgttgagacagggtctcgctctgtcacccaggctggaagacagtggtgtaatatcggctcactgcagccttcgcctcccaggttcaagcaattctcccacctcagcctctcaagtagctgggattaacaggcgtgcaccaccacacctggctaatttttgcatttttaataaagaaggtgtttcaccatgttggccaggatggtctcgaactcctgacctcaggtgatccgcccgcctcggcctcccaaagtgctgggattacaggcataggttactgtgcccagcctgttctatagtttctgtttcttaaaaggggagaaagaacttaaaggcacttacaaagcaatctgggtgcagaatatttatagatttttcttgttttccaaacttttacaataatttcgcatagctaattctacagcagttggtttttgtaattaactttcatcccgtgtttccaaagcctaatttttcatagatacacttttcttttttatcacttttcatgcattaaatttacatatcattgaatgtaaaggggataattacaaacataaattggaaaatgagcatctcaactcaggggagcagaaatatgtgaggtaatactaagggtccagagatgctggacacatgggcacggtgactgatgcctgtaatcccagcactttgggaagccgaggcaggtggatcacttgaggccaggagttcaggaccagcctggccaacatggtgaaacccgtctctattaaaaatacaaaaaaaaaaaaaaaaaaaagttagctggacatggtggcgcacacctgtaatctcagctacttgggaggctgaggcaggagaatcacttgaatctgggaggcagaggttgtcgtgagctgagatggcaccactgctttccagcctgggcaacagagtaagtgagactccgtctcaaaaaaaaaaagctaagggtccagagaatcggtcaggaggtttcacaaagggaatggggagcatggggtaacccagcaaactaattgagtgaaggtttcttaaaggcttttatagtagtagtttcactaaatgtatataaaatttaggaaacatggaaccaaagagactttcaattgcttaaagctaaatttttattatgtaattagacactgaagggcttcgggcaaaatttatttactcttcttgctcctgtatcactttttaaatgattacatatacatactgattgttctaatgagattacagttgtatttagaaagttaatggtttaataactttagaattattatactttttccatcaacaatttcttttccagatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcaggtagattataagatatttcttcctctgggtgggggatttgacagtattgacactatattgtagagctttttaatacctgaaattgagtggagatcggtttctttttaatttgctcaaaagactctcaattcccaaagacatctatacttacaaatatttaatagcattttaattttaaatttatggagaaagtgctaaataaattacaaaaccaacaattacattacctgccccatcacttatttccaagtagaaaatgctttttcaaaattgtaaaatgttgaatgttatgtaaaaatgtaaaatgttatgttgttacaaaaaccaactgctgtagaattagctatgcgaaattattgtaaaagtttggaaaacaagaaaaatttgttttccaatatgttacaatttattaaacaaatataagacttaattgcaaatataatttggcaatgggaaaatataatttattgtagaaccatgttcattaaaaattccactgggtctggagctaatccccaaactggaaaaataaatctaacctaggggatcagatatttcagcagaggataaactagatcacagaaatatatggatattaattttcaaaggggatctacctaagaaagttactgttagaacattgtttaacattcatggttcttctgttagaggcaaaagggcagaatagccaatcaaaatcatgtgaataggaatgactggacctattcccaatgaaccaaaagtaaaacacagaaaagtatgaatgcttcccaatatattcatgtgtttgcaaagccttccattcccccgtttctccctctcgtcatcaatgacttttaagtacatcagaaatagaatattagagatgtatatatgggaaggagaggctatggaatttcattaatgatattcttggaggaggacagagaaaggaagtggggaccatctgactttgttgaaaaactttgtacacagtagatatttgctaaatgttggttgatgttgatgatgagaatagtggggtggaactggactgaaccattaccgtttcagcaggagcatttgttatgatcagctcagaaaggaaaagcctaaagggggtggagatattgctatctacttggccagaataaaatctccagaataatagcatcttttttctccaagagacaactttttatacaaggaaatagtctctgcccacaaaggttgggtccttttagacataatcatacctagaaacaagcatatcatctctcttgtcctcctcctacattgaaggattcttttttgcttggatcctgttgacacgtcccacaactaagggtcatcagtctttgtccagtaagcagtgtaatatccagaggctgggaccttcctcggttatcaaggctttccttaagaatggcttcatgtctcatgcctgtaatcccagcactttgggagtccgaggtggggggatcacaaggtcaggagtttaagaccagcctggccaagatggtgaaaccctgtctctactaaaactacaaaaattagccaggcactgtggcaggcgcctgtaatcccagctactctggaggctgaggcaggagaatcgcttgaacccaggtggcagaggttgcagtgagctgagatcaagccactgcactccagcctgggcgaaagagtgagacttcgtctcagcaaaaaaaaaaaaaaaaaaaaaaaaaaaggcttcatgtattatttctctatcaggactttactgtaagatgatgtaatacctggccaggcacagtggctcatgcctgtaatcccagtactttgggaagcccaggcgggtggatcacttgaggtcaggagtttgagaccagcctgaccaacatggtgaaaccctgtttccactaaaaatacaaaaattagctggatgtggtggtgcacgcctgtaattccagctactcgggaggctgaggcatgagaattgcttgaacatggcaggcagaggttgcagtgagatcgcgccactgcactccagcctgggcaacagagcaagactgtctcaaaaaaaaaaaaaaaagagaaaaaaaaagaagacgatgtaatatcctcatccattctaatcgtagagtaaaatgagagaagtttgctataaatattggcccatttctgcaagatagtgaagtaaattggttaaaagcagactctggagtcagattgtctgggttcaagtcacagcttgagctgctgtgagctgtatgaccctgtgtgaatcactcagcctctcagactcccactttcctcacttgtaaaatagagataataatacaacttacctcatagagttgtgagaattaactgaattagtatgtgtaaagcacttaagatagagccaagcacacagtaagcactaggaaagtgttttccattattatctatggaatagcacaaagccatatttacagaaaagaaaaataattacttaaaagtattttttaatcgtcttgttatttatagctataatgtcccgatcaacacatttaatctgaagattcttgagggatttttagtgtaagcatctttaggataaaggcttcaaggctttactggataaatgactttagaatattgcccaaaatccttcaatttcataaagcctgtgtcctgccttcttccccagcttcatcacctactacggccccaccctctatagacacaagccaaactgacctcctttcagatgctttctcacaccgtttccccatccatattaaggcctgtgtaacatgctgttgcctctacatggtacattcttgcccctcctttgccttgttaactcctacttcaccctcacgtgtcatcacagatccttctaaaggcagctttcgctgatttccctgacctcttcaaatctccctcttctacatgctcataaggccaggcaaatatcctttgtggcacttcacaccctagaattttacatataattgtgtttgcctctttcctccacaccattaaaagatgtccatgtctgatttgtttcactactgtatctcagtacgtagcataatgactggcacattagaaggcattcaaggccgggcgcggtggctcatgcctgtaatcccagcactttgggaggccgaggcaggcggatcacaaggtcaggagatcgagaccatcctggctcacacgggatgtgagctaatacaaaaaattagccaggcatggtggtgggtgcctgtagtcccagctactcgggaggctgaggcaggagaatggcatgaacccaggaggtggagtttgcagtgaaccgagattgcgccactgcactccagcctggcattcaaactttttttaaattaataaaccacatcttttatttttatttttatttagtgagtgtctcgctctgtcacccaggctggagggcagtggtgcaatcttgtctcattgcaatctccgcctcccaggttcaagcgattctccagcctcagcatcccaagtaagtgggattcaggcgcgtgccaccatgcctggctaattttgtatatttagtagagatgggatttcaccatgttggccaggctgggcttgaactcttggcctcaagtgatccacttacctcggcctcccaaagtgctgggattccaggtgtaagccactgcacccggccaataagccatatcttttatacaaaaaattgtatagatcttgcctccaatgtaccatcgctgtgaagacaagattaattttctaacctaaacacaaactgggttaaaaactagccaaatagtagtaacagaaataataataaaataaacatttattgattacttagtatgtgtcaggctatgcaaaagctttgcattatttaattctcacaaggacactatgagcacacactagtattcctgttttacaagtgagttaactaaggtttagagggattaagtatcctgctcagggtcatactaaaaagtggcagaggcaggagtgaaaccaaagtgtttaattccagggcctgtgctcttaacttttgtgactttctgacttgggcagcttcccagtgatactcaggcctagactgggtgtgtcccaaaaagcaggagataggatttgtggtgggagacaggtgtgaggggaaggagagagcagagaggtggggcatttactgagcacattgtttttatcttgtgaacttagtaaaaccagtgttaatgtggcttcttatatagagctttgcataatactgatcttttaaaagatactgggtttatggtgccagttctattttattttgtgggtaaagttttggccatgaaatgatttgagcatcagcaacaccctagagaaattaagtttgtcattggaaagaattagatcactgtgtctcaaacagctgtgagttaaaagcgaaacagatgcttttgtttaaaaagtagggatctattaactgacagaaagaaatggaagagaactaacagttattgagcccctgccattgctcttttaacaatgagcgaacaagtgtaggatctggctcaataaatagaacaaaaccatataatccaaagctgccttttgcaataagagctaatttggagccttgtgggttttcataagtggaagagtgtatgtctgaatcaagctcccaattttccattaagatcttcaactctgagacaatatattatgctcctctataaccatatggtgatgtcactattttgctactatgaaattcttaataaataatggcctaattacagatgtaattaatttcatactgtgaatgttttctcaaaacattgtaggtaaatgtattttaagaaagtgaactgtactttaaatccactaagagaaatagttctttaaaggaatccctgaggattctcttaaataagagaatctttagtaatgtatatgtctgcaaactaatttttgtttttttcaaatatggacttttgtgtattgagttttttaaagtaagattcatctcttttaaggatggttgttttaaaaaatcaaaatatccttgtttttagcagagtttttgattatatcaattattcttacagtaaaagttagagtttattcgttgaatgacgacttgaagccagccaaaagagaaactgtcttaactttcatagtaagtattttatttatttaaataatactttaattcatttttcaggacaagaatctcatttcattaccctgtcctcacactacactaaatcattcaatgttccataaatggttattgaacatctgcaatgagtatagaatcatagatctatacctctgtaatacacgtatgtgaaaggctcatacaaattaaatttcaataacttgaaggattttgagctaaaccatttaagtacaatcttgctgatttattttttaaagaacacccactggccgggcgtggtggctcacacctgtaatcccagcactttgggaggccgaggcaggtggatcacgaggtcaggagatcgagactaacctggccaacatagtgaaacctcatctctactaaaatacaaaaaattagctggtgcagtggcaggcgcctgtagtcccagctacagctactcgggaggctgaggtgggggaattgcttgaacccgggaggcagagcttgcagtgagccgagattgtgccactgcactccagcctggtgacagtgtgagactccatctcaaaaaagaaaatctaaaaaaaaaaaaaaaaccaaaaaacaaaaaaccacccaccaatcactaagaattgactgaatacccatttaactataagatatacataatggatatatctattatgtatttattatgtgcaaaagaactatatttaatggtacttactcttaaggaacttagagtttaataactattatactaacacaaaaaatcttgctaaatcatgagttaaagattggcagtaattcaccatttatcagacatgacatatgtaacagacgctgtgcattgaactcccatgatctcatctaatttgtgtcacataccccaaacacttttgtgaggaaataaaataatacaactagttataactgctcagttattaacagtaggtatactactaatggtccttcaatataggctgcagcacttttgctgctactcaaaaaaaaaaccaaaaaataaaaataaaaacttatcagaatgcaggtgcaaaagcatagatactacagaacaaaaccatactaaaatataaaacaaataaattatacagtaggacaaataccatgagctcagagggaagaccaatgagaggtgagagtgggggtgatacacatccttctctggaacggagtagttaaagggaaccctgagttgggtgttaatgaaaggaattgacataaattatttaaaaatagtgaagaccatccatgtaagaaacagttgagttaagctatgggggcaagaagaaataaaaaaaaatgaagctagtaaataaactgattgactgatagaatgtctgaaagagaactaaggagagcaatgtcagctcaaatgccctttttctatcagggaatgataggggtgtggatgtatgctctttatccaacgtcttcatggttgaacttaagtgatgcagaatcatggcataacctgcagaaaaatgaatgtcagtcatctcttgtaagagctgccccaggaagaaaagattgagaaagctgatcccagagccttaaggagttaatatagaggaagtatcctcaaaatagtacctgagaaagatgatcttagaagaattgtgcacaatggatagtgcgatgaagaagagccataaaaatactcagctacaagtataattcttgttcaaaataggcttctgtaagttttacaattaattacgaaataaaacctctaaaatccaactgtgaatttcagtcatggtaaatggtgctaagattttttgctttgggttttttgttggtttgtttgtttttgtttgtatgtttttgacaaggtcttgctctgtcaccaaggctggagtgcagtggtgtgatcatagctcactgtagcctcaaactcctgggctcaagccatcctcccacctcagcttcctgagtagctaggactacaggcacccatcaccacaccctgctaactctttaaacatttttttgtaggctggtcagtgactcatgcctgtaattgtaatcccagcactttgggaggctaaaatgggaggattgcttgagctcaggagattgagaccagcctgggcaacctggagagacctcatctctactaaaaattaaaaaaaaaaaaatagctgggcatggtggcatgtgcctgtggtcctggctacttgggaggctgaggtgggaggattgcttgagcctgtgagttcaaagctgcagtgagctatgatcacaccactgcactccagcctggatcacagagcaagatccctgtctcaaaaaagttttttgtacagataggggcctcacttatgttgcctgctatgtttatgtgttgagttaaggctgaattggacccccatgtgtagtccaaagaaagtcaaaacctcatttcaattatttgctaacccaaacacaaaattaagtttatggggaagctttacgagaactatcaagtttgtttaaccatttgagagttttaccaagctgaaaaatgcccatactatacatttataaaacatctggctaaaaaatataattcatagaatatttgcttttgaaagctttaaatgaacatatataaaaattagattctggtatttataaagccaacaaaattcacatttagtttatcaaaaacatcattgtttgtttgtttgtttgtttgttgttgtttttacgtgttgttacacttcatcttttagatgtacaacagagagttgagtctcttcaagataatgaggagagatggggaagattggaaaaagaagaagggaaatggctgaaatgaaccatatttcccttctataacatttaactgatcttcatccttcatatttaatttgaagacatgggtatttgtcttcaaatatttgatctataaatattttgtacatcaaagattgtataatcagttaaattttttaaaatgtagtttctggcctttgagggtgtttgtttttatttacaggatcctgaaggatcagaagttgacatggtagaagaaattgatcatattggaattatctcttttcctgacttcaagattccgtctaatcctaggtatgtaaaaatagttgttaataaaaccacatacggaacttttggtgaagaagcaggtaaccagttaaagggggccacctaatgttaacaaagggtgtcacataggtggatatgcaaaatcttttgaagttctagcaagaacttaagctctgttcttggcaaaaaatttccaatacttctcagccattctttttacatatagaaataaaaattgggaagaggaaaaaatagtacccaggtttttttgtcataaaaaacatcaactcctacccctcaaagtatctaatagattgtcagtttaaaaggctggtgtggtcttgttccttgctctggttgctataaaatagggtcgtctgtagtttttgcctggataaactaccagaaggcaaagtccaagagggaaggagttctcagagctatatctattatttggcctcacatgaaaggatttaagaaaaagtttaaacagggttcaatgtaataaatattcaatgaacacattcttggtatgtgcaaatcacaataagagggagagatacaaaataaataatccacagtccctgctttcaagaaatttgtaataggccaggtgcggtggctcatgcctgtaatcccaacgctttgggaggccaatgtcggtggatcacctgaggtcaggaatttgagaccagcctggccaacatggtgaaaccccgtctctatcaaaaatacaaaaaaagccaggcgtggtggcaggcacctgtaatcccagctactcgggaggctgaggcaggagaatcgcttgaatctgggaggtgagggttaaagtgagccaagatcatgccactgcactccatgttgggcaacaggagcaaaactccaactaagatagaaagaagaaggaaggaaggaaggaaggaaagaaagagggaggggagggaggaaggaaggagggaagaaaagaaagaaagaaatttataatagagcagaatgaataagacaagtgcatctatacatggctgcactagaattttagaacaacatctttttatggtcatttttcctctgccctcagttaattcgctgactgaaatttttctaaaaatttaaattgaatttggaggttttaaataacttggataatttaaaaattgtgtacattcttgaaaatactacatgttccatagtgcagaattaaacctattattttattactgctatcatttctccaacttcatcttgtgccacttgccccatggcaaattatgtgctagccatggtctggcatgtccagtgctttcctacctccgtgcctttgcacatgtcatcccctctacttggaatgggcttcacctggctcttcataagcctggcttcttttcattgttatgacccagagtagaagctgctacaaaaaggctattcctggatgcatgatgtaatgtaatctcttgctttgttttactccctatctcagcatcttgtttattttcttcatgacacttatctcaatgtcataatcatttctttacttgcttgctggcatttttattccccactagcttataaactctttaaggtgggccttgtctgtattgcacaccagcagttcaacataataggcccttgataaatattcattgaattgatgatgatggtaataatcattattataatactattaacatttgtggacttcatagccaatctgcaaggtaggctcagtatatatatgtgtgtgtgtgtgtatatatatgtgtgtatacacacatatatacatacatacacacacacacacacacacacacacccatagtttttttgaaacagagtctcactctgtcacccaggctggagtgcagtggtgtgatctcagctcaccacagccttgatctcccgggctcaagcaattctcccacctcagcctcctaagtagctgggactacaagcatgcaccaccacaccagactaatttttgtatttttttgtagagatggggtttcatcatgttgcctgggctggtctcgaactcctgggctcaagcgatcctcctgccttggcctcccaaagtgctgggattataggcatgagccactatacctggcctagtatatgtttttgaataaaggttattaattaaagccaggtcattttcatcttttaaaaaccatgctttgtttccaaccataaattcatttttgtgaggtgtaaattttatcatctgtataagcttgtcttgtattatatgtttctagagacgttattatggattttgtactgtattttggattttagtattatgttagcataattaggctccaagattaaataaattctcagaaataataagttcttcaaatcaaaactaatgactgtattaagataaaataccaggaaaaataatacaatatatgaaaaactggttactaaacaatatctattatctattatcctaaaaatgctcaattatttattgcttaaaaatcagtcacaaataaaatatattacttaggttttatatatctttgtgtattcttccctctttaaaacaggaatttattagatctcctctgagtgaattaaaaacatttgatgacatctataattttaaatattttgcttccacagatatggtatgtggacgatcaaggctaaatataaagaggacttttcaacaactggaaccgcatattttgaagttaaagaatatggtaatttctgacaagtaaaagtttttctttgctttttgttttttgtttttgagatggagtctcgctctgttgcccaggctggagtgcagtggcacgatctcagctcactgcaacctccgcctcctgggttcaagcaattctctgcctcagcatcccaagtagctgggattacaggcaccaaccaccatagccggctaatttttgtatttttagtagagacagggtgtcaccatcttggccaggctggtcttgaactcctgacctcgtgatccacccacctcggcctcccaaagtgctgggattacaggcatgagccaccgcacccagccaattaaaagtttttctataaaaagttagtgttttgcaataattctttttaataatgtagttaatgcaaaattattcccagatgaagatgaggcagcctgtacgtatggctagaagtactggctagaggttggagggaggagtagtagttgaatgcctagattctagttccagcatgcctttaaccctgatcaagcagaacaacctctgtgtacttgtgttccccatcagagagctggaagagatctagtcccctgaagagcttgactagtaaagatcctttctagaattgtgattattattaggagaaacttaaatagtcatagatgaggtgagtggaacccagtaaaaccaataaatgatttacttgagtcttaaaaccaattagtgacaaaacaaaaacaacaattaggtttccttacccctagtccaacactattttctggctcctaaattcctaatatattcatttgaatatttaagatattcttattttgaaataaattatattaatagactaacaagtaacgtaaatagtttaatctttcatttcttatagtagtttactagcatttctgtgtgctctgctatcaaatttaactttcttctgcttgaagccattttttattccctcaagagattcataatgacatggagaagaataaatactgacacaaattttaacaattaacaagaaaaacagtgacaaaacaaattcgttatgatgaaactcaaccttaaagattacaggctctctgtaacatataatcctaacccatctcccttcttctaagtgtttttgtattttctctgtatatctagaatccacccacctcttactgtctgtagccactctcatcaattcatcagcactctccctcctggactacagcaaaagcctcctaactgatgtctctgcttccaagctatcttgcttggtattagccaaaataatcttgaaatgcaaatttcattatgttatgtcacaattgaaaagtttttttgttttcaaggaacctatactctaatggaagaaataacctattgcctataataaatgctgtaatcaaaatataggcaaagtgcttctggattgacctctgattgttggagtgggaaggttctgcagagattgttgttggtgatgacgatgatgacgatgatgattatgataataaagtggatgttgtgttgatgttacagcttgtccaactataccagaaagtctagctgtttgctaggctttaaagtctgctctaatcaaaatggtaatattacctgtttgtttttattttcagtcttgccacatttttctgtctcaatcgagccagaatataatttcattggttacaagaactttaagaattttgaaattactataaaagcaaggtaagaacatttgtttttttgttgtttttatttttatttttcaaattaactcaactctggttgatgatagttgcccaaagtgagatctgtgatttattatcaaagtgtgccatgatttggggactaattgataaaggagacatcatgctggtagttcatttgcttattctgattttagctgattctgagtttagctttgttggctattcaacagcaaaaacaaagaaaagtgccaaagatctaagtttggtgtatgtgtttagaaactagggtaacttagaatattgggactgagatatgaaggattcacttcctatctttttttaatgatttaatcagccagctaatgctgcgtaactacttcaaaacccagtgccttgaaactcccacatttatgagtcagctgggaagttctgctgatctgggccaggctggtgtcagctgggctcacccatgtagctgcagccagttggtaggtcagctgggggctggctggtctaggaaggtcctgtccatatgtctggcagttggatggggctaaaagtgtgtgtgcctctcatcatccagcaggctagcttgtagcagcagcaacactcaaagaggcaatggaagcatgaaagtccccctgagcctaggcttggtgctggcacaccatcacttccacacattattttgtccaaagcaagttacaaggtcagcccagaggaaatagacccctcccacactttgtggacacaatgaactgtgcaaaggtcgttgatacatggggaggtagagaattgggggttagttttgcaagcaacctatcacaaaagcttaggtcattttaaaattacaatataatgtagttataccaatctatataactatatgtgtggggtactcttctaagtactcagcatatattagcacatttaatctttacaacaactctatgcgttgatattgttactattcccatgttacaagtggaaaaactgaggtacataaatgtttaataatttgctcaaaatcatacagctagtaagttgcacagcctgtctgcttccagagtccatgcctcaaacattaccctatgctagctctcttattagcattgatttgaaaaatagagtgtttattacttggtctaaaccagcataaaaggctcacttgagagaaaattatagaaactgacctcctataatggggactatttattcaaaccataaataaggaaagttagctcttgctatagtattatttgctgggtagaaagtttactttattcttactttaattctaaactaaaaagggaaacatgcagtttaaattttttatgaatagatctcatataacagtgagattggacacgtaccttttaaaaacataaaagaaaacagagagtagctgatatcaaaattatcaaggaagtaatttggcatataggagagggccctgattctaagtcttgtgatctccccaagatcaatttttttcatctagcacatagctttattaatgtggctttatgaggatgaaatgtaatagtgcatgaaggacgctttatttattattattatactttaagttctagggtacatgtacacaacgtgcaggtttgttacataggtatacatgtgccatgttggtttgctgcacctattaactcatcatacattaggtatttctcctaatgctatccctccccgtcccccaccccatgacaggccccagagtgtgatgttccccgcactgtgtccaagtgttttcattgttcagttcccacctgtgagtgagaacatgcggcatttggttttctgtccttgtggtagttcactcagaatgatggtttccagcttcatccatgtccctgcaaaggacatgaactcatccttttttatgcctgcatagtattccatggtgtatatgtgccacattttcttaatccagtctatcattgatgggcatttaggtgggttccaagtctttgctagtgtgaatagtgctgcagtaaacatacgtgtgcatgtgtctttatagcagcatgatttataatcctttgggtatatacgcagtaatggaatcactgggtcaaattgtatttctagttctagatccttaaggaattgccacactgtcttccacaatggttgaactagtttacactcccaccaacagtgtaaaagcgttcctatttctccacatcctctccagcatctgttgtttcctgactttttaatgattgccattctaactggtgtgagatggtatctcattgtggttttgatttgcatttctctgatgaccagtgatgatgagcattttttcatgtgtctgttagctgcataaatgtcttcttttgagaagtatctgttcatatcctttgcccactttttgatggggttgtttgtttttttcttgtaaatttgtttaagttctttgtagattctggatattagccctttgtcagatgggtagattgcaaaaattttctccattctgtgggctgcctgttcactctgatggtagtttcttttactgtgcagaagctctttagtttaattagatcccatttgtcaattttggcttttgttgccattgcttttggtgttttagtcatgaaatccttgcccatgcctatgtcctgaatggtattgcctaggttttcttctagcgtttttatggttttaggtctaccatgtaagtctttaatccatcttgaattaatttttgtataagatataaggaagggatccagtttcagctttctatatatggctagccagttttcccatcaccatttattaaattgggaatcctttccccatttcttgtttttgtcaggtttgtcaaagatcagatggttgtagatgtgtggtgttatttctgaggcctctgttctgttccattggtctatatatctgttttggtaccagtaccatgctgttttggttactgtagccttgtagtatagtttgaagtcaggtagcatgatgcctccagctttgttctttttgcttaggatgaaagacactttaaagtgcctcaagtgctttacataatttcaaattgttacattttatctgaatcctgttattgtaaccatgttagtaaaacagttttatgctattgtctgacagatatttttataataaagtagtcactgaggctgacgtttatatcacatttggaataagagaagacttaaaagatgatcaaaaagaaatgatgcaaacagcaatgcaaaacacaatggtaagatgttaagacacagtcactcacacctacagatgcatccagaggtgagagatgagaagttacttaaaaaccatctagtccaatcccccattttagataggttgaaacttaaaatcctccattggcttccctttgcctttagggtaaagttcattttccttggcatcagcctcccttaccagctgatctcatgccctttcctccctccctcccctttgtattaatcactccaatttctctaactgaccaaagtctctcttgcctccaggtctttacaatatcatttattctgcttgaaaatgctctttcccattgtcacctcctgccccttctttgcctggctaattccttctcattctttaagtttcaacattgacagcctttctctgggaagcctcccctgactcttctacactaggttagctgccccggctgtatagcctcttttcttaacacattcttcacatttcattgcagcggttctcaactaggggtgattttttattcccaaggagacatttggcaatgtccagagacatttgtggttgctactggtgtttactagggagaggccggggatgctgctaaattcctaccatgcacagggcaggcccctacaacaaagaattatcctgttcaaaatgtcaataatgctgaggggttgagaaacccttctttactggaatggcttgtttacttatctatcattttcaatattaaactatttgtgagtctgaatcatttcccttatatgcccagagacagcatagtttcttgcaaggaaatattcatgaagttatttgtccatagtttagggctaatgattgctggaactgagattagggcgctggttccctttcccttattcagcgttctttacattataccacagatgatatgagttcatgtcatttttgctcactttttcgtattcatttggtttgcatcatcaatcatttatcctctacaatcttattaattcaagatgtaaattaaatgcatttttaaaatgcaaaattctatgctagacactgggatgtaaggctaaataagacaaaaatgcctgccctcaagtcgctcaattttataagaaaaaataaggcaaagtttattttactgttgtgttaataattaaataatataatatgacttaaccccacatccctttactcattgtgtgttttaaaattagtatttaaatttgtaagcagtgaagtacaaattaaatattataaaaaccaacaaactctcagttaagggcggaagtacgctgagaggcctataaagatgaatgatgacgcaggaattggaagaagtcgtgtttgtcagctattaccaaaaagacctgttggaccatgtgatgttcaagacccttctacttctataattctatacaaataattagaaaataacatcctgggcttaatcgtggactcggttatctactttacttttgacactaaaccattcttctgacatttaccttcaatttagaggttagtaaaagcagattttattaatttttccttataagttcttctccgaaataactcctcctttttctccttttaaaaagttgataaatggaattgctcaagtcacatttgattctgaaacagcagtcaaagaactgtcatactacagtttagaagatttaaacaacaagtacctttatattgctgtaacagtcatagagtctacaggtaagtgtgtgtgtgtgtgtgtgtgtgtgtgtgtgtgtgtgtatactttcttttgaaaaatatttagacagaatattaaagatataaataatttccaatttctataattatttcacattgtattttctttcatagttaaatataattataagaagtagacttttatatagttacaaaaaggcagtagggctctgcttctttttagtcattggacaagccattgggtccctattacctccacttctactgcaaaaatgggaaaacagtacccaattcatgtccaaagtagttctgcaggctctctgccttgaccatttggcaccctagtgtcctcacgtggtgaaaatcaaaaccaaaataagattatgtgtgtaaaactatttgataaagtactatacaaataaaagttattactattatcattattatagtctacataatgatggagtcaaactgaatgtttcctaaagcctaaagttttcaacattattttaatgtttcttctttttattttttcctcaacttattttaaataagttcagtttaagcagtatctatgagatatttaaagtattgccaaacagacaggcttgcaaacattaatgatgtatgatgccagcactaaagtggcttacaaattagcatcaggtataagacaggtgaagaaagaactgttgcaagaaagaattccatatgagctctaagcaaaatattaatgcaataggattcagaggaaggtgagcttctagatgattgttgagcaagcaagaacagtgttgtgaagatgatcagtcttgaaaaataattagggttttgaggcagagttgctagacagggtgaaatagaaaccctccagagagagggcagatgaagaagagtagatggtgaagcttaatctttgaggacagcagatcatccagtttggctaaaatataggatatgtatagaatgtattagagatgtaatattggaaaggagtttgggaatattaaagcttcaaatgttattcttaatagtttaacttaatctttacctggaggataacattattgggctcttgccagttgtctggtcatgtccccttccctccccctcccccctcccgctcccctccctcccctccccctcccctccccctcccctccccctcccccctcccgctcccctcccctccccctcccctccccctcccccctcccactcccccctccccctcccccctcccctcccctccctccctcccctcccgagtcttgctctgttgcccagactggagtgcagtggtacagtctcagctcaatgcaacctccgcctcctgggttcaagcaattctcctgcctcagcctcccgagtagctgagattacaggcatataccaccatgcctggcactttttttgttttcgttttttagttttagtagggatgaggtttcaccatgttggcccggctggtctcgaactccctttcagggttctttctatatcaagctccctttttctgatttctctctatgtatctatgctctgtgaacaccaacccccatcccccacctccacttctgtaaggctcagtttctggcctgacccttccctctctcctcaatcccttgaatacagtcaactgaaactcaggccactgatgaaaagtggtgtcccttcctggcatccttcctcagtccagtcctgtagctctacttctccaagggcttctctacatacgagcttgtgcataaggccttggaaactcctgaggtctaaactcttctctgctgtgcccctctgaagcaagacctatgtcctacttactactggtaaatgaatgaatgcaagaatggagtgagtgaatgaataagtctgtggagacatatagagatgaaatggatatccatacagatcatgatactcctaaaaactgtcaacatgatgcttgccatttccttaggtggattttctgaagaggcagaaatacctggcatcaaatatgtcctctctccctacaaactgaatttggttgctactcctcttttcctgaagcctgggattccatatcccatcaaggtagattgggtgagggggtagacgttgctacatatgatcatcttgttctgttcatggaaaacatgtgggtggcaaacagggtaagaatgttgccatgaagtcacagagggagcttattctgtgaaacctgcccctcctggtggacacagacagggatgggaaattgaaggtcagctgcagccttggcaatgacttcaaaagtgagggcaagatagccttgtattaggcatccctaaataagcattaaattacatgtaataaataagcattaaattatatgtaaataaaatctcataagactctagttcaaaaatacaaacatttaaaattatttggtggcaaattcttaaaaagccttaagatggagatatcattccttgaaaatagactcctttctctcactatgtttttgcctccagtgtgtctcatttgcttccctctgtctctgtgttgtctttgtgcataactctgttcaatctctcgtctctgtattgctctctgttcttttcatttttgcttctttccgtccctgaatctctttttttctgtcttttttgcttactcctctgcattcatttttctctctttcaccttcttttcctcctctaaatgctgacagtatagaattgaaacattcatgtggtttttagatttttatctatcattatatattttattacaaataatatattttattatgttgattaaatggaaatgtttattccctgcccttaatttagaaatccagagcaaaatttttttttgttctttgaaaatgtgttactttttaaaatcaacttaagtacaatcaaaatgtgttatttattatttactgtgggtcatgggcttttaagaaaaaaaaggatttaccaagcccaaagcaaggtttggacatgcttgtaggttcttacatatatatactatatatagaaaataatatataacaaagtatcatataatgcatatacagtaatatataatatatatactaaaatatgtaaatatagcaatattatatagaacataagcttaaaatatgtttatataaaagtaaaataacaaactatatctgtgtggaattgtgtgtgtatatatatatatatatggcagtgagaggtagatgttaaaggaaaaaaggtgtatctatttttgtttctcatattcaagggacttattcccagaagcgattgcctcattttctcctttatccagtcctaaaccaatcaaagaaatacagaagttagatagcagaagaccttatcacacctactccttgactgacttaatagaatgatatttatgttttgagtttgcttgatttatgggagaatctattcaagaatgatttaactaaatagaattaaatctttctataagctgagaatacacttctctttactaaattaaacataagtaaaccaggtgtggtggagcatgcctaaatagttccagctacttgggaggctgaggtgggaggatggcttgaggccaatagttcaaggttgcagtgcgctatgattgtgcctgtgaatagccactgcactccaacctgggcaacgtagtaagtctctgtctcagaaaaaaaattttcagaaaaaaatacataaataatttatactttggtggggaggaaggaaaattatttcagaattgtgctttaaaataagtgatgagctgttgaaatagatttggattgttttgacaaacaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtgagctgaattctcctgttgtattttctaggacaatgtgtactcttgaccatgtgttttggctagtgtgcagaacagatgcggcagattttacacatgagtccagtgaacagttccataattttgcatccaagacaaattagtcccagagacaatctgctaatccattgaatggtccttgaggaagataaatgtatcaattttttatttgggagttaattgttttatcttacaccgttaagaccatatcagactctagaagcttcagaataggtatagcagtgcacatgagtgttaggaatatcctctcttcccccctcacttttaatcccctgaagggccacaaaagggtcaaaaatatggaagcctcccttttttctaactacagaaaccattctactttagagcccacttaatagtcttctctcgcagcaaatattatttaagttcccaatctcaaataaaatatgagcaataacatagtaacatagttacaaagtaacttagtaacataataacataggccaatgactgcagcatgcatatgctcactgtcatctattgagcacttactaaatgctaggcatcatgctgagagctttatgaagaatacatgaaacaccatttaattagcaagatgagttagaatattatctttgccattgtgtggctcaggaaatggaggcttctaacctctcttttgattaactaattttatccagagttaataagtggtggtactggtatgtgaaccagtgtgtacctgactccagagcatgagctaataacacttctgctgtctgagggtagatattgctgccatgatatcatttcttctccacctcatatttataagcacccatctgtgcctctacttcacaatgaaactgggccagatagtctctgagatgttcgttcatagctcctgtccccaagagttagtgctacctccccactacttcccttctcctacccccatttcctaaatgcttaggcatctctctgtaatcatcccatgcgaggagaagtcccaacttaccatgacatttcaggaagaccaccaataattattcctggagcatctttctctcttcatttcagacttttccgccatagcccataatcccatcattcttgtctgtagtctttgtaaagttgcttgacaccacagctgtataaacactgaagtaatggagggttttttcccctttagcatttgttattgtgaaatttagaaatttataaagcaaggaaaataatttgaaaggtatgttttacagaaagcattacatcacagtatacatgtctttttgaaatttctcttttcaggtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttggtaagtacataatgatggatttacatcttattcccccacctggaacattttcctttgcctctagagaggcattagaattatcctttatacttttattcccaaagcactttcaagaacatcatctaacttgaacatcagtttctcaaaaaacctttgaaatagggcatgattttcatgaccatttcacagatgaggaaactgagggacagagaagttaaaagacttatgatggttactcagctgggaagaggaaaattttgatttgagctgaggactctgactcctgttctaataacactttttaccaaagagagcctagttattccaaagcgagaacctgattaaatcatgttgcctctgttctctttcatggccaaagattatatgcctagacccagttcggataagtgaattttattgtcaaaaaatggggaagcaaaatcctctcctgagaattgaatcctatcttgcctgttccaattctgtagctgagcaacatccctattgcatcatttatattaaacagaggtggatcgatgaagcctgttggtgaaaccaagaaaaaaacttacagaaaatattaagagcttcctgacaatcaccaaataaatggaatgaattatttcgacagccaggccaagtacatgctgttggcttttcaacatttttgaggaagaaattgaaaaaacagtaatgaggaccatagataaatattgactgataaagggaaactgtttatggactagataccaaatccatgtatgcagttctggtctctaaggacaatttaagggacctctgagggcattttggcttcacgtgattttttttttttaatcttaaaccttcaatttagaatctaaaccctggctttaaatccccaaataagatgcactccacttattcatctatttttttttaatcggtgaaacaaaaggggttttagtgacagtgtgatgactttgaacagtttttgggttcaaattttagctctctaatttactagttgtgtgattttgaattaaaatcagtatgacttttagtttctgagcctcagtttcttaaatgaggagaataatattcctcttattgatgtattgtgagaatgaaaggagttaaatacatgttaaagttcctggcacatagtaggcccataaacgttaactcactctttcttccttccttccttccttccttccttccttccttccttccttccttccttccttcctttccttccttccttccttctttctttctttcttttctttctttctttccctccctccctcccttctttccttccttccttccttctttctttctttccctccctccctccctcccttctttcttgccttccttccttccttccttccttccttccttccttcctttctttttggtggagtctcactctgtcccccaagctggagtgcagtggcatgatttcgactcactgcaacctctgcctcccaagttcaagcaattctcctgcctcagccttccgagtagctgggattacatatgcccaccacagtgcccggctaatttttttatttttagtagagccagggtttcaccatgttggccaggcaggtctcaaacttctgacctcaggtgatctgcctgccttggcctcccaaacttctgggattacaggtgtgagccaccgtgcccagccaaaattggtatgtctttttttttttttttttttttttttgagacagagtcttgctctgttgcacaggctggagtgcagtggcatgatctcagctcactgcaaacttcacctctcgggctccagtaattctcatgcctcagcctcccgagtaggtgtgattacagtcatgcaccaccatgcctggctaacttttgtatttttagtagagatggtgtttcactatgttggccaggctggtcttgaactcctggcctcaagtgatcggcccacctcggcctcccaaagtgctaggattacaggtgtgagccactgtgcccagcctaactttatttttctttaacataatttctgctccagctccaggctgcatcctaaagcacaggttttgtttttgtttgtttattttttacttattgttgctgctgctgtttatttttagattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggtaagccacaaattataagtcacaattgaattttcttttcaatgaaggaggctgccaaagttttagctgcttctgaaaagtcttgtctcatacaaatgatcttttcttttctttttcaaatgaacttttaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagttaagtaatgcatgtctcgctgcagtgttgcatgaagtgtggccaccaggctaggatatggaggaagaactaagggaagactaggcctgcttttctgtaatctactcaacatactcatttttaggaaggtaaaccatcctcctgtcagctcccaaagcacaggtcaatcctcttttgtttttcaaatgtaaatgtaagcactttaagaatatatgatcatggtagcaattacattcatggaggaaaaattactatcagaatactttggaggtttagggtagggtgttgatggcagttatagtagctagtagcagcacaggaaagacctgtataggtaacatttggattttttttaaattctcattgaaatccatagcacagaagaatctcaaaatcattcaattctcataagttcctatttatcttattatgttcagctattattttcgaggcttgaatgtctttgaacaaggaaggaaggactgagaaactgtaaaattaaaaaatactcggagaacgaataagcctgtccaaacaagtcttcagccatttagaacctagggacctccccaccaaaatgcacaaagttgtgcttttaaagcaacttaaaattaatttctatgttaattcagtccttcatgcattcatacctatttatttatttatttggaacattatattgattgcagcattcattctatgtacaaaacactatatatcagtttctaagaaactcctcatcaaagctatttgtttaagacttagttcttgatttaactttgaatagttatgtatttataaatacaaaaggacaaacttagaaacaaagttgggaaattttgtctttgatcatttgaaaaatatcatctgtgtatttcactggtttgtgataaccatgtaacaattagtaccttttagatctttagaggaatgatttatacatctcaatgtgctcaacattttgcctttctggacaggtatttcaattcttagagaagagtgatctgggctgtggggcaggtggtggcctcaacaatgccaatgtgttccacctagctggacttaccttcctcactaatgcaaatgcagatgactcccaagaaaatggtaaaatgctcagcatgtttattactgaaaatcccattgatcatttgccccccagatctcatttttatccttcttcccaaatattctgtaccctgatcttagaatgccaagactacataactcacctgtataaaatgtttcactggccttcaagataaagtacaaattctttagtgtagtactcaaaaccttccatgatcttcgccctggctctctccaactagctcttaccctgctgtgccttacgttatgtttaagctctacagaaccaagtggagttcttgagtggcattatgctattttgcacctttgggcctttatttattggaattggtttccccttcattagcctggagaagcaatgtaagaatcatcgcctctacaagacctcttccccacatagaatttataattccctcctcctttaatagggaggctattgcagggactagatctatttacaagttatagaacagcattgtgtcattgtgcattcttacatgtagttgtaagtcctgctcacctactgcatcaggagctctttaaggatagtaaccataccttaatcatcttctttctatggttttaaaattgttcataattatacttgatactgtggtattcatagttatatttgcaataatatagcacaaagagcaaataataaaaatagcatacccaacaaaagcatcactcactctaaatgcttaggtatttctctggaatcagtggatcagagaggctgcaggattcaaaaccaaattcagataaaataagtcaaaagatatgacactagatcatgaactccactaagataaaacaagtcatattaagaagtatggtgcacagttcctaatccaaagcagcccctcaatatttgttaaggaatgacttgtgaaggctctaaatacttaaatagtttcatggaatttttttttgagattttatctcctttttaatccttcttctttatctttttttaaaaaaaccagatgaaccttgtaaagaaattctcaggccaagaagaacgctgcaaaagaagatagaagaaataggtactgtaagattcatgtgattgtaaaaaggttatggtcatatcattcaaaaactggacaaaattaaatgttatataaattcccctaattgaaataaaatgaatgaaaagaaagatatgtatggaggtctagcttatctctctcagaaagattaatccaaataaagtctagtagttcatttgccatagccttaatctaaggaaataggtctttattacttcaagctctaaaatccaaaatattagcttttatttgtcataaatattttctctctgataacttcatctggcaattaaaatcatatccttccattttattctgacaaaatccatgatttgactattttggggatatacctagaagtctattacttctatttcatatatttaactgttagtagcattgttctttggaaaatacatcttgtgagaattattttaaaataattatttaaatggttatgataattcgtcatgttactgtagaaagaatatcaaactgggagtcagcaaattgagttcaactaatatcatgcctatggtaatataatagtttcttccatttgtatatgagttattttaattctaacctttattctaagttctaatgatatgaaaagagagacattgactaatctgagcacttacaatgaaggataatgctactaggtgaagtccacaaaccatgttatataagaagtttttgaaaaataggatattcagcttgaagaaggaaatatttgtatagtgatgatagccatcttcaaatatttgaaggcttcttggatatttaacttattttcttaaaaaacattttctattctttttctatatttttctgcatattttcagcagaacccaaagttccagtttcaagagttagtatttagcttaattgcaggaaaccctttaaccatttagtgtgagctggaatggaccatttggtaaggtcacattctccccattcttagaatagttccaaggggagtctggacagtcaactagccataactattgtgggtagggggatcatatagcaacagaaaccaggtatcccttgagattccttctaagcctgagatgttatcactctgcgtcatcaagagcacttgcattattaccatttcagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacgtaagtatgacattttctatcagaattctgctcaatatggggaattttgtgtaattttatgctgctaagaaaggcagttttcatgatctatttagaattgaaagtagaaaagataacttgtaaatgtccataagaaaaaaaaatccttcatttttgggcatccgaagaggtacagtacagagcagagtacactaggccagagttaagacctggcataaccttaaagccaagtcatcccataaacttgaatgattatttatcctctctgagcctcatgcaaggagcttcgaccagatcctctccaatatgcctgtgagttctacaagtctacgcttttgtgatattacaaccattaaaaattctgtctatatctacattgatgaaataaaggagaatatttctaaatctagcctaaggttaagtgtacttatataaaagctgatgtcttatttcagtttcaaccacaatacatgtttccagaatttatagaactctcattaacatgttttcagaacttttaggactttatatatagtctttttttttttttttttcagtaggaatctggctctgtcacccaggctggagtgcagtggtgcaatcttggcttactgcaacctctgcctctgggttcaagcgattctcctgcctcagcctcctgagtaactgggattaaaggcgcctgccaccacacctggttaatttttgtatttttagtagggacagggtttcaccatattggccaggctggtcttgaactcctgacctcaggtgatccgtccacctcggcctcccaaagtgctgagattacaggcgtgagccactgtgcccagcctatgtatagtctttaacaaaacaagcaaaagcaaaatgacagcttctgttttatacttatgtgtgctgcgtaatgacattttcatcaatgatggaccacatgtgcaacggtgatcctataggattataataccgtattttttctgtacctttcctgtgtttagatatgcttagatacacaaatacttatcattgcattacagttgtctgcagtattctgttcagtaacatgctgtacaggtttgtagcctaggagaaataggctatactatatagtctagatctgtagtaagttataccatctagattagtgtaagtacgctccatgatggttacacaacaaaatcatctaacaacatatttctcagaacatagccctattgttaagcaatatctaataaccataattttggtaaatggccacaaaatttatgtttgtagaaatatattcattgagatgtacagtgtctaagattcagattgttttccaatatttgttttgctttgtttgtttgtttgtttgagagacagagttttgtttttgttgcccaggctggagtgcaatggcgcagtctcagctcactgcaacctccgcctcccgggttcaagcaattctcctgcctcagcctcccaagtagctgggattacatgcacctgccaccatgcctggctaataatatttgcttattataagcagaattttaataaacagtctagtccatatgttgtttttctttttggagggaggatttggcttttttttctcttaattttttttaatttttaaatttatgtgggtaaatagtatttacggggtacacgagatactttgatacaggaatgcaataagtaataatcatatcatggaaaatggggtatctatcccctgaggtatttctcctttgttttataaacaatccaattatactcttttagttatttttaaatgtacaattaaattattattgactgtagtcaccctgttgtgctgtcaagtactaagtcttattcattctttctattttttgtacccataaaccatccccacatccccctcatcctcctactacccttcccagccttctactctatatctccataagttaaattgttttgatttttagcacccacaaataagtgagaacatgtgaattttgtctttctgtgcctgacttatttcacttaacataatgacctccagttccatccatattgttgcaaatgacaggatctcattcttttcatggctgagtagtactccattgtgtatatgcaccacattttctttatccatttatctgttgatggacatttaggttgcttccaaatcctgactatttttaacagtgcagcaacaaacatgggcgtgcagatatctcttcgatgtactgattttctttcttttgggtatatacccagcagtgggattgccagatcatatggtagctctattctttgttttttaaggaacctccaaactgttctccatagtggttatagtaatttacattccccactaacagtgtacaagagttcccttttctccacatcccctccagcatttgttattgcctgtcttttgaataaaagccattttaactgagatgagatgatatttcattgtagctttgattgcatttctctggtgattactgatgttgagcaccttttcacatgcttttttgccatttgtatgtcttctttagagaaatgtctattcaaatcttttgcccatttttaagtgggattattacattttttcctgtagagttgtttgaactccttatatattcttgttattaatctcttgtcagatgggtagctgcaagtattttctcccattctgtaggttgtctgcttactttattgattcctttgctgtacagaagctctttaacttgatgtgatcccatttgtccattttggctttggttgtctgtgtagtggggtattactcaagaaacttttgcccagaccaatgtcctagagagttttcccagtgttttcctatagcagttttatagttagaggtcttagagttaaatctttaatcaatttttatttgagttttgtatatggcaagagataagggtcacgtttcattcttctgcatgaatgggataaccagttttcccagcaccattaattgaagagactgtccttcctccaatgtatgttcttggcacctttgtcaaaaatgagttcactataggtgtgtggatttgtctgggttttctattctgttccataggtctatatgtctgcttttatgccactaccatgctgttttgaattatactatagtataatttgaagtcaggtaatgtgattcctccagtttttttctttttgctcgggattgctttggctattctggtcttttgtagttccatatgaattttaggattttttttctatttctgcaaagaatgttattggtgttttcatagagattgcattgaatcagtagattgctttgggtattaaggcgttttaacaatattgattcttccaatccatgaatatggaataactttccatttttttgagtgtcctcttgaatttctttcattggtgttttatagttttcattgtagaaatcttttacttctttggttaatttaattcctaggtatttaattttatttgtggctattgtaaatggtattactttttaaatttctttttcacattgttcattattgacatatagaaatgctactgatttttgtatgttgattttatatcctgcaactttattgaattcatttagcagttctaatagttttttggtggagtcctcaggtttttccaaatatgtgatcatatcatttgcatacaaggataacttgacttcttgctttctagtttggatgacctttatttccttctcttgtctaattgttctggctaggacttccagtgcactaggacttgcctagaaattgcagtccttgtggcctagactgcccctcaagttaacctagggccctagagcactccagcccatggtggggaggcttgctggaactcaagctccaaccactgggatgagcgatgcccctctggctagggccagtccaaatgctccctccatgggcagacaccagctgagtacagcctggttctgctttccaccgtgacagtgcaacactgagttcaatgcaaagccacagaatgactgcactctccctctcccaacacagagattctccatgctgcacagtcactgctaggggatgtgggaggagtggcattggtgcttcaagactatctttcctgccctcttcaatgtctctttcagtgatgtaaagtcaaaaccaggtactgtgattgctcacctgattttcggttctcttgatggtgctttttgtgtgtagttagttgttaaaatttagtgtaccaacaggaaagacaaatggtgtaggcttctattcagccatcttgctctcccctctcatatattttttcgtttttcaatttttcaactataatcatctggcttggcttcagctggatagaagtctctctctgcagccccctccttcctggaactctccctcattccagacaagttggccttgcaaaactcccatcagtgttgccacaagtcttcaaaatcatcaggctctgcttgtattcctctccctgccctagtctgtaaactgcctctaggcagtaagctggggcaattttaggtttcacctaattgtttcctttctcttagagatcacagtcttgcttatgctctaatgtctgaaaactgttattttgcatatcatgttttgttttctattaaggcatcttatatgaaaacagaagttcagtccatttttattaaagtaaatataaacaaattaccaagttaaagaaggcagagaaccatataaagcctccttttttctaatataaacacaattattacaattatatatataagtgcaaataactttatagactgatcgatatcttgtataatctcaggaatactaaacatttagcaatttaagaaaaaaatcattaaagatatttaatgctttgttttgccaatgctattagtggaaaaatcctaaggcctttatagtttgtttgtttgtttgtttgtttgtttgtttgtttgtgacagagtctctctctgttacccaggctggagtgcagtggtgcaatctcggctcactgcaacctctacctcccaggttcaagtgattcttgtgcctcagcctcctgagtagctgggactatagacacccgccaccatgcccagctaatttttgtgtttttagtagagacggggtttcaacatgttggccaggctgatctcgaattcctgacctcaggtgatctgcccacctcggcctcccaaagtgctgggattacaggcatgagccactgcaccctgcctataattctattttggaagcattaaacaaaatgttttatttacctttcagaaaatgcttaagttacagattaatggccatattttaaaattcacctataagtagaatttatattgtttttccataattgaatatgatttttttgtccagacatgaagaccctgttaccagtaagcaagccagaaattcggagttattttccagaaagctggttgtgggaagttcatcttgttcccagaaggtattatacttctttcatgtttccttgaaagaaatgtggataatgcaagtattatggccaaaaatctagaaactacccatttcccaatagcttgcataggagttaagatgatcctgcaatttgatcaaattttgttttgttttgctttgcttttttaaatttttatttttttaatatacatcgtactggtgattggctccaggtcagaatgaagaagggtgctattccatttaattttatttgacttcagtatgcatttactacacacaactatgtgcgatacactatattaagccactatttttatcctaaaatatctgtactataaaacaaacattaataaacaggaagaaaagttttctttttaaagttttctattcaacacattttaaggaaacacttcctctataccactgaaaacagtgatgggctgagtcctcgagccatactcttcttagatgggcttaaagcactggttttccaatgagaaggcaaggaatgagttcaaaggcctgcagttgtctcctcacgcatctccttatttctacccttgtcttctctaatccttcttccacacaattgtccatttcatctgacattacccattagctagcatgtcctctagtaaaccttctggccactgctccccacactaccagtgattggattaattgcaccctcaattaaccctgttgtgtgtatcatattgtattataatgacttgtttactttcctgtcttccacattaaaatgtaaatacctcaaaggcatgaactaaattcagattactgttttatatccaggacttggcctaggatactgaaaataaatgtgttgaacgaatgcacactgcctctgaactcttataatgccttattggtacaattattacagtgcagtgtaatttatttacttaactatttcttccactagattgtaaactgcctgagagcaggactgtatcttatcagtgctgtttactcagtactcagcactatacctgatacaaagttggtagacaatagctgtaaataaatatacaagcttaatcataatcagcagtttttagttatgtcaactttgttttgagcagtgctaacatgcatcactttgcttccctattttagaatatactcacaacaaacatctttttctttgtttgtgtgcttggattttgcaatgtttcaaaggcattcttctgaacttgaattctcatcatagaggtgcaatgtctaaaaacatgcaatatataagagagttactgaatatatttttcttgatgaggttttccttaatgatgtgatttcatctcgtgaatttttttctttctctaaagtagtttgaagcaaaaattctgttaatggatgtctctgttaagttgggttaatcaatattccactgtatttgaatatcaacattttaacttccagaaaacagttgcagtttgccctacctgattctctaaccacctgggaaattcaaggcattggcatttcaaacactggtaagcaggtttaagtgatatatgcatttaaatagtgatttgattagcaagatgtaattctttgttagtatctatttagtttacccaggacttaaatggtagcaatttttaaaaaatattcttttttttatgtattaccaaaagacttggatatacccacatctttgaacatattgatttctcctttcactcctctcttttttttctttttcctttttttgtaaatgaagaaggggtctcgctatgttgtccaagctggtctcaaactcctagtttcaagcaaccttcccacctccaccttccaaagtgctgggattacagcttgagccactgcacccagcctcaagtctttattttccttcacttttctcactgactgggagcttgtgtagagttagaaacaaataaatgaactctcttgggctgatctttatgatgattaagtgcagatgctttccaaatagcttcaggaatggttttgtttgtttgtttgctacttttgttttaaaatcttggtttccacaatcaaaattttatactcattaaacatggagccaataatgaatatctaaaaagatttggtgtgttagttgataaacattctcatgccttaaatagaattaactatttgttgaataaatgaagttttttgttaatactaattattattgaaattaagatcaatgaatagaaaattcaaggacatgagttgagagttcagagaaaaacatgatctaatattattttttccttgaagtaaagcaaatgtgagaaattttaataccaataaaacattataggaatttcctaatatgattctactttgcttccactttgggctgaaggtatatgtgttgctgatactgtcaaggcaaaggtgttcaaagatgtcttcctggaaatgaatataccatattctgttgtacgaggagaacagatccaattgaaaggaactgtttacaactataggacttctgggatgcaggtaagtaggtgttaatatttatgggataaaggaaacattctctggttttctgagaattctattagtggaattaccatacacaaaaaagtagaagttcaactcagttcagcaatagaaaccaaacacttaaaatgagcattgtactatatgtgtagggatgtgaattaaagggatgaaggaaggaggaaggacaagtaggtattcatgtaacttcaattgaaagaataaattgcataagataatccatgtgctgtggaagtccagagaagggtgaattcatctttagttcctttatttgcctatactcagagttccttgatttccttgattctaacaaccctttcctccattttagccattcatactcatcttcactttatagatcttatcatcctctctgaaatcttgatttcagacattcacatctcaccatccagtgacaacctccttcctgtcctcctaactcattaaccagattacttccatagctctgggtcagtagcatcactgaaaccttcagtccattgactcaatcccttttattgtcctttacttccctgctctttttactttactccttgttcagattagaattcaccagccatcattaaaaccacactgactaaaattatgccaactccctggatcctatctcactccaggacacaattccaaccatgattggacccaccatttatcttctctttgccagcacacccctaaagagaattatataataggctgactgatttgatttgaaaatcacagtcacaaaactttgcatgagaattcaatgtgttccaaaattctagctatatttttttaaaacactaactttattcttagagattagaatttcagtggtttcctaaaattttgcttacataccctcttgttttggaaaaactatgtatccctctgacactttttttttttaagacggagtctcgctctgccctctgacacattttaaaattggcatctaaaatttttatcatacattttttaaaagatggcaatctattacttttaaaatatttaaatattggtatcttaaaataaaactgttttatcaaacttatgtatagcagactccaaataccatagcaatcaattttttaaatgctcaaataagcctttttttttcaagatggggtcttgttctattgcccaggctggagtgcagtggtgcgatctcggctcactgcaaactcctcctcccctgttcaagcaattctcatgactcagcctcctgagtagctaggattacaggtacacgccaccatgcttggctaatttttgtatttttagtagagacaggtttcgccatgttggccaggctggtctcgaactcctgacctcaagtgacccacctgcctcagcttcccaaagtgctgggattacaagcgtgaggaactgctcctgggctcgaataagctcttagcaacagattacatatcattccttttcctcaatgaattcatatttccattttactcccctaatgttacatattttatgcatgaatttttttctgttgatcaccttattatactttaatgaacaaaaatatgcacatacattgaaaatgaaatatcttaaaatttcatgattgtaaaattccaagtatcaaatgatatgtggatttaggtatcattacaaatattattattagtatactattgataaaataacatatttctaaagttattaaatatagaaataaaattttatttaaaaattctcttctcggccaggagcggtggctcaggcctataatctcagcactttgggaggccgaggcgggtggatcacgaggtcaggcgatcgacaccatcctggcaaacacggtgaaaccccatctctactaaaaatacaaaaaagttagccaggcttggtggcaggcgcctgtagtcccagctactcgggagacagaggccggagaatggcgtgaacccgggaggcggagcttgcagtgagccgagatcgcgccactacactccagcctgggcgacagagcgacactccgtctcaaaaaaaaaattatcttctcattagataaatgaaatttttctctcaattggcttaatagttatggataaatgttatttattgttagaaatgagagagagtttggcataaattctattcttatttttcatttttatagaggtaggcattgctgttcaacccaattttatcaggaaggttgataaaataaaaatattgtcaattttattacccctttatcaatatattttaatcttatatcttggagcttcacatttagcttattcaatttatgtaatatgtttgtcatataatctaactggaaaaatcagtcctcattgataaaatgatcagcgaaaatcagacttactctttgtcatagaaatgccaatttcatttttcaatccaaatcatgttaagaaatgtcactctttttttcacaattttaattttcagtaaaaatgaacttttccatataaacttgtttcatcaggtaacactaaatatcagagaatgcacacacaaattttacttggccacaggatgtaaatggggaataaacttaagtaatcagaatttaccatactgatggtattatcttttttttttttctttttttgagacagagtcttgctctgtcacccaggctggagtgcaatggcacaatctcggttcactgcagcctccgcttcccaagttcaagtgattctcctgcctcagcctcctgagtagctgggattacaagcatgtgccagctcgcctggctaatttttgcatttttagtagagacagggtttcaccatgtggtccaggctggtctcgaactcctgaccttgtgatctgcccaccttggcctcccaaagtgctgaaattacaggcatgagccactgttcccggccagtattatcttatttttacagaaataaaatcaaaatgttactcatttctcttccttagaatttactcacagggtttgcataaatcctatgaatcatgccaccatcttcagccctgtggaattgccctccctcatttggctccatccccaccaccctaaatacaacgtgaagagttggagaaggaccttgattaagaagctgtaaagttgcctttacattatttcttttaaacccactagcttttctgcagacagaatgcttcatgaatttaagataatcataactcagatagagataccaaaggccatttctccatcaggttcctgtagtggttttcatgtctcaaaatcctgattcaagatgggcttgaggcttggaaactgagatactaagacagtcagaccatctcatcaaaacagactcagcataattttataactcacactgatcttggctaccaaaggattttggtagatgattaaggaggtgtcactcttaaaccatgtaaattgtaatttgagatagacacataaataggtggccataacagatgggtaaggcacagaggccacagccaaactctgctcaactgtaggattgagatcagcaagggctcctctgctcacctagtcttagacatataaaatcggcttgtgtaggtatgtgtgtatatatatatatatatatatatatacacacacatatatatatacatatatacatatatacgtatatatacatatatatacatatatacatatatatacatatacatatatacatatatatatatacgtatatatacatatatacgtatatgtacatatctacatatctacatatatgtacatatctatacatatatacatacatatatatatatatacacacactgcctcagcaatttgtgtttccaccaataatattatcagagacatcctttcatatcagtatatacagatttacttcattactttaatggctgcacagtaattcacatggtgggtatactataatttattgaaccatgtttctattaaagacatttgggttgtttacaggttttcactattataactgattttgcaaagtctccatttatgcatacatatcttcctacatgtatatttctgtaggatagatgttttgtcttggagtgaactaactgggctaaagggcatggacattttaccttctgataataaatattgccataattatcttccaaaaggattccatcaattgacattcttaccaagtgtatgcaggtagccttgatccctcacattcttataatttgggggaataaacattttttcttttattcatacaatgaacacttatacagaaattgaaatgaatggactagataactacatgcatcattttgattaaagctcaaaaatgtaacattgctgaaaaaagcaaattgcagaataatatgtatacacaatgaatacaactacataatatttaaaaacatgaaagaccgcgctatatattgtttgttaatacacataaaatttttgccaagttgacagacacaagtgatatgtcactgatgtttctatttcactaccctgattactagcaatgttgaacctcatttcatttgtctgtggccatttgtatttcttctttcatgtattctatgatatcctatatactactttaatatcctttcttttgctttccattgagttccttttttctggggtaagttacctagcttcttcttgcttagtttcctcatctgacaaatgggatgataatagtatctatttcatagttgaagattaaatgagctaattcatgtaaatatagtacttggcccatagtgagtactcaacaaatgtacttattattgtttacaggagcactttgtatgttagagctataaattctttattgattataaatgttgctggtatttaatctgctacttgtctttaactttgttattagtgtttttaatttgtatgttataaaatctgtagatcttttcctttatgtcatttgagttttgtgtttttggaaatcttttctcactgcaagttttaaaaacgtttttctacaaaatactgcatgttctcacttataagtgggagctaaacattgagtatatatggacacaaagaagggaacagcagacaccagggcctgcttgagggtggagggtgagagaagggtaaagatcaaaaaatgacctattaggtactatgcttattacctgaatgatgaaagaatctgcacaccaaacctctgcgacacgccatttacctgtacaacagacctgcacatgtgccccgaacctaaaataaaatgtttttctaaagaactgttttttctatattttctatagtacttttatagttttttgtgagcatttagatttttttatctgaaataaggatctaatcccaaatagccagatgatccagcagtatttgttaaggaattcatgcttttccaactgatttaaaatgtcatcttgcccccatatatattgaatttccatatatgtggatctatttatagattctctcctctgttttgtttacatcagtatcacactgatttaaagtaccatagatttgtggttatattgtataactattaggcaagtactctctggtattcttatttttcaaacgtttttgatgttgttattcttacacatttactctgccagataaactttggaattagtttgttgaattctccttttaaaattataatagggttttcatattgtcctgaatttatgaattaatataagggaaattgacttgccatattgaatcttttacatctctttatccttttgctttatgaactaaatcaagggtcagcaatttatggaccatgggccaaatctagcctgccatctcttttgtatgtcctttgcaataacacaattatatataacttgacagcattttttttttttttgagacagagtctcgctctgtcgcccaggctggagtgcaatgggaagatctcgggtcactgcaagctccgcctgccaggttcaagcgattctcctgcctcagcctcccaagtagctgggattacaggcacacaccaccatgcccagccaacttgacagcattttaaagtgtcatgcatatcactatactgccatattttatttaatctttaaattttcagtgcatttccatcatatcaaaataagaaacaagtacatctgtgatattttgggcttagttcctgttaattacctttcctcctgagtgtgggttacactttcctatttctttttatctagtaattttggattgaatcttctactttattaataaaaatattataaagactctggattctattacattcctctgaagatttttcgtgtgtgtgtgtgtgttagcaggcagttggctggattcagttccagactctgaaatctcagttcagtatttttagccttagctggatgctagaaatctgtgctgtgcataggtcaagggtcagccaggtttgagcaaggattatacacagaacttggagttccttcactattcagctgtggtaactattccctactttgtcctctagttcctaaaccagtatgatgtcaggttctactggggttttagccactccaaggcaccaatgggacctgccctcagggtaaagctataaaaagcgggacacttattcagtgtcattcccttctcccaagtgtcactttccctcccactctctagtatctgcaggtagtttgttttaatatgtatcttgtctagagtttgtggttatttttacagaaaggttgcccaatataagctatttggctattactgaaaccagaaccacttttttttttatattttctatcagtttcaaaagttccttttagtctcaatttactaagagtttttgtaatgcaattatgctgaattgtattaaatgactcttctatatctatccttccccaccctcccctgctgttctaaggaaatcattggccgcaggtgatccaatagtcttttgctctggcttctcccaccctggtggttgtctcccaagaagatagttaagaaggaaaaggaactttctgttttcaagaaattcctcaaaattagtggttgaatagctggtgctctcttttgtttacctgcttgacttattctggattttatggatttattattttgggtatagttctcaattctatcagttcaccagaatttggagggaagatgaaaaatgtttactatttgagccagaagtcagtgggcactattattattcccattacaaagatgagaaaatggaggattagagagttcatgcaaccagtttccatcaccagttaataagaggaatgccaaaaattgaatccaggtctttctggagccagagtttggttgtaaaatggggtacaaatgggaagttgataaaattagaaaagtaagctggggacataatgggcagggccttgaatgccgatatagggaattttcagtctttgatgaaacccatcatttactgaataccagaggctgagctaaaagatacaaaaatgaataagatgaaaatgaaaaagtacctgagcctaaggctcccactatctgaaacacaaacatgtaaagagacagggtaataagtgctatcacaacagcatgagctctgtacccaatttagtacgtaacagtctaagaaaggtaagatgtttctgagacagtgttgacttttctagacatctgtttgcattgctaaactctacggcaacttgtgtgtctatgttaggaaatctgaaatgaactttcttctgtgccttagaatctaagggattattttaacattgttaaagtggagagtttgtgtccagacaagcataatcaaggtcaacttttttagagataaagtatttcgagtctgggcacggattacagcatcatgcctgtaattccagtactttgggaggctgaggtgggcagatcacctgagatcaggagttcgagatcagcctggccaacatggagaaaccgtgcctctactaaaaatacaaaaattagctgggtgtggtggcgcatgcctgtaatcccagctactcaggaggctgaggcaggagaattgcttgaatccaggaggcggaggttgcagtgagctgagatcatgccgctgcactccagcctgggcgacatagcaagagtctgtctcaaaaaaaaaaatgtattttgatataattcttcacttgtatttcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtggtaagaaaaacatgcttcaataacttatgcttaaattattgcaaaagagagacacagaaaggggggggagagaaacaatagtgtaaatttaacgaaacattaagcattaaggaaactggatggaggttattccagattttttttgtactattcttgcaatttttctgtaagtctgaaatcgtgcttaaaaatttttaataaaacaatatttgtttcgtagaaaatataaaatactgaaaaacgacagataaataaaaatcatcaataattcccatacccagagatatctaattttaacaattggtacacgtctttttttggtatacaggtacaattggtacacaggcttttttttccccttaatacattcagaaaatgtgtcttgaaatctatgtgccagacattatgcaaggaactggagataaaacaataaataagacatggcccttgaatttaaagaacttgcagtctagaaaactttccattgtataaacaaataaacagtcccaaaaaagaagaaaagtataatttgttaagtacaatttacccacagtctgttaattgtattcacgttattaacattaatatttttatgtaattttaatatttttatataattttaatattttatataagtatgatttaccaattaaaaataatagtacttttaaaggactaagattcttgctaagggtcatatggccaattaatgacagactggatttcctggctcttcactctctgttttcagctatgaaattcacttcagtaaacatgtactgacttattttgtgcaaagcacattcccatgcatccttgcactgtggttccatgcagtctctggagcgaggctgctgggccttgaatcttggctccatcacctcctagcagtgtgacagtgttacttgatttccatgtgtgtcagtctcctcatctgtcgaatgggagtaataacagcaccaacctcatagaggtttttagaggttaaatgagttaatacatataaagcacttagaacaattatctggcttataaataacttctttttaagcatttgctctggtcaatatgcaaatagccataaaatcttattgctgcttatatccatgtaagtatttatacatagtttgccttttccaagaaaaataattttttagtttgaaaagtggtccagaaaagttgatccagggaattcaggttatataaacttatgtttttaactgaatgttttctgcctttattttagccagaaggtgtcaaaagggaaagctattctggtgttactttggatcctaggggtatttatggtaggcaaaatgattttttattttatatgttatcttttgctttagaagttaaagtgtgtatgtaacttaaaacactatttttcagaaagtgagttgtctaaaatcagtagtatccacttctggccaggcacagtggctcatgcctgtaatcctagcactttgggaggccgaggtgggtggatcatttgaggtcaggagttcgagaccagcctggccaacatagtgaaaccctacctctactaaaaatacaaaaattagctgggcatggtggtgggcacccatagtcccagctatttgggaagctgaggcaggagaatcgcttgaacctgagaggtggaggttacagtgagctgagatcgtgccactgcactccagcctgggcgacagagcaagactgtgtcaaaaaaaaaaaaaaaaaaagtatccacttcttagatcactatctttcttgatagcattatagtacaactactataatctgaatgactgagacacaacaataataattccattaattttgaatgcaaggccttgaaatagtaacaattgcatgacttccctcatatattattcattgtctatccatcacaataataatttataatatattattattgagccaacagtccaaagaacacctaagaaaaagtcatttacataattaacatgcattatttgaaaacataataatgctaattaatcactaaacaaacccattcctcattgctcctgcttccctacttttccttcaattgagatattccaaatcttctcaaagctagaattttgcaaacatttgagtacttaatcaaggcctaaatacatatacatgtatttatgaaatttaggatgtggccagttaaccattctcttttcaactaaagaagacagattactgcagttcttattaaatgcttacaacttatcttaacgttgtatcaataatttttgttttatttcaatgatataacaatggggaaaaaatttacttacagatcatgatcactatcatcagtgtcatttcctctgggaaagcaaagaattaataccctttacactttaattcatctgagtatcatgaactgaggagtgttatttcagtagagtaataaaaagtaaaatccatctatgtacatgcgtccacatgcttacttgtttctccaattttttcttcacacagacctcctccttgcctgctcattgtgaatgatctatgggtagagatattacaagtttcaagggttttagcctcatgcaattatatcaagcctcaaaagccactgtgtccttggcttctctttctttttttttttttttcaccacagatgctgcttctgctgacattattgcaaacaattttccagagcagtcttgccttactcatcctaggtgtgaacatcaaggccacaggataggaacaatcttttatctgggaataaatctctgtagagaaaatctgggttaaaacaaaaatctgtgcctctttccaatcttctcatatgacttttttcccttaacattttaggcaacttgggtttaggcagctttcctgatttctgcagagctaaagagggaaaagataaaaattctgttcagcttatttcagatattttattaaatacttctaatatttattatttttttttgtggggtggggggacagggtctcactctgttgcccaggctggagtgcagtggcgccatgtcagctcactgcaacctccacctcctgatttcaagcgattctcctgcctcagcctctggaatagctgggattacaagcactcaccaccatgcctggccaatttttatatttttagtagagacggggttttaccatgttggcaaggctggtctggaactccttacctcaagtgacccaccagccttggactcccaaaatgctgggactacaggcgtgagccactgtgcccggcctatttctgatatttatatattgaaatcgctatacaactatgatactttacagggttcagttaaaaaaaaatgctaaaaagtgtttggaaaaataaatggactataatgttaaaggaaatctgaaaaaatatatcaatgagggagaacaaacagtatatagtaattaaaattgtgtgacaccagcttaaaaaaagactaaacacagagactcaatgcttaagactagctctagtctttagtttctgctttctgtccctgataagcccttttctcccaactcgtctcatatctcaaatgcagagtgttaagtttctcactccctcatttcctgacacaccatcctcattggtttaggcaggcccctctcgttttattttttccttcatcccggaccccattcccattccccttcctccaaatgtacccactcaaatgtgtttgctgtatacttttgaatagaaaggtaatgttgttttgtatgtatgtacctctttaatctatgtatatgtaacattgtgctatagatcctattctgtcttaagttgttacactcaaggcttagttttaaagaaatatctcggccaggcgcggtggctcacgcctgtaatcccagcactttgggaggctgaggcgggcggatcacgaggtcaggagatcgagaccatcctggctaaaacggtgaaaccccgtctctactaaaaatacaaaaaattagccaggcgtggtggtgggcgcctgtagtcccagctactcgggaggctgaggcaggagaagggcgtgaacccgggaggcggagcttgcagtgagccaagatcacgccactgcactccagcctgggcgacagagcgagactccgtctcaaaaatatatatatatatatactctattgttataggtatacttaattcatttttcttacatagaatttcagagcatgttccctcaccattttatccatcactgtatatacaatatatttcccttgaaaaatccatgttagcatttacctggaccatatatccaggagctgggtcaaaggatatatacatatttaatgccatttagtcctgtcatattgcccttcagaatggttatacttccattagcagtgcacgagggttctcgtctctccacaacctcaccaacacttgcctctctaaaatgtggcatttttaatgggtataaagcactatctcattattgttttaatttggattcttctggttactaatgattttaagcatttcttcatatacttgtccatttgggtttcccatctgtcaattgcctattcatatcttttgcacgtttttaaattttctatttgggttatccttttaaaatttcttcttgattttgtctctgatgtacctctttgagcaacaacaagccttcatgggtttgaaaaggaattatttattctgatgtagtcaaatccatcataatttcatcttatggttatatatttttgaggtaatctttaagaggtctttctctactcttagttcacaaagacattgctggatattttattctgttaattttatagatttgaatttaaaatgttttaatctgtctggaacctgcctttttatgtgatgtcttgatgagtcttttaccgtgatcactgatgaggaataaaattaacttctcttagttttaactttctctttaccttttccacctggtagtagagttgccaatggaattgaaatagtcaagagcaggtttcaatggagaaaatggtgaaggagcaaatctagataatctcaaggctatctgtaataagtatcatatattgagcatgaattgtatgccaggctctttgtctatattatttttatcccacaaaaatcctttgaggaaaatgttgttatctccatttaactgatgaacaaattgaggctaagaaaggttgtatcttgcccagcgtcacatatatactaagctctttttgaacttcatgctctttcactcaaagtgcaaacctcttaaatgtcttctgaattttattttgatatatcctctgcatttatcaaggattaatgaagaaagaagttttatgaggaatgttcctgcatttttaggaaagccatgtggcttgtccattaaattgcaaaatgtgactcatttttctttagcatcttccatatgccagggtctgtgctaagtgccaggactacagctggaatgagaaatgattcctgcccccagagtgctttcttagcaggacaatgggaggtggattctctttgtggtgactagtgtgggctctgcagcaaaacttctggagttcagattgcagctccacttgtattgtttctgggaccttgaacacgttactttctaagcctcaatttcctcatctataaaattaaactaatgaaaatagacctaacatagaggactgttgtgagaatccaatgcaataattcatttaaagaacttagtagcatgcttggtactctatcagtagaatgatcaatgttacctttttttggacataaaccagtgatcacagtagaaaaattatctgataccagtatgctaaaactctgttgttttgcccatagattaaaaagtatcaaaactagactgggaagggaaggtggaaagaatttcagatcatacttccctgtggagctaatgttcaatatatagttgattaagaaattacatgttagttattcttagctttcagttccaggaacaattttctgtctttgggcaagctggcatgctatattttgctggtgaataagatttatataacctatttatttcacatcttataatgaccaggaagcttacagccaaatttaatgctttatttaataagattatacaagcctagggtttgattaaagtccttgatgatttttaactttcttttaaaattttaatagtctaattataagtcttttattttgaaatattctttggaagtagatacattataaataatctgcaaacagtcttcccctggaaactctgtataaatccaaattttctaaattacaggtaccattagcagacgaaaggagttcccatacaggatacccttagatttggtccccaaaacagaaatcaaaaggattttgagtgtaaaaggtaaattaacaaatgccatttttatttctcatttcacttggtgcttcaaacaaaaatcaaatatcctcatgattattctgtttctccacttccgtgttcagtagcacacacaaatctacctttaggagtgctccacccctacccacccccactttcaaacctttaatcacttttcccactatcttcttccaacggcctgatttacatggagatgcattctcctccaatggaaggtagggactgtcattggctcaaagatgtctctaaaatgggggtccagttgcttctagacttaaagaactttccatggtcttagtggccagtcccgctccagagaaggcctatggcctgcacatggcctagcgagaacagcactgctctgctgaagtactggtcccagaagggttgtcttagtccatttatgctgccataacaaaataacaaaatttataaataatacaaatttatttctcacagttctggaggctgggaagtccaagatcaaggcatcaagagattgggtgtttggcaagggctgctctctgtttccatgaggatatatgttgctgtatcctcctgtggcagaaagtggaaaggcaaaagggcaaaaaggggtgaagaacttcctcttacctcgtctataagattattaatcccactcattagggtggagccatcataacctaatcacctctcaaaaagccccaccttctaatactatcaccttggtgattaggcttcagtgtatgaattttggagagacatatacattcaaaccatagcagggattctcctcccctcgcatacatttgcagaagtgatatttgcacaagtgactaggttttccttagtctccaggctttacaattcaataacatattaccgaatgatagaatgtcctgactacattttatctcagataaaaccctagaatcacaaaatgttagtactggaaaggatctttttgatcatgtgcaaccctgctgttggatataaaagaaagtggcatgtccaaggttgcacagtgaattatagacagtcatgtcagcactccctgttcaggctctttgctttgcttcctggaagggattggtaaatatggtttataatgtctaaagctaacaggttgaatggcaactaatttgccatgttctcttgcagcaatcagtccactgtattacattacctaccaccatattttagtgatttttaaagtcttttttttttttgtttctttcaaattcatgttcctaaccggatctttttttctcaccccgtttctgagaagcaagtcaactgcctagataaaaagggaagaaccatctctagatggttgttcttctctcttgagaacatactgttagaagttaataaaaagcaatgtgtctactttgatcttttttgtttcaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaaggtaaaaaaaaaaagtatttcacataaaaattgggtgattctaaaccaatatttttattaaactaatatttaagttgtgaattatagaaaactttgtaagagaattttagcaaaaaaatcatgagatggactctactatataaataaatattatttctgtagcattttggctcaacttaccaaaatgcctgaatgagaggcaaggcacctgcattccaaactacagaacacttccttccttttcgaatgagatcagaatgttctacttgataattcccaattcgagcaattcatatacttcctttgagaagttcaatgctggccacagagcatatgcttgctgcccaacaccaaaggaagcttaccattctcagggcctgataaagtgttctttgagtagaaacggaggtctgttaagcaccgtgttctttttcttgtgcttcttagggatgttgagcattatgtcctacagaaatgctgactactcttacagtgtgtggaagggtggaagtgctagcacttggtaagtagaagattttgagttgcattttcatatagtggttaattaactaaagaataataaccataatggaaactccattcctccagttgctcaggctaaaagcctcgtcatccttcactcctctctttctcttaccgttcacatctgatccagcagatatggattcaaaatatatccttaatttgactacttctcaccacctccaccacactatcctgttccaagacaccttcctctcccacctggattcttacactagtctcccttagtcttctgggttcagcccttgatcctcttcagtatatactcaacacagcaactgaagtgaccctgttaaaacatatgttagatcatgccactcaaaaccatttaggagcttcccatcttacccagagtaaaaaccaaactttttattgtgatttacaaagctctgtatgatctggctccacctcatgtctcctactttatctcctatactctctttccctccaattcagccccactagccttcctcaaacacaccaggcatgcttccacctcagggcctttgcactgttttctcagtctggaatactcctccttaggtgtcagcatgactggctctcatatttccctcaggtctttaccaaatgtcaccttggggaggcctctgctatatcataatgtctaaaattgcaatccactcccctcccaacacctcatatcgtttcttttctcctcagtgtgattactaacgttcttgcttattccactattgtgtatctcccccactggaatataagctccatgcgggaagttctaagtatccctagtgcctggtacctacctggcacatagtagatgctcagtaagtatttattcaatgaaacatatcttccaaaattctgatgatttgagggaaagatagtctgaattaattaagagtccatatggcagtctattttcaaaaaataccggctgggcatggtggctcacgcctgtaatcccagcactttgggaggacaaggcgggcggatcatgaggtcaagagatcgagaccatcctggccaacatggtgaaaccccgtctctatgaaaaatacaaaaattagctgggcgtagtggcatgtgcctgtagtcccagctactcaggaggctgaggcaggagaatcacttaaacccaggaggcaagggttacagtgagccgagatcgcgctactgcactccagcccgggtgacagagtgagactctgtctcaaaaaacaaaacaaaacaaaacaaaaaaaccatcatgctatgacaaaatatttaataaaaacggtgtgccagctgctttgtaggttctatatgaaacatatttaaggagtttacaacctagaatactttaattttagatttttttcttttttcttttttcttttttttttttttgagacggagtcttgctctgttcccaggctggagtgcagtggcacgatctcggctcactgcaacctccgcctcccgggttcaagcgattctcctggctcagcctcctgagagctgggattacaggcgcgcaccaccatgcctaatttttgtatttttagtagaggtggggtttcaccatgttggccaggatggtctcgatctccggacctcgtgatccacccacctcaacctcccaaagggctgggattacaggcatgagccactgcgcctggccagttttttttctttagctattgagatctcccagaattttatctttggccctcttattttctgtaatctcccctggtacagtctcattattgcccatgatttccataacatctaggccaatggccccctaatcaatgtctcaaggcctaacttctttcctaagaagttaggaaatgtcctagatccatatttctaggtttccggaagccaaagatccttcaagcacaatatgtgccaaattcattattttcttcctcaaatacacttctgtttctttactcagtgcacaacaataccctgccctttgtcccccatggatcaagtcagaatcatcagttggtttttgattccttcctttccttttggctttacctctgatcagctaccaagttccatagattataccttaggattaggtctgaccatgtgtgggtgacacacttcaaaagacacacagggccagatacagtggctcacacctataatcctagcactttgggaggctgaagcaggaggatggcttgagcagaggagttccagaccagactgggtaacatagggagaccctgtctttaataaaacaataaaaatataaaaaaataaataaaaggctcatagacccctgcagcacaccaaccagaggataacccaggatgcaggagtgggagtgagtgtcaatgaagactggaaactgacacagcaggacctgggaaatagatgcctggagagcagaaagccccacaggaaggtacaacagcctctcagtaaacactcagagcctttcaagagtttggggcaagactgaaacatacacccaactccatgagttccttgaaagaaataatagacatagaagaaaatgtccagcacctaaataccctcaaacttttcttgagaaatacaaagcagattttttaaagtacgaatatcattcatattagcaaaacccaaaattgatgatgatgaacattttttatattcgtcttttttttttttttaaagaacattgtggatattgaacttttctctttaactacaagcctccatcttatttctgtttctttcccccaagggcattcactatcatgagtttatgcatctttccagaacatttttaatattttatatagtatatatatacatgaaatcatatagctgtaacttaactccagtttggctgctcactgctcaaatgccaaactcaagagactaaggttggtgggaggaaaagcaggttaattcaggagccagcaacccaaggagatggcagactagagtcaggaaactatcccaaatgccctaggctggccagagggattttaaagaggaaggggcttggaaaactgtgtgcaagagttagctacgtacaggtcagcatgtcttgttctgattattatcttgagtaacgggccatctagtggtcagctagactgaaacaggtttgtagattaactgctcagtatttttcttctccaggggacatttcacatccttgatttttatctcatggctagttcctggaattcttaagtaagcactgtttaagaaagttaagcattgtaaaagaaagaatggttatttgcttccaaaatgaagtgatgggtttacagtccctttttgtatttctaaatgattataactagtatcatactatacctatcattctgtaacttacctttttcttttaatactttttagttactttagatctagtagtataggtaaatatagctcactccttttcattgccatgcagtattttattttacaaatatatcacatagtatatattctttatctattcctatcttgatggacaaccatttccaaattttaatattacaaacaatatgataatgaacatcttcatatgtctctttgtgcacatgtgtgagagtttctctagggtatatcccaggagatagaattgctggaacataaggaatgcatatttacagtttcatcagattttgccagatttctcttcaaggtgactaaaaaattcttttctactctaaatttttagtcccagaccctactgtaaaacatgaggaactaaactagaccatattaagcacttgtagaggtagcctagggtctggaacaaaagcaaatcaaatagcctacttctttttttcctccatgtcacacttaaaatttgaatttcagggcagtctccaagggacaggtcagtgggaagaggagaacgcaaaaagctagagcgaattgtatttgctttacctttagggaagtgctgtctagactctcactccttaaggataccagggatgagacacccaagagtaccaaagagaaagagagataggagtaagagcttataaaaaccaggtgcagtggctcacacctataatcccagcactttgggaggctgaggcgggtggatcacctgaggtcaggagtttgagaccagcctggccaacatggtgaaaccctgtctctactaaaaatacaaaaattagcttggcatggtggcacgtgcctgtagtcccacctactcaggaggctgaggcaggagaatcgcttgaacctgggaggtggaagctgtagtgagccaagattgcgccattgcactccagcctgggcaacagagagagagtccgtctgaaaaaaaaaaaaaaaaaaaaaaagtaagagcttatacctattgaatacttactataatccagaactattttaagtatgttcatatatttaatctttataattgatcccaaaggatgagtccgttgtttctatttattgccattgccttttttcaaagatgtaactaaagcatctttatatatacagatgtatagataagtggagaggcagcctggccgtataactgcactcatatgcctttctagcctgctaaaagaagagagacttccaaaagccaaaatcccaagagagacccaatgtaaaatgtgggccaatctttgaaaatgtgagtgtccttgaacctgagcaatccgtagaagtatttctcatccttgagagcagtgtgggaggattaaaaagagaggagctctcaactcttaccccctaaaagtcaatagagtagaaaataaatttctgatgtttctagagaaagaattaggaaaaggcacctagttgtggaggggcaagttccgattaatatcaaaaaaaaaatctttaaaataattaaatcaattagagcaaagactgagaacaacctaaatgtctacagaaagggaaatggcttaaatagctttggtgcatctgtaccaaaatactataatttaatgtataaaatcacttgtaaaagaacaaggaaactttatgtattaatatagatctctaaggcatattactaaatggaaaaaaagccaagtacaggataatgtaaacattctcccactattttggtgtggttgggatggaaaggtagatgggaaggctatatcttgtatctactatttggaagaaagcacaagaaacaatggtcatcttctgttgggaggtggagggggacagggactgctagaaggagacttttcataaaatatccctttgtgcttttggatttttttttttttaagttctctcactcaggctggatgcagtggcaggatctcagcttactgcagcctctacctcctgggctcaagcaattctcccacctcagccttccaagtagctgagactataggtgcctgccaccacatctggctaatgttttgcattttttgtagagacaatgtctcactatgacgcccaggcttcacttttggatttttgaatcatgtgagggttttacctctttaaaaaaatgcttaaaatacatttaaaaaatgaaaatgaaaaagaaacacaaattttttaagtgggggaagtgggagagcaagtcaagtggtctgagtctcagacatttgaggacctggggagtggagcctcctgggcgactgagagagtgaagagatgttatggggggatgaacccaatcctctctgatactcttcgatgggtattagtagagacttgaaattgctttttgactaagtaataatgatcattaaaatttcctgtggggtagtaagttctgtgtcaatggcagcactcaaggacaagtgagataaacactccagggacattgggaaaggggacttggggcctcagataggaatttagattccatggaatgcacaaattttacaatctagaattttgtgatttactctttcatgtctcatgttcataggtcaatgccttgactcaaaactatttattttatctctgttatctttaactttagagtgtaattcttatcatcaggaatcaatttttagcttgtgtgctagcggacaatgttgtaatcacagaagatgtgctgttcacatttgtttaccgaatgttttggaggtattccaaaaatcttcccttcctttgtaaaatgatgacttactttggaattgcatgttttaaaatgttattttcttttaaagaataaagttgtataaattaattgaaagtcaaaagggattcagcgttctaaatatttatttatttgattttgtcttaaaggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacaggtaaggaaaccaaatgcacaaattagcaatagttttatttagtttgagttttattctcatctgattatgggaggatgaagaagaagaagaaaaaaatgtaattctgcaagaaattcctttgtgaacaagcaaaatatacaaaggtctttcccataatatctgaagtgaagcgatcttcagacagttcactagagatcagagaagtgatatcttagacctctcgtttaacggggtggaggtagatgggcaagtgaaagcactcaagcgagatagacccagggcttattgagaaatgggaagcaggaagggaaagagtgggagataaggcttaaaacacagagtagaggccaggtgcggtggctcacgcctgtaattgcagcactttgggaggccaaggcgggcggatcatgaggtcaggagttcaaaaccagcctggtcaatatggtgaaaccccgtctctactaaaaatacaaaaattagccgtgcgtggtagtgcacgcctgtagtaccagctactcagaaggctgaggccggaggatggcttgaacccgggaggcggaggttgcagtgagccaagatcaagccattgcactccagcttgggtgacagagtgagactccatctcaaacaaacaaacaaaaaacagagtagaatcaggtcatttcgccttaaagacaccatttcactccccttttaaaacattgcttctttttagggtaccttgcctgttgaagcccgagagaacagcttatatcttacagcctttactgtgattggaattagaaaggctttcgatatatgccccctggtggtaagtaagagttttctttctctcacacccatcatctatttctgtactatatactggaggggccaccaatcagaagaccttttgtttcaaaagcttcttttccttctttccaataacttgaaaataacttaaactccagaattgaaagatttcagaacaatgatagatattagagaccacctagtccaacctactcatcggcagttgagaaagctgaggactaagtaaggtgaattcagtttcccagtgtcacaggctaataaattgtagagctgggtctaaaactgatagctgggactgggatggaagaatgatccagtgcccccagcttctctgtcttatctttgctaaatcctgctttatatgttactgttatcctatagtgaaagcattctgtatcatgcaagtactgaggatacacaacagcaaatgtgtatcctccaaatccttccaaacaacatttgcttggaaacgggagaaaagtgatgagccacctaagtaaatcaacatagaagatttccaaggttgagatggaaaatctcaagtggatttgcaaaactggaagcacaaaacaaaaccatttgttttcagtttgtttcagaagcttaacaagacaaaataatcaatgaagactagttcccaggcacctagtggccacatgggtgagagatgcatgtggagctgggagaggaggcaggcaggatgttagcagcatcgcagcaggctttctgctggcccacttgcccaacacaaccattttggtggcgtcaggactagtgatcgggactatttacccaggcattcttaggatctaaaagtactgtggcagttagggtttctttctgctacttattgttttatttatttatttttttaagtgtaactccttttgaacctgtgtgcctgttgcaactacgctgagagggaacaataaaagttgtgtctatgggccgggtgcagtggctcacgcctgtaatcccagcacttgggaggccgaggcgggcggatcacaaggtcaggagattgagaccatcctggcgaacacggtgaaaccccgtctctaccaaaaatacaaaaaaaaaaaattagccgggcgtggtggcggggcgcctgtagtcccagctactccggaggctgaggcaggagaatggcgtgaacctgggaggcggagcttgcagtgagccgagatcgcagcactgcactccagcctgggcgacagagcgagactccgtctcaaaaaaaaagaaaaaaaaagaaattgtgtctatgctcggtgccttttcttcctggaggctaggtctgatggtgtactcagaaactaaaggcacaaaacctctaaaaggaaagtgagaattcagaggcaaaaagcttaacctgatttggacaacctcattgtcccttccaagattatgctctgctccttctctcggagggatttgcttcactgagaagccatccatttccattaggtcagtcctcttttcacccccatattgcttgctccaggatagtgggatctgagggtagttcatatcaattgataggtggttgcttgacatagaaactgaagtatcttctcttgtttccagaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtataacttgttccatacatgtattcagtgagtgttcactaagacataaagtctgctagtctgggaagtgggtggtgacatgtgaacttgagtaagatgcaattcctgtcctcaaggaacaaaccgtcacaatacgatgtaatgtgtgccgttattcattcatttattcatgcattcattcagcaaatatttattcttttttttaagacaggttctcgctctgtcacccaggctggagtgcagtggcatgatcgtggctcactgcagcctcgatctcctgggctcaagtgatcttcccacctcagtagctgggactacaggtgcccaccactgaacccagttacttttttttatattttgcagatacgagtctcactgtgtttccccggatgatctcaaatgcctgggctcaagcactcctactgcctcagccttccaaagtgctaggatcacaggcatgagccaccacacctgtcctctatttattcctttattcaataaatatgcattgagtatcctatgtacaccctggacaccccctatatacctggcactattccagtctctgggaataaaggaataaacaaaacaggctccccaaaatccaggccatcatgaaacttaaattctaactggggagacacaaacatgataaataaataaagctttatgaatagatggtgatggctgatatgaagaaaaatagagcagggaaagaaaataaggtgagaggatgcattgtaattttagacaagctgactgggcttaagtttcactaagaggatggtgtttgagtcaagagctgaaaggaggtgaagaagcaattcctgtggctatctagaaggaagtacctggtggagaacagcacgtgcaaatgccctgaggcatgggcatgcctggtgctccaagaatggcaaggaggccagtgtgactgcagaggagtgagaagaggagtaggaagtgaggtcaggtaaggaaaaagtgagggagcaagggaaggtcatttaaggcattagagagactcttcagggcttctgtaaacagttgtgccgtggacaaagtacctaagcaatcaagtgaatcgaggctgaaatctagcctgtgctccactcccccggccacataccctagtttagggctgcttccacctagagcaaggagtgcccatgtcttatccacagcaatgtgctgtggggaccagaaggagccctagaactttaatttcagctttgagagtgaaaaggggagccactgggggattttgagcaaaggagtgcatgacctggcttatattttaccaggtttgctataaaagtatgtgtttggttttgaagaataaagatactgcttcctataggtcaagagacaaaaaatagaaagagagtagcagtgattattagcatggttgggcactttggagtcctcttctagctaaggctttataaatcttactgaggtttatgaccatctacaaaatatgatttgtgccatcattttaaaattactatattttaacatatgcctcaaaaccacttgtacgatacttcaaaaataacacaaaagaaatgtcttgggtattgtgagatatgggtcataaaatcataaaatttaagatctagaagggaacttaataatccaagagttgttccagttgggtttctttaaaatcctaaactcaactcttcattttaaatacagcaaatctgagactctgagaggaagggtcaatatcattttcaaggtcatgcaaataatgtagttatgaattataaacatacacatcaaaatttttactaaccttcaaatatgatttccaaatatgcattactttttttaaaacaaatagtttgttccaaaaaggatttgaggtttacagatttaaataacaaatataatttacagcctaatttatgaaaagtgctgcatgtacgaaattgtcttgagtgctttaaattggaaagaaataatgaaagactgaactaaggctttaggtttaatctcataatttccaggatgtaaattttcctatcaggaaaaaggttctccagtttattttttagtgtcagtaataataataataataataatcccttatatatgcatggtgctttctagtttacaaaatcttttactttagtatttcatttgagtttcactgcatggaagaaagtattatctatactataggtattaggaaattgagtcacacagaactaaaggaatttgcccaaagtgacatggtaagttagcaacaaaagaaagactagaagctgggtgcaataccagtttattgcactttcgactctactaaactgccccttcctagtacatgtgtactatgttgattttaaaatacagattgaggccgggtgcagtggcttatgcctgtaatcccagtactttggaaggccaaggtaggaggattgcttgagcccagtagtttgagaccaggctggataacataacctggcatggtggcacacccctatagtcccagccactcaggaagctgaggtgggagaatcactgagcccaagagattgaggctgcagtgagctacaatcacaccactgcactccagcctgggtgccagcaagatcctgtctcaaaacacacaaacaaaaaaaacaaaaaataggttgagtgttcctgatctgaactgcttgggaccagaagtatttcagatttcagatttttttcagattttggaatatttacatatacataatgatatatcttggggatgggactcaagtctaaacatgaaattcatttatgtttcatatatactttacacacagcttgaaagtaattttacacactattttcaataattttgtgcatgaaacaaagttttgactgcattttgattgtgacccatcacatgaggtcaggggtgaaattacccacctgtggcatcatgtcagagctcaaaaactttcagattttgggggcatttcatatttcagattttcagattagggatgctcaatgtgtaaagacaagtaataccatattaagggatctcgttttgcattggtcatcttcaggaagttcctctaacaagaaaaagtaagtagcttctagaaactggaaggccataatacacctggtagaattattatgtcaaattcacatttttaatcatattaatgaatggaatttgttgatgttcaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggtaacatttctttgtcttgtttcatctccctgtagacatttttattttctcccccaccacactcatctggcctccatgcctttgtccaccaaatgagcatgcaatagatatgaataatgcctagaattgaaggacccctacaggttatctgcgtcaacactcttattatacagaagaggaaattagcccagggagttttactcagggaattcatggcagagccagaatcagaactcatgtctcctgactttaagcccagtacttccttcatgattctaaatcaccatgaaaggctagtaaggttattggcaattatatcatatcctatgtaataaatagtggttgccatgtagacaaaggtactgatgctccttctccacaacgaaataaataaaaagtgggagaaatactgattgttacatgttaatctatctagctatttaatgtaaactcatttgagtatgtatttttattacaactaattattatgtagtcgtataatacatgtttatattcaaagtttagatcgaatgttaatatcttccctgttgcctggatgtttagataatgatggagtgtgtatatttatatatatgtaatttagatgtagagagggccttcagtattaatttactgaccatgtaatgtgttttattttgggtacaattatagggttagcagaaaagactgccctattgattagcatttgccgccacagatataggcagagggaatggccacattgtttaacatctctgatctagtcatgtttctcagttttatagatgagaaagatgaggtccagaaagataaagtttattcatttattccttcaacaaatatttatgtacctgctaaatgcaatggacattgccttagtccattgtgtgttgctgtaacagaaaaaacgacacactggataatttacaatggacagaaatttattacctcatggttctgggtcctaggaagtccaagatcaggggggctgcacctggtgaaggcattcttgttgcattattccatggtggaagggcaaagagaaggcagagtggagggttggtgggagtggagtataaactcatctttttataacaaattcacttctataataagcagcattaatccatttatgaaagtggtacgccccatgacccaaacacctcccattaggcctcacctcctaacactgccacattggggaccaagctttccaacacatgaactttgggggacacattcaaaccacagcaggcaccaagaaaaatatattacctacttgcctcacaaatcttatattgcagtggggtaggccaacaataaactataaataaaagcattacaaattgagatgaatgctagaaagggcaaaaagggaaccttaaaacagagaataacgggaaaggggagtttatggccttgttgtggagatacttaaggtcagactaaaggatgaggaagagataattgttcaaagactcagatgaattctgcaaacagtgacttgcctgaggttacatttgcagaatatatagaggacccagatctgaggccacacttccttcctgtccctgctaacagcatctttattgaggagggagagacctttcttccacctccacaatggggctcttaaccagtcttactgagtcagctggagtttcatctccagacaatgctgccctaccctctcataaaaagggcatttgtaaatagggagtacataaataaactaaacatatttttgtgccttgctgattgctgacaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtaaatgaagaactttctgtagtattttacaattggctgagaccattgaaatcatctgttccactctttattttataaatctatctcttcactacttaaacatatattgagtgtcagctatgtcctaaacagggatgcctgctatatcctgggcactgaggattcaaaaataaaacacaaacaatcagcgtagtgcagggagattgtcatttaagcagatagtgaaaaataagagtcttgataggtacatggaagtacagaggggccctcctgatcctggctgaaagatggagggagtttgtcagatgtgtccagatgtgtgggttaaatctgaaaaaatcagaatgagttagccaagtgaagaaaaaggaagaacattccagacatagataacagcgcacagagcagtacagtgagcgtaggagggaaggcatgtctgggaggctgctggtggtcccttctggccctggtcatacatgcagactgtggccaggttggagttggcctttagggtccccagctccttgccccatgtcctttgctactgctggatttttaaaggtggtaactttgatggcttatgaaaatttcacaaagaacaagacatgttggaaaaactgggttctatattaatattagctgcccacatatagctgctgatacatatttttctaattactgtgtttgcattattttaaagtatatttaaatgtacagtaattggaaataatcctcattgttgacatccttcacaaattggtgtttgttaaaagtaaacaagcatgagaaataattttttttttttgagatggagtttcgctcttgttgcccaggctggagtgcaatggcgcaacctcggctcactgcaacctcctgggttcaagcaattctcctgcctcagcctccaaagcaggcgggattataggcgcctgccaccacacctggctcattttttgtatttttggtagatatggggtttcaccatttggccaggctggtctcaaactcctgacctctggtgatccacccaccttggcctcccaaagtgctgggattacaggtgtgagccaccatgcccagcagagaaataaaatttaatgcaaaaattgcaaactggtggcccatactgaaaaaaaagaatatggatataaacatagacatagatatatgccaacatttaaggatccagatatttcaaataaaaacctgattcccaacttcccttgataaaccaaaagacctgaaagcaaagcaccaggcattggcatggcttctacaatttactgcagtccccaccagtcacaggacgtatgcatgtgcatttatgttcatacctgctttgtgcccgggcctctgcaggcatttgtgcttgtggtccctagtttgggaatatgtctcctttccctgggatcatttagagttcaccggagattcatgttctgagtctaagctctaagaaggatctcttgaccttccagctacctgaggtagctgaaattattcttctctatagggataatgctgtaagaggcctcttgtcatcctaacaaaatttaaaccccagcccaggatgctgcttccatgtaaaacctgggctgttattatccagtgtggaattttctactccagcatttcctgaaatgtgttccatgaaagagtgttaggtggttgagtgtgcattaattaagttaaacaaattaatttaaattaagttaaacaagttctttaatccagaattcccctgttctgtaacatgtatgtgattaagtgtggtgactctgggtgtgaaaaggggcagaggcagggcacagtgcacagcatttcccaaacttatttgtcatgcatgcttttcacatgcagtatctcaagacacctgttttccaacaaatgctgctatattctatcagggagaacaagaatgttgacctactttcctacatttactaaaatttgaaggaaggattgagaaactttaacatatgcccaatccatcttgcattattgtgctaagcaaaggaaaggggaggcttggagtaaaggaagtgccaacccctcgggctcaaaattatctctcctgtactttccacaaattagggagcatttggatgacagagtttctctggagaggagaatgacttaactccgtttatgtcttcagtttcctcctagcagagtgggaagaagagcagcagcaactaaggatttggcaggcttgagtggggtgctagtggtttggggtggggtaccaggggtttctgcaaacaaaggcggtgacaagtggaaaagataaatcatcaagagatggaaaaggggtgcaaaggaggagctcagagaggaccaaagatagatgcacccgctttcaagttatgtggaggttccctgctctgggttctaatgaaaacgatctccattggcacacaggatgctgattcctgagctaggcacagaaaggaatttattcagttggcaaaaggagatgaagatccagatttaccatagccatatgtaaatgaaaatgtaaccagaagtgacctctgacatgttgcttttgttggttcactcaggagatctcagacatcttatttacatgtagaagggaaaggggaaataccagccttgtttagcacctgccatgggcataggattttcagtgtctcatccagttactctcagaagagctctgagagaggaggctggtacatgtcaacccacttttcatagctctatcctccctccctatcaaatgatgaaagaaagcatggtttgtttctctattatctttccaggtgcttctcaatgatgacctcattgtcagtacaggatttggcagtggcttggctacagtacatgtaagtatttaattgatatccaataacgagttatgtgtccatttgtactaggtaacataaaagttaggagctttgccacaaagtcacagaaatctgggcttgggtaaccatgactaaagtgggattcacttatgtaaatctttctagcaatctttgtaactatcctcacaatttttttgaaaataacaatgttggtcaggcatggtggctcacgcctttaatcccagcactttgggaggcctaggcgggcagaccacgaggtcaggagatcaagaccaccctggctaacacggtgaaaccccgtctgtactaaaaatacaaaaaattagccgggcatggtggcgtgcgcctgtattcccagctactcagaggctgaggcaggagaatcacttgaacctgggaggcagaggttgcagtgagccgagatggcacaactgcactgcagcctggcaacagagcaagactccgtctcacacacacaaaaaaatttaatccttatatgtatacattctgtatacttatagaaattatatatatttatagagatatataattttatgattatatatgtgtatacgcatatggcatatgtgtatatacatatatctgtgtacatatgtgcattgtatatatatatgttttctatcccatctcatttatccaggattttgggggatttatgtgttattcataaagacttatttcttcattttagccacttggcagttgcaattttttttctttttttttttttttttgagatggagtcttgctctgtcacccaggctagagtgcagtggtgcaatcttggctcactgcaacctccgcctcccaggttcaagcaattctcctgcctcagcctcccaagtaggtgggattacaggcacatgccactacgcctggctaatttttgtatttttagtagagacggagtttcaccatgttgaccaggctggtctcaaactcctgacctcaagtgatccgtccaccttgacctcccaatgtgctgggattatgggcgcgagccaccacgcccagctggcaggtgcaaatttttctaggctgtttaagtattttcatgcattcttaaattgcatgttctgagcataaattaacatcctattaataattttaatcacgctcttatctttagtgcattcattccttcaaggactgttgtaagtttatatgggggaggagagattgtccacttttctgccacttctggttggtgtcaatatatctacttctggcagcacctctgcccattcatacacacctataatttgttgtttgccatgatggcgtgtggctggaagaaacccacacttcttagccttgtgctgttgtgtgtaaaattaaagtggaaaggttcaaaacaagaaccttgggaactctcctgtagagtgaggtgcccagatttgactgcatggaatttagaccaagcttctgaccggccagaagtcattttttgcttactttgggcctctcaggtttagattatggagtttgcttaaagtccagctgctggaaaaatgagtcactaatgtacaccatttgtgctggattatgaaaatgatccttcgagcatcccatctgcagcagcagtgttgccataatacctttgtcactttcccactttaaatagaatcttcttgcttacttgtccccaatgtaggtaacaactgtagttcacaaaaccagtacctctgaggaagtttgcagcttttatttgaaaatcgatactcaggatattgaaggtaaaaacagcaggatttacgctgtaattttggctaaaaataaagcatgtgtataaatagagagcttctctgattagtaaaaatgtgcttactcaaaaagtgaaatttcttaaccaaatactttagcaggttgacatccaagtaaatattacttccattttttacaatagataactctttaatatagtcggaagctaatattaaataacaatgactaagctaaatgtatttgctattgatcaataaattgttttgactatgttatttttaaagagtgtaactagttgtaaagccacattaaggtctaattccagaaccaggaatttctgttacttttgtgttagccttccaatctgggaccttgaattctcttatcaccctgttagttttccatcccttagcctttctgtattccaaggggcccagaaaataaacatttctctgcctccatctttaacttagtctctcctgtacccctttcttttttagtctctcctgtaccatcctttctttaaatgtacccctgacccttttatttaacccaaggccctcacatccctctgctggttggttctcccttcctggtccaaaagcaagtccacttgcacactccagtcctcctggtctccccattgcctccagggtcagaatgaatgttgctgcctctgccctgatattttccatctattgctcagaagcctgttcctacaggaaacttcccaactaccagcaaattaaggcatctgttcttcctccctccaacatcccccaaacatattaccaatacatatttatctttaataatttcttcattaaattataagttatttgagagcaatgaactgttaattatttaaagacttcctggtattgtcaatagccatgaatttccattagaaccactgaaagtatctaaacttccaaatcacaaatcatttttaagtgtgttcaaagatttgctcattaatgattctgttctgacaggttccaaagcagctgaaaacagtttactcttatatttgtctgtttgttttcttgtcttatgtgccagcatcccactacagaggctacggaaactctgattacaaacgcatagtagcatgtgccaggtgagcctatttccacaaaggggagcatagactccaagttctcatttttgttaacgtattgtttctttacatattttcaaattttggtatgtccagaagatacaaaattgttcaattgtttaaaaatgcagaacatatatattcttaaattgctacttaccataaaaaacagccttggttttgctcataatagttttctctgtctgttttgtcttctgattcaaacagtgtaatattaattttttctctttcagagggatagaaatgtgatttaaaaaattaggaaaaaaatataaaagattctctcaaaaacagcccctactctcttacttagaaaaatcacatttacctaacaaaatccattatcagctagattctcaactcaagctgcacattgaagtcagctggagagctcttagagctgtccaaatgtcccgggctccagaggtcattctaatggtagccagggttgagaaccactgatgttaaaccctctcccaactaaataccgaggcctcaattggccactgtattagtttcctgttattgctaggtaacaatttattgcaaatgtaatggtttaaaccaacacagttttactatcttgcaattctagaggtgagaagtcccaaaatcaaggagctgggtagggctgtattccttctggaagctctagaatttctttgcctattccagattctagaggctacctgtgttctttggcttgtggcccctctctgtcttcaataccagtgtcacagcatcttccaatctgactgtgacctctgcttccatcatcacacctccttctctgactctcctgcttcctttcctcataaagattcttgtctttacattaggcctgcacaaataaccccctatctcaaatccttaatttaatcacatctgtaaagttctctttgccacataaggtaacatattcacaggttcaggggattaggacatggacacccttgggggccattattctgcttaccacagccaccatcctaaaacatttatgaaagtgtaggttttttgccgggtacagtggctcatactgtaatcccaacactttgggaggccaaggagagagaattgcttgagcccaggagttcaagaacagcctgggcaccatagccagaccccatctctacagcaaattttaaaaattagccagacatggtggcacacacttgtagtcccagctactcaggaggctgaggcaggaggattgcttgagcccaggaggttgaggctgcagtgagctgtgaccacgccactgcactccaacctggacgaaaaattgagaccttgtctccaaataaaaaaaaaaagaaaaagaaaagaatatgtaggtatttgaaaatatgtatatacttttggctttggtgatcacacagtgtgatcagagagtggtagagccaggactgaaacacagacttcttccctgttctttccatcgtccctcagtcctttctattgtgttctattttcttaactcttgtattgtcaataacagtgatatctgtggatggcattttgctgattttacttataatcatgcacccagtgtggataacttggaaattcaatagtgttgtgcaaaagatgagagctgagaaggaccttagggatgatatcataatcctcttgttttggaaatgaagaaactaagacccaaagagataaagtcgcctgccaaatgctcacagagttagaggcagagctaggggctcaaatccccaacctctgatgttcaatccagtatctaaaccacatcttttttttttttttttttgagatggagtttcactctgtctcccaggctggagtgcagtggcgtgatctcggctcactacaacctccacctcccaggttcaggtgattctccttcctcagcctcccgagtagctgggattacaggcacatgccaccatgcctggctaatttttttatttttagtagagatggggtttcagcatgttggccaggctggtcttgaactcctaacctcagctggtctgcccaccttagcctcccaaagtgctgggattacaagcctgagccaccacgctcagcctaaaccacctctttcaatcagtgtaatctaagaccactaatcccaaggaacagcacatagtttctccctgcctccctcccagctgtttcccagtcttctctatgtcccaagcccaatcgcttcttaggattccttcactattcagccctatttccttcctcatcagcatttcttccttccagcatttcctacttccttctgtggccagtccctgctctctgttcccgctcaaacatctttcctcattccctaatgtctttccagtaaggtcgccctttcccaggcagcttctttccccctaaatgccattcctacccttgggcacctaccagctggggaggagcatgatcacaattacctttaaatttgtaacagttgtcaaagggaagtgtaagcaaacttctgggcagagctcgaatcagtgcctgggaccctacagggaggcatctagacttgcaataaagaagagctctctgatagggtgagacacctgtgggatagcctctaccagtaagaactccagtgaccttcaggaaatcagtttacttctccaatcctcttctataaagcaaagatattgcactaccttatctcaagttttctgccagttctaattatccacaattctgccgtacagaaaaaagctgttatcaaaaattcattcatttgacttcattgtcaggaggcctaattccagattatcaatatacaaaagaaagcaaggagaaatgcaatcttgaatagtctatcctttggtttttacaaattggggacaaaatgttccagaaaggcgggtggaatatgcttttggctctgttgacactgaagttaggttgggtaaattccaaaaggaactgtgtagtacttattcatgtaggaacttctttgccttcaaatattctctctcctgattaaaaaatgccagcatgaagtttctgtgttcagagggtctctttcgtgtatttacctttttacaacctctctgttgtattcctaagaaaagaaaaaaggatttcatttccctcacaacaaaatgcctttggggaagattgctggttttggcagcaggcaaagggcttcttgaaaggaggatttctgttccaccattgaaacagtctccatggcaaccagtcatcaaggctccagcaaccttttcatagacactctccactcgggaggcccttttccatcctgctgacaaagtgtttgcatctgtgagcaagagtgctctgcttctacccatccaattagggagatgttcggatgtcacattagagttccaagtgttttatattctgttctaaattgttaatttggtgaagaatagggttaaatttttatgagtcagagattttagaatacttttctttattgtggcaaatattacatctatgacttctaatggggactgcttttatttatttatttatttatttatttatttatttatttatttttgaggcagagtcttgctcagttgcccagactagagtgcagtggtgcgatctcagctcactgcaacctctgcctcccagcctcaagccattctcgtgcctcagcctcttaagtagctgggattacaggtgtgagctaccacagccagctaatttttgtatttttagtagagaagtggtttcaccatgttggccaggctggtctcgaactcctggcttcagctgatctgactcagcctctcaaagtgctgggatgacaggtgtgagccaccgcacccagctgggactgcattatatatgctctatgaggtgtcattgaggaaaagatatgccctgacccctcactaacttgcttagtatctcctcttccaccaacattcatacctgtaggtgagatcaattcattttaccccttatgaagctgtcttttaatttcttcctttaatcctgactgctctcccaagcttcactctcaaacatccagctgcctttcaagcatcttgaggtgaggctggaacctgaaatcaacttttacagaatcacactccgtctgtctctgccccagcctcagccccgccagcctgtctcttttatgtcttctaacatctcttaatggtagctctaagcctctgccacccaaaaccaaagcctgggaattataaagataaatttaaaacacaaacttatacttcttcacagttaattttacaaataagaaaatgagcttagaaaggggaaatgatttgtgggaatctcagaactggaataaaacccaagtttcctgattctccatttcagtattcttttctctcttacaaaacaaaaacaaaaacaaaaccctcccattgtgccctttttgcatttccgcttaaattcctactagcagaattcctactgaaaggacagtccttgaaacattttctatataaagtagctattatgggaaatatagaaaatagagaaaagcatgaaaaagaaaagagataattgcttataatctcaccatccaaagtagctactaatatttgtgggtttgtttgtttgtttgtttgcttttaaagagggattctcactctgtcgtccaggctgaagtgcagtgctgcgatctcggcgcactgcaacctccgcctcccaggttcaagcaattctcctgtagttaggattacaggtgtgtcccaccaagcccggctaattttttttgtatttttagtaaagacggagtttcaccgtgttagccaggctggtcttgaactcctgacctcaagtgatctgcctgccttggcctcccaaagtgctgggattataggcgtaagccaccgtgccttgccttagtgtattttcttccagcttttcctggacatgtttattgaatctcttttcaacatacaactgattttttccttggaatatgcttcattagaaaatgaactaacgtgagaatccaaagacctggattcttctgtagctctgcatgaattagccatgtgaccttgaaccagtgccttactctcatcctgagtttccccagctagttagcttggtgtggatgacttctgtgttccagtagagtggtctgttgagattattgatcaagtgaggaaagagaatagatgactcaaagatctcttgcaactctaaagtcagagattttaacccatacattgtagaaaagcaaataaatggagacccaaatttaaaaattaaggtctactaaggaagagtgtcctttcttaaagactcttattcacttatttattatattttctaacctcttttttattttagctacaagcccagcagggaagaatcatcatctggatcctctcatgcggtgatggacatctccttgcctactggaatcagtgcaaatgaagaagacttaaaagccgtatgtgttttcttttaaatcgtgttgtgaatgcttcattttcttttctgaattattttatagacaattttactttctttcatttgaatataccacttttatagaatcacccagaatatttttttttttttggaggtggattttcactcttgttgcccaggctggagtgtgatgcagtcttggctcattgcaaccgcacctctcgggttcaagtgattctcctgcctcagcctcccgagtagctgggattacaggcatgcaccaccacacctggctaatttttttgtatgtttagtagagacgaggtttctccatgtcagtcaggctggtctcgaactcctgacatcagggtgatccactggctttggcctcccaaactgctgggattacaggcgtgagccaccaggcctggccagaatattcttttcaaaacataattaacctaagttttgatttatcaaagtgaagcagaagcatacactagcatgctctgtaaaatatgagtttatatgctaatgtgttcagactttttcaagaagaggaactgctcttcaatttctttgaattacagatcacatccctgcattgtgctatctcatcaacaggtgaatgcatttaaacaaaaagataatgaaatgaaattcaagcttctctcttttcccccttagcttgtggaaggggtggatcaactattcactgattaccaaatcaaagatggacatgttattctgcaactgaattcggtaagctccacctgcaaccatttttcctttactattactattcaaaatatacaggctaaaagattataaatatcatctctccataatttccttaaatccttgaatttgttaaacagattccctccagtgatttcctttgtgtacgattccggatatttgaactctttgaagttgggtttctcagtcctgccactttcacagtgtacgaataccacagaccaggtaatcaactccatgctaacatttcttcagaagaatactttgtattctttccagaacatttagaaatccactagagtcctgtaaattttatgtattgcctctcttagggaccactcttcatgaaagtcccaatttgaacattcaaaactactgcatacaaaatattgtacataaactacttcttgacattgagcagaccgtttcacctcagtcctcagtttcttcatatttaaaataactggattatagtgcctccaacttcaatattctttgcctcaggtttatctatggtgttcacagataaatcatatctctccttttgagagaaatcaactcaatccccccagaacaacttctagcccatctatattcttgttacactttgcagatagctctattatagcagctgtcacattgcattcaattatttgtatgtctttttcatcaaccccagggtgttttcattcttgtgtccctagtatctaacgcagcgtcgggtatagaatgtgaactcaataaatatttatgaatgggtgatcccacatttgactattcagccatttttgagaatgttatgtggttggagagcttattggatcacaagacagatgactccaccttgggcagttctacttgttagaaaattcttgaagtgaaccaaaactctgacacccattcattctagttttatattctgaaatcacatagaacatacatagtccctcttccccttgagatagatatatagagatacatagatatatgcttttcttcccttgtccaccctaaacaattccaactctttcaaaagatcctcatgcaacataatttattttcctcttacttagagaagcatcaaatgttttatttctgagaaacgagtgtttcaagcacagaactaagtgaaaaaggggagatctttctgagggtagcggaacccttcccaggacagccaattcataattttacctccctgggccttagctataaaaagaagggtttaaaataagcaatctctgaggctccatgtaagacacttgccaattagtaaatgtgttgttcttcaatcaaaccacttctcttaaccacacttttgttgccacagataaacagtgtaccatgttttatagcacttccaatatcaaaattcagaaagtctgtgaaggagccgcgtgcaagtgtgtagaaggtaaactttatttaacatatttaggctgcatgcttatttaaagcagtcgttcataacctgaggttaatctgggggacactgtttggtaaactgttctttctcagaagtagaaatgctatctcagctaattgaaagctaatgattccttgagcattgtaaaactacattttcacagttcctgaacaacctgatagttcatgctgtacagaggcagggaaacaccatcgagagggttgttgaatattataggggcaacatgatgtgagattttactttcacctagtctttttatcatataagaccagaggctcagcactgaaccactagcttctgttccttttctcttatacttcccagttaatggaattcggtttattgtccagttccatttagtctttcctaaattgaagaaagccttcttggccaaggaaaagatccagaactcaccaataatcaacagctggctccatgagggtctcagttagttttggttttttcaaaatcctcaatatctacacattttctaggtacttattgtgccattttatagctataaatcagtcacattatcattttgggtccttcaaaggacttctgattatactcaaaatggaaaatttccccctttcatcaagggaaccacatacatttctaaagacctgaatgtggagtagccacccagtctaacaataagtcttatgccaggggtgtccaatcttttggcttcagtgggccacattggaagaagaattgtcttgggccatacataaaatacgctaacactaacaatagctaatgagctaaaacaaaaatcacaagaaaaatttcataatattttaagaaagtttacgaatttgtgttgtgccgcattcgaagctgccctgggctgtgtgctgcccacgggccatgggttagacaagcttgtgacatgctcaagattttgttttttgtttttgtttgttttgttttctttatgtaatatttcactttatgaaagaaaagaaaatgggcaggtcttagaaatctgacatttgtaaggttatattgggttgtctctgggctcatgagaaaccgtgtttactcctggaaagagtgtctacttctttccattaaccttatttttaccaattttcacaaaatccagctgattgtgggcaaatgcaggaagaattggatctgacaatctctgcagagacaagaaaacaaacagcatgtaaaccagagattgcatatggtgagttcaaaagttcaatatagctcctttaaacatgaaattttatgaatatgtgttcagttagaaagatcaaaaactttatatagtgattatatgaatacaacattccatgtgatcccctgaaggaaaatgccatcgatttttagcattaacatgcaaagtttttattcctcagcaaagaaatgtgattttcattataaataatagaagtgacatgtatacccagccaggatactttcccacaatagagctttttcaattacaggcactaaaacatagtcaaagggaacttttgagaagccacagaggtataagatttcagttctgtactcttccaattgatagaccagaggcagaggcaaaggtgatttagggggcttggtttttaaaaaaatatcttcagggtaaaaatataaataccaaataatttttaatatattcaagattgcaatccatgtttgagacactctccatttgaaaaagcaaatctcagtgcttctagttgtccagcgcttagagctaaattagtgttcaagtacagttgtagccttgtctcagttcctgataaaattagctcctttgttatctattcagtttttgatgtttattgctggcattttttgagagagagagagcatattgtacactatctcaaatcattttttcattttgaaattggaagggtggagccgggcgcagtggctcatgcctgtaataccagcactttgggaggccgaggtgggtggatcacctgaggtcaggagtttgagaccagcctggggcaaacatggcaaaaccctgtctctactaaaaatacaaaaattagccaagcatagtggtgcgtgcctgtaattccagctactcagcagggtgaggcgggagaatcacttgaacccaggaggaggaggttgcagtgagccaagatcgtgctactgcgctccagtctgggcaacaccagcaagactctgtctcaaaaaaaaaaagaaagaaagaaagaaagaaagaaagaaatttgaagggtgttatttataaattaaaaaaataaacacagccaatttggtactttgtgtttagcaacagcttccataaacagtttctcattgcaatggaaagggttctcattcttacggaaagggtctcgtaagaacttcatgagggctgggtgcggtggctcatgcctgtagtcccagcactttgggaggctgaggcaggtggatcactttgagctcaggggttctagaccagcctgggcaacatggcaaaaccttgtctctacaaaaaatacaaaaattagctgtgcgttgatggctcatgtctgtagtcctagctacttgggaagctgaggtaggaggatcgcttgagcctgggaggtggagattgcagtaagccattgcactccagcctgagtgacagagtgagaccctgtcaaaaaaaaaatgtaacagagtattatcactatttaccagtgaagaaactgaggctcagggagattaaataatttgctcaaggtcatgcagaaagcaagtaatagaattaagatgcatcctgatctccagtattttttccatcgaagtctactgaattctcttaatagtaattcaggcaacagaataagttttatatggttaataacttttctttctttgaatttatattgattttggaaaaaaaaaaaagctaaaaagctgcctgactcagcctaggcccactgcagtttgttaaatacatgaagacttgagaatactatattgttttaacaaacaaaagttccactaaattatttcttccctccattttagaactattttaaatctaaaatatcagaaatctattttaacacagagaataaatgcaatttgggtttattgtgttgtttcaagaaaagacttcgctggctttttctggactacaagccagaataacagaatagaaacaaaattaagtagttctctctctgtacccaggcccacatagtaagtacattgcccatgtccattataaagacttatgaatctgaaagtcagaacacttttcatgcattttaagccactaatttacatagcccctggttctgccatgatgagttcacctagctacctctcaatcagtcaatctatatctgggatagacttaaagacttgagggatatctagaatgaacaaatcttttaggtcactaatttcaaaacaaaaaatagatcaaaagcaaaaataaaataaatctctcctgaggccacatagaaagaatgggtcccttcaagctggtctttccagacctgaggtcaagcacattatgcatcaaacattgatatctgaatgaagggaaaacaggattgtaggcagctcttgttaggtagttgccaagcaagggtgagtgagaaaacagaatcatcctaaaaaccaaggattaaagccagtggaactatatgaggaagcaaagcaaggaaccaagaaagctcacatggtagacctgaatgagagataaggcctcctctgtggccatggagaagagaatgaaggggctcttcaaaagatgcccatgggcatgactccactcatcttaaaggatcagcctctgaacttaacatctaacaaaggtttatcttgtttgtttgttttatgtgcttctgttattttattaaatatgtctcttattctaatcagcctgttctataacattggccagggctaatgattctaatagattgagagattgaatcagactgaggggattggggaaggcttcttggaggaaataagaactataatagtttgccatgcttcatttctcgtgtttgacaaattctggcttctactggacatagcattaatagtattaagactgaattgtttcattgttgtttgtcttttgccagcttataaagttagcatcacatccatcactgtagaaaatgtttttgtcaagtacaaggcaacccttctggatatctacaaaactggtgagaattcattcgttcattcgttccttcattcagcaactatttagtactgactatgtgccaggcattatattaaacacagaagatacaactcaaataagacagagctcttgcctttttaaagcttatattctacttggggagaaacattttttaaagatgttcgtataaatatttctcattgaattcatttttctaaaacttcagcaaaatgtttttttcaattgcgtaattgtccaatttctttttctttacaacttttattttaggttcaggggatacgtgtgcaaatttgctacatgggtaaattgcatgttttgggggtttggtatatagatcattttgtcacccaggtaataagcatagtacccaataggtaatttttcaatcctcaccctctaccctcaagtaggctctgctgtctagtgttcccttctttgtgtccatgtgtactcactgtttagttcccacttataagtgaaaatatgtgatatttggttttctgttactgtgttaattcacttaggatagtggctttatttctgggtgctgtaacctgttccattggtctacgtgtctttttttgtatcagtaacatgttgctttggttactgtagccttgtaatatagtttgaaatcaggtagtaggaggcatctagctttgttctttttgcttagaattcctttggctattcaagttctttctttgttccatatgaatattaaaatgtttttttctaattttatgaaaaatgataggaatagcattaaatctgtaaattgctttggacagtatggccattttaacaatattaattcttcctatccatgagcgtggaatgtttttccatttgtttgtgtcatctctgatttctttgagcagtgttttgtaattctcattgtagagatcattcacctccctagttagctgtattcctaggcatttttgtgtgtgtgtggctattgtgaatgggattacatttttttttttgaaatgacgtttcactctgtcacccaggctggagcgcagtggcacgatcttggctcactgcaaactctgtttcccaggttcaagtgattctcctgcctcagcctcctgagtagctgggattacagacatgcaccaccacgcctgacttatttttgtatcttagcggagatggggtcttacatgttggccaggctggtcctgaactcctaggctcaagtgatccactcgcctcagcctcctgaaatgctgggattacgtgtgtgagccaccgtgcctggcctcatttcgattgatataaattttgcaataagtaggaccataaagctaaattgcaataatatgtttatactaaatttttttctcttttgaaattctatcaaatatttcaagtcctaaaatgcttgattttttttcttttgagacggggtctcactatgttgttcaggctggtctcaaactcctaggctcaagggatcctctctcctcagcctcccagcttgattattactaaccataccctagagtttaaaattctagtaatatttttcaattttgtatttgctttatcaacactttgataattttttttaaatttttgttattttgaaagtttcattgtatgaaacttatttgtgaagttattttatttttttcttcattgatggtcacaattttttaatttgcaggctagttgccattctaatgaaataagtgtttagaactttgatgttgccacagtccaacttttgagcaacattttcatccaatgttcatattacaagcagtaataagccattctctttttactgaaataacaaagtgcttttcattccagaaatacaaattatttgttttatttgatactgattcttgcatagtatcaaaagacattttagactgttctgaatttttcatagcatcggatggttcccaagctacaatttttttattagtatcatttcttctttgttctcctgtagatccaaagatgcattttatgatatttaaaaggaaatgttaagaaacattggcatacttcatctcctcattctgggcccatttttaacacataaattttgaatttttataaatataaaaataccacacactacttacagaagaattgtggcacagtgaccataagccatttagaatcaagggcaaactgtagtttgaggataaggataaattggtatttctccaaagcacagagtgcttagaataggtaaggatatagaagaataaaagtttagttattgttgaagcccagggtagttgcctgttctctcttctgaatatactttaaattttccatgatgagaagcttaaaaaataataaggccccacacagctacactgcttactatgacaggggctgaaatggcagatagtactggtaatgttgctcagatattgacgtaataggaatctacaccatcagggcagcctaagaaatcagcttgaactaatgggtgtacactgaaatttatatcactaatgaaagtttaccatttacacagtttctattatacactatttgccaattggttcagaagtttttcaggacttaacaattaagatgactctgccagaacttaatagttaaatatcagccctgtatatatagcgataaatcagacacagtccatgccttaagaagtttctagtctagctagaaggacagatgtgggacaaaaaattgtgacagaaattcaagtgtaaaagaggtaaagaggagacagaaagatatttaaaacaaagagcatccaggaatattttactggatactgtgagaattgaaggagactttcaagataaatgaaattcaagaggccaacatggggaggaatgcattccaggtaggggaactggctacttgtgagttctttgagaatcccaaaattactatctttgaagttttccaagtctttcacattttgtacttttccacaaagttaacagttgccaaataccaaataattttatattttactatataatgtggagattaatgttgttcaactgtagagaggttcttttaattctggttatataagagtaataataagtacttacatagttcctactatgttccaggcacttttcatgtattaactcatttaatctcacgatggttctacaaggtaggttttattatcatgcccagtcttaagatgagggtctaaggccttatacagataacataaatcattttcccagagtcacatagccaggaagcagcatgcttagagtttaacccaggcagtctggctccagagactgaagccttaaccacatggatatcacggctgtccactagccatgaacctctcaatagccacgaggaaccagaaaacttgagagtttataattgtgacattaaaacatgaatggtataaccttacttgacttgcatgtctctcaggggaagctgttgctgagaaagactctgagattaccttcattaaaaaggtaacctgtactaacgctgagctggtaaaaggaagacagtacttaattatgggtaaagaagccctccagataaaatacaatttcagtttcaggtaagtcaccaatatttttcagtcactgatcttccctccaaaactgagtataatttattcttaaatacactacgtgtttcttatggccctgctcttaaccaacaaaccattttgaactaaataatattaatgtcaagcaaagaatgatttaaaaccatcgtggcagctgaggacttagctgcctgattaaccatctgagtgtctggacctgatgatgaatctgaaagtactcaccggacctcccctaaccaccacaccagctcccttgatagttctcagactgtttgtaaagaggaaaatgtgtaaatatgtattgtattatctgcttttagaaactagtcattgaaatagatgtactttctgcctttaatatgggagccccaggcagctttacaattccttaagggtttgtgaaccctccccaggagaggccggtacagaagagtttggcggacagcctgacccctggggacctgaccacagctgggctcttataaaataaatcaggctgagcacggtggctcacacctgtaatcccagcactatgggaggccaagacgggcagatcacaaggtcaggagatcgagaccatcgtggctaacacggtgaaaccccgtctctactaaaaatacaaaaaaaatagccgggcgtggtggcaggcacctgtagtcccagctactcgggaggctgaggcaggagaatggcgtgaacccgagaggcagagcttgcagtgagctgagatcacgccactgcactccagcatgggcgactgagcaagactccgtctcaaaaaaaaataaagaaatcaaattcagcttttctgttttgtggccacctcacaaacactttgtttcttggtaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaaactgtgctaaaaagcctgttattttatgctagatcagcttcaaccacacaaagacaggcaaattgagagagatggagaaagtcagcagtagagaaccttaaccttgagcgggcttagcctcagagccctcagcgcactgagaaggtaggtgggtttgtccctgccccctccccgtccattgccctctccatacccctgaagggagaccctctactctctttccctcccttccggcacatgttcatttcccccaggaacctgctctcgccaacaattgctttactaaaagacaggccccagtgcagcaacctggtgaaaagaaactgagtggcggatcgggagacctttctccagccctaaccaggtctctctctgagcctcaatttgagctttataaaagaggatacataacagaagttaatttttaagtgacattttgcagcacttcagatcatattaaaaagctctcgcatatattctcatttaatgtctcaagcctctcacaagattcagaaattattatcattatcatccccatcttacagataagaaaattgagatttaggcctggcatggtggctcaagcctgtaatcccagcactttgggaggccaaggcgggcagatcacttgaggtcaggagttcgagaccagcctggccaacatagtgaaaccccatctctactaaaaatataaaaattagccaggctaatttagcaagcctgtaatcccaggtactcagtaggctgaggcaggaggatcacttgaacccaggaagtggacgttgcagtgagccgagatcatgccactgcattccagcctaggtgacagagtgagactccatctcaaaaaagaaaaaagaaaaagaaaagaaaattgaggttcagaaaagtaaagcagttttcccaacctagtaaggaaaagaattggaaatcaaaccccaagactctatctcagtttaaatacatctctgttccacatcactacatattgcttgttgggttgaattttctaacagtaaggcaggatatagtagaagtttcttagacacagattaaccagccccactgaactatcacaggaaacatgaagatgacctccggatgtaacggtaattaacagagactggaatgcatctccttttgaagagtctgctttttactagttaggtgaagctacacaaggccttgtagtgtgcctttgtaaataacactaagattttccacttccagggactaaggacttatttttctctaatgtcaaagctcacattgtaggcactcccttggcaaaaacaaccaatgtgtcatgttcaagatgcccacactccctgtcagcgaggggtgaggagaccttctccagagcaggcctctcggtgtctcctgtcacttccttgctgggaggagggaaccactggtgctgcttcgaaggcacaggagtctgactgccttttcctgagcactttggcaaatagggcaggccacagtggcctaattaacccacaatgcagctgtcaaatatcaaagaaggttttgtgaattagcctggcaccatttaaaatatctgccagctcctcttcagctaactcctatgcatttgaacatattttctcagtgaggcttttgtgaccctccaaaccaggctgggcccattacccaaccctgcacttctcctccaaggcacttgtgctcttgcaatgatttacttaatcagattgaattattagtttagcgtgaccacactgaaagctccacttaggtaaggtctgagtctgttctattcgccagtatctcctgtagttggcacaatgtcgggcacatcatagggactcaataagtgtttgtggattcccctacagtgtagagaatcagaagacccaagttctagtcttggctttggccctaattggcagtgatttgggacaagcctcttaatctctttgatagcctataaaataagggaattggacactctaatgtctcttttatctatagctaagaa

SEQ ID NO: 15649 - DNA, 26165 bp, Human
tcatctgtaaggtggggatgatgatggcaatacctgcttcacagagtgaaaattagatgagatgatgtctgtaaaattacgtaagacggtacccaaaagtagtactatttttcccttttcttattagagcaggttgggcacgttttgatgtccgtgggaatgagcaggtagagagggtggtattgaggctggaggggagagaagggacccacagatggggagagaagtcttgggtgcctgttttatcccaaaccaggggaaggagggaacaggtagggctggctgcaggaaagcttgcaggtatggggtacacagttaaaagggagtgtcttctgatagtcttgatgcaggcctggaggtcgtttgttatgggggtggaggtcctgatgtacattgtggcggtaagatgccgtgctgtctttgccaccagcctgtggcagccctggtgttacaccagggcaggtgggcagtttaatgtatctcaggccagatgacctgccctgcccacctgttgaggctccagtagatagacgtgaaagcacagtataagcataatgcaccactttaatccttttctctgaggagctggaaggcctgtagtcaccatctgagccaaatgtcattcaagtacttcacttgggttacacaccacactttgacccactatctcatttagtcatcacaacaaatgggtgaaataggtattattgtcccattttacagatgcagaatctgagtttcagggaagttaaggactttgtcccagggcccacagttagtaagcagtggacccaggatttcaactcagctctgtctgacctcaaaacccatgatctgaaaccactgtgaaagtttgcaaaacctctgtagcagccaagcaggatggaaagatgtgtagggattgtcttctccatttgatagatgagacaagagctgggtactctgatctccatcccaagcacacagagcttggggccccacagccctggtgtgaatcccactccactaccagaggctgtgtgcctttggaccaggcatcttgcttctctgaccctatatacagctgcagaagaattccttgcaggttgctgtaaggatttggagggaaactgttgcccagcacacagtacacattctgggagccatcgtttccccagtgcacttttcctgcaaatgtggatctacatcccacttggatgctgagaccagctgctgtgatcttgcatttgtttagcgctttgttctccttgaggcagtaaagtggtggcacctgaccggagcatgtagccacctatgacttcctgagtggggtggtgtggggagggccctgaggagtctgtggtcctaggccttggatttcatcagggctttcctgctccttctggttgcctcagtcccaggcaagatagggtcccagaatcttacagcccagaggccacctgttgcaacttcttttttacagatggagtcatcagaacccactgtgaggaagtgacttctccttgaggtcacccagacactccaaacagagcagagcaaaagcgcctagaacttgaaattttggacctgtctccaacaccctggggatttccaccaggaaggtgagcacccccactgagaattccaggctgctcagaggtgccagggaacacagaccagggaccagctgtggccccctcctccgatgtgcccagggaagtgggggaagccagcggcagcctgcgattctcaaccaggggaactctcactgtgctttctgagagtctgtgacacgggtcattttctctgacttgctctcttgctttttctcactctaaaaaaaaaaaaaaatgactggacactcctaaagccttcagtcaccatccaggggatttttatcgccacaaagggtaattcctgctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagatggcctccagctcaggcagcagtcctcgcccggcccctgatgagaatgagtttccctttgggtgccctcccaccgtctgccaggacccaaaggagcccagggctctctgctgtgcaggctgtctctctgagaacccgaggtgaggtgatggaggagcggagggtgggcagaaagtgggtgccagggagggacccctgatgggaggtgaggggcagaggagcctgtgacttcaggcggtgacttttcttctctgggcctcagtttccacacccttttctcacactccctgacactgcccctctggctgtggtggaaggagaggaagccacagaaaggcatcagctcccacaggggaaagccatccacaccgaggagagcctcgaggctgtgaggccactgtctcactgtgtggtctggtgctctgctaatgtccctaagccgcagctcgcttgtctgtaaagctgttttctgtgtcatagaattgttaatgaagcccaatgaataataatcacaaaagttcttataataacaaatataaacctcttggtgaatgacaaactgttagacgaatatctctccttccacagcattgctcatcacctcagaccgtttgctgggaacccttttggaggggacaaagagatcgatatatatttgtgtatttaatgatacttaaaatattaacaacccagaaaggcatgatatcagtactattgtggacatccctctttaagcaattatgcacctactgtgtgccaaatgctctgcccttgggtcctcagcacaacttagaggggtggatactattatgatcctattttacaaatgagaacactgaggcctaacagattaggtcagctttggtcagtttcctggcaaatatgcccttaaactatctcatgtgatgaccttttgtttgcggttttacagcttaagaaggtggcaaagctgaatcaggcaagtgagaagttcaaacatgacgacaaaggaggaggctgtgagaatagcgaggagaggctgtggccgtggaaaggccagccaggaggtggaggagcagaggttcactggttttaccatcaagcggattgtcagggttcagctcaggctctggtagtgggtctcctggtttcccctctccctccttccaaaacctggcagaggagggagctgattggaagttggagggctgaggcctgaggcctaagtcctgaagagcttctactcagctctgctcctgactcactctaccttgaccaatccacatgccctctggggcctcattccctcacttgtaaaatagactatctcggtagcggtagcaggtcagagacaccaggagctttgtaaaaacacagttgctggccaggcgcagtggctcatgcctgtaatcccagcactttggcaggccgaggcaggaggatcacttgaggtcaggagtttgagaccagcctggccaacaaggtgaaacctcatctctactaaaaatacaaaaattagctgggtgtggtggtgtgcacctgtaatcccagctacttgggaggctaaggcatgagaatcacttgaacctgggaggcagaggttgcagtgagctgagatcgcaccactgcactccagcctgggctacagagtaagaccctgtctcaaaaaaagaaaaacccccaaaaaacagacaaaaaacccacgggtacccaggtgttacccattagaatctgacacccattcctgattaagaacctctaggacagatgttctctgaggccctttcttgttctaataggccatgatcctctgtaattactaaacatataagaccaaaaccaaatggaggaccaaatgagaagagcaaatatagtcacatgtcagcaatcttttgcctaaacccctgagatcagatgtgttttgtaattcagaattttttttagaaaagcaaatcagggcatcatgtaattgtggcagggaatgcggcagtgccctgtaatcaagcacattaatgtttctgcaatgaaacatgtatatattcacactaagtggggcaagtaagggctataatagcttccggtcagtgcagtcacggcaggtttggcagcccaggaagctcactgcaaactaccaaaaaatgtgggatactcggcagttttgcgatttaggaactgtggctctgggattgtggacgtacatgatcaccaccctgctgatagttgaggcttctggagctgtcaggagagtggatggtgcagggagctgtagtgcctctctccaaggctttgtccatgtttccccaggaatggcgaggatcagatctgccccaaatgcagaggggaagacctccagtctataagcccaggaagccgtcttcgaactcaggagaaggtacgttggcacatcacagaaaggcatttgtccgttgtcttgatttttccaggttgaagccaagtagacagctgcccactccacccctggcaggcacctcccaactagtcctgagtccagactgaatttgctttataaggaataaggagactgatgttcacagtggtgaagtgtcttgcctaaagctacctggcaatagacttagagtgagaacagtccagaccaggggtccacaaactacggttcatgggccacattctggcccaccacctaagcaacgagctaagagtggtttttatattttcaaatggttgaaaaaatcagaagaatgataggccatgcataatgacctgtaattctcgaggctgtgaggccactctctcactgtgtggcctgctgcactgctaatgttctcaagccacagcttgcttgtctgtaaaactgttttctgcatcacagaattgttatgagccccaatcaataataatcaaaaaagttcttataataacaaatataaaccccttggtaaatgacaaacatgcctgtaattctgaagtgttagaattcaaattacatagaattacatgcctgtaattctaacactttgggaggccgaggtgggcggagagcttgagcccaggagtttgatactagcctgggcaacatgatgaaaccacatgtttacaaaaaatataaaaactagcctggcatggtggcacatgcctgtagtcccagttagtctggaggctgaggtaggagagtcgcctgagcctggggaggtcgaggctgcagtgaaccatgatcgtgccactacactccagcctgggtagcagaatgagaccctgtctcaaaaaaacaaaaaaagatattttgggacacatgaaaattatgtaaaattgagtacttgcaacaaagacttcatagcccaaaatatttactatccacccctttacataaaaaaggttagcaaactcctcatctagatggttctgtctgcctctgtttgcctttaggtggggagagaccattatcagctcacctcctgagctctgtcaaacggtgcttctaggaataagagacacatttggaagtgtgataggccagagagacattttcaggagctacaatttagaaccctggccctcccaagctggaaggaccctcataggttacatgtcctgctcagaggttcccacatgctatccagaactgatccattcccaccagctcatgacaaaatgataaaaataaggcaattctataaatcagtttatgtaaactaaattctttccatttataaaaccaaacttttactctgagattgcgtctgtcctatgcatgtctttatataaatgaaaggatgtaatcgtagatgatagtttttggcaaagcctttgctaagtaaaattaaaaagatgacaatctctttgttaatctctcaatttaaaaaaaaacacactcgtattggtccacgaatccaaacaggcaggagtcactgctcaaaatcaaatcctcttgtttacacacggggccctgagacctgcagaggagtctcgttgctcagccgccctctctacctccactgggaagtgcctggctcctttcagccaaagccctcttcttgcagcaaactgtggcccagggatcaggagcctgatgtccaggggtggttctgcataattctctgcttggctagcagcaattcccaggccctgtttctgtatctgtaaaatgaggatattaagtcagctctgcaaggcctttccaggatctgtgatgtccagaccgtgatagcagtgctggcagggcagctatccccctaccgctggaccagaggcaggcgagtgtccacacctccttctcctttctctgagctggtccctctcattcagagagttcaggggaatttcctgtcccacccagagctggttttgagcactctcccatctgcttctcagcaacctctccatcggcaggccctcagagagtaagagtaaggaccaaatgcatgttcttggaactttacactctgcaacgtggtaagagttaatatgatatgctgctccgtggagtaactccctgagcctcactgtttggctcttggtggatcggctgtgagacacaagcagaccctcaactctgtgagccactatgcctcacttgcaaaaggcccttacctgcttgaatgctctaggactgttgtttttagcttgttttattctttcctcttaacaaaattaatacacatttattgtgtaaatcttagatcacatagatattttaatatctcctaatccaatggctttttttcatctttttcaatcagatgaaagtaaaagcattctgatggagggggatcctggagccccgacctgttaattgccccatttctttctcctatccgagcccctaagaggttctggggactcctagggccctgcagagcacagtttgaaacttgctgccttaagccaagtgaaggcactataattcatggtagaattataggcaccctaacaggctacaggatgggagaggaagctgcctgtatttgggagcaaagaagccttctttaatgcgggcagacctctgagaggcatcagccccctcccctccctgctggcttccccacctcgtggagtcatggacttctggtgaaaagctggggtggggaggggcggtaagtcatggtctgatcacctacacaaagccacataggggaaggaccagggactcctctgacttttgccccagtgggaactttgggggacttttgaccaaaggaaagtggctgatgataagtcaccactttgcatgtgtggtaattcctaagtttgcctgcacatctggggcaacctgggaaatggaggcagggtggagggctgaggaccagccctccttgcaaacacttcccatgccatctgcttatcagtttgtccccagcctgtgacttcattagatgattatctcccaaagaagtgcccagagccatggactgattacctaatgtaagaagcagatattagaggattaatgttgacctagttagagacttgatacttgcctggcgtgatcttcctgtagaagtgacagtgaaggaggggatgccagggggctggagataatcttcagtcctgtctgctgaggatcagcaaatgggattgtttctcccaccccctccccctgaggcccattcaagaaggtcaaaagcaagctgacaactgatgccagtagctcacagtaaagccttaatttgtctagactcagaaagtgacaagggtttaagctgtctagtccaatttctgttctgtactggattcatgctacgtggctccatgtccttccaatggcagagaggtcattactccatgaaacaaccacacctaccctggggagctctgagtgatgcaacattctcctctttctttgtactgagctgaagtctgtctgtctcccttgaggtcacaaaaggcaacttagcctcctatccctggagtcagtcctgcctccatggaaagacactgagcagtctttccccagtctctgtgcatttggggtaaatgcgcttctgtttatctgtgttccttgaagtgtgatacctgggaataaacccccaaaccttacacttctgagcttgacagtgttcatctgtaatcgccccgatcctgtgacatcctgtgtggtgggtggcggtgatagccctattttaccaataggtaatattttgaggctccatgaggaggtgtgcctggaccaaagtcacacagcaagtgggaggcaaagccaggctctaacccatggctcctgagctggtggcatcttctctatgctgcctctacacaaggaatcctcccctaaatgtttcatacctgcttaaataacacagtcaggctttagtgcaggagtccaccaagtgctatgggaaaaacaggaatgggcaagactatgttcaaccaggagaatcaggcagggcttcctggaggaggtggcggtcgagctgagcagaggctgacagagagtaaaccggcccagttacagaggagggcaggaacgggcggacagtggcagactgaccaagctccccatgtgactgtagagcaccccctcagcaccagctgagacctgagtcacagcagcccctccgggcatccctgacctcagcccagtgtgggggtaggcagtgcctggcctgctcagatcctctttgttctgtgcaggggctgcagaggtggcactcatgctcccagcaccctcttaacagtcacattcccggaggccccaggtctcagaatggggccccccgctagggcccactgtgaccccaccacaaagggcctgggtagccagggtggccggaaacaccacacacgcagagactcctcagacccagacagaagaacgagtgttccctcagggctgggaatctgttttctctgtttctgtctcctcctcggaggaaattccactgcacactttatttttagcaatttgcaagcagtgaggccactcacacaggggccacttgtgacaccagacagggttggcccaggacagatcctctgttcttctcctgcaatgcagtctgattcctgattccctctcctgtcccctcggtccctggcctttgagtgaggccaccccaggcaaggacactatggtggggaggacggagcctgcacacggactccaggctcctgggctcccctcgcctgccccgttgcctcctgcaagtcactgatcgcccctgggcttcggcttctccacctacccgagggaagcagaacctcagagccccaacctccccctcatggctgtgaggatctgatgggacagtgtctacatgagtgccaggagagcagcaagcccatgcaggggctcacaactgtgagagagaatgcacaggtgtgcccagctcctctgctcacaagctcagcatgaccttaagccattccctctgtttctgcctgtgttaaggtgactctaatacagccccacctgcctcagatgattgtcacagggatcctatgggacaacattcaaacatattttggtcctgttcatttaggaatgttcctcaccaccttgaggaaatccagtgggaaaatggagttttagagagttcattgttaaagagtttgtgatgtgaggattaaatgagatacatgtatatgacagccactgagggattgggactgggagatgtcccggggcagtgcttaatccacaggaataagaatactaattagtagtaatactagtagtattactactattagtattattagtgttattagtagcagtagtattcaacaagtattcagtagtagtatggaataatttcaataaatatgagccattattactattaatttattattagtaataatggctcatatttattgaacactgtgttaggcagaataatgtcctccaaagatgtccacatgtgaatccccaggacctgtgagtatgtgacctcacatggctctatgcatttgccagggctgccataacaaagtgcacagactgggtggtgtaaacaacagaaatgtatttcctcgcagttctggaggccagaagttcaaggcacggtattggcgagttggtttcctccaaggcctctctctttgccttgacatggctgtcccctccctatgtcttcatgtggtccttcttcaaatttccccttcctaaaaggataccagtcacattgcattagggcccacccccaatgacctcattttaatttaattagctctttaaaggccctgtctccatattctgagatactggtggttaggacttcaacatctgatttgggtgggggttgctgagcccataacaatggcaaaacagactctgcagacacgattaaatgaaggattctgagatggggaggtgaccttggattatctaggaggcccaagtgtcctcagaagagggagatgagggtcagagagaaggggagatgctccactgctggctttgaagatggaggaagggaccacaagccaaggagtgcaggcagccctgagaagctggggaagggaggaagccatcctccccttgggcctccaggagcaacgcagtcctgctgacatttccatgttaggacccctggcctccagaactgtacgataataaagctgtgttgttttaagctgttaagtttgtggtattttgttacagcagcaatgggtaactaataccagtgcttacatgtattatctcatttaatcctcacaataaccctgtaagggggtattattattatccccattttgcagatgaggaaactgcagaacagaggagttagtaactatcccagagccacaaagctagtatgtgaagtgacagaaacaagctctgaaccccaaaaggctggctccagaggccacatcctgaactcccgtgcactctaaggaatgaataatgatgatggagaagcctctgaaagcctctcaagtcacccctgcccctttctccagcaactgttcaaggctcatcacagtccacatctgtacacgcatcacagaaggatgtccctacatctgaatagcatttcactccctaaaacagacatttgctgttcacacaacgccaggacagctccgctgctgaaagacacatcccctccacctgcggggtgatgtctggaatttcactcttagcttgatcattttcatgttcttatctcttttatgactctcccaccaagctttgacccttagaaccacagactattggaatcatggacctgtggggaggggtgggacctgaaaggctcccccaggtatattcaccaaggagccaggtctacacatagcatcttccctccactgttctcacatgtcaaaagctacatgtttggggaggtttcatcaccacagacttcccgaagccagcacggtctccctgccaaggccgccctctgcctgccttccatagaacatctgttttctattatttattgggaacaacttgtccctgaagccctgggcagttggtgggtgggggtgggggcagggtggcctttgctgggctgtgttctgtgtctcaacccaactgtactcattaagcccacagctctctggttatgttacttttaaagaataataactagtgtgactttttgtatttgctcagtccgaaagacctctgtcctctcctgctttcgtccaaatcccctttcacgtggttccatgagattattctctcaaaaaaaaataaataaataacaaagcgcttatagaatcaagattttatttatatgccataaaactcactcattttaagtgtacagtttgatgaatataaataatcatgtaaccgccactacagtcaaatggcaaatgtttctgcacgggataaagctgctttgtgtccctgcatagtcagtcccctccccacccacagctccaggaggcaaccactgatctacttcctgtcactctagttttgcctttgctagaagctcgtaagaatggaaacaggtagtatgtagtctttggtgtttgacttctttcacttagcataatgtttttgaggttcatccatgttattatttatgctggtatttaattccatttggttgttctgtagtatatatagaccaatttgtttacccactcaccagctgatgacacatttgggttgctttgaacaaagccgccatgaacattcacatacacacctttgtgcagacatatgttttactttctcttaggtaaattcctaggagtgaaatgtgtggattgtatggtaactttataagtatggtttataagtaaattattttataagtatgatttaactttataagatactttcatagattgtatctgttcattattcatttattttttttaagagagacaaggtctttctctgctacccaggctggagtacagtgatgtgatcatagctcagtgcagccttgaacccctgggctcaagcgatcctcccacctcagcctcccaagtagctgggactataggtgtacgccaccaagactgctaattaaaaaatttttttaagtagagatgaggtctcattatgttgcccaggctgtcttgaactcctggcctcaagtaatcctcttgcctcagcctcccaaagtgttgagcttacaggtgttgagccactgagcctggctatgcccattttttattaggtcatttgtctcttattaggttgtaagagttctctatatattctggatacaagcctttatgaagatacagtcatgtgccatgtagcagtcaacaccagaccacatatacaacgatggtcccagaagagtatagtactgtattcttactgtaccttttctatgtttagatatatttagatacacacgtacttacagtgttaacaattgcctacagtattcagtatggtcacgtgctgtacaggtttgtagcctaggggcaatacgctgtcacagagtttcggtgtgtagcagggtataccatccaggtttgtgtaaataatcctatgatgttcacacaatgatgacacatttctcagaatgtattcctgttgcatgactgtatatgttggaaaaacttttttcccatctctcctgggctgactcctgttaagaggtagtgatgtgcgtgggaggggccctgtggctgtgctgcctcccagctcggcctccttgggcaaatcccttcccctctgtgagcctcagttttttcatcagtaaaataggaataaaaacccaccctctcttccccaccatgctgtaaggagccctaggaagaattatggccatgaaagcatttggtaaatgcttcagacctaaataggctaacagtggggtcaaattgctattataatagcactgagaccctcctgtatcccttccctcaggcaggatgttatctggaagggaaagttgtgcggagtggacacacctcagtcaaggatagatggccaaggagggatgcagatgggaattgtgagcccaagattccccatgaacttcaggaggagggaggcatttactcatgcagtcagtgtgttctgagtgtctcagctgtgccaggcactgccctcagcactgggaacacagccatggccctcacagagcccccccgaccagtcggggcaaccagagagtgagtgatgattacggagctgtgtggactgtgccctgacaggagaaatagcagtgctgcccaggatcacagtaagggcccaggtcctgttttgaaggaaggtcatggaagggtggaagcttaaagggtggaaaggagatagccaaagggaacagcagtgtgcaaagtcatgtggcccaagccatctcctgccctggtggatcctggtgcattgaagagagccccagggtagccacagggatcgctataacattcagtgatgtgattattatttccaggctcaccccgaggtggctgaggctggaattgggtgcccctttgcaggtgtcggctgctccttcaaggtaagcatctgagtgtgagaaaggagatctatccactatggttccagacctccaggtctccccactgcagcccctccatgattttcccgtaacatcagtccactcatctggatgtcctttgtactaatgactttcccaagcatcagagcctactattaagtcatcacagtactcagggaagttcttcctaatgtcttacctaagcataggcagaacatcactaaaatgacccccacccccaatgcccctctccatggtcctgaatcatccttgcactccagggcagggcagaattagaagctgcaatgcatgtggctcatcgtgggcatgtctgatgccagggtcttcctctgaatccctcccactgtacagaaagccactcctttttgctgggtgaatgaataatccttggtgacctttgatagcagggcactccactgctcccctgtcctcactccacctctgttttcactgatcagccccactctcttgtcagggaagcccacagtctgtgcaagagcatgaggtcacctcccagacctcccacctaaacctgctgttggggttcatgaaacagtggaaggcccggctgggctgtggcctggagtctgggcccatggccctggagcagaacctgtcagacctgcagctgcaggcagccgtggaagtggcgggggacctggaggtcgattgctaccgggcaccctgctccgagagccaggaggagctggccctgcagcacttcatgaaggagaagcttctggctgagctggaggggaagctgcgtgtgtttgagaacattgttgctgtcctcaacaaggaggtggaggcctcccacctggccctggccacctctatccaccagagccagctggaccgtgagcgcatcctgagcttggagcagagggtgagtgtgggaggcaggtttgccttcaagcccggctgagccccatcctgtctccagagcggcagacaggcttcctcctaatcattcatcctgcttacagcagtcactccatcaaaacgtatctcccctttatcccacacccttccaggaagagcgctgagttagaagctgtagtcaaggtcataacctcccatccagtgcttcggttcctttgcttgaacttttgtgataagacaccacctccctgagcagctcattccagtgcaggacatattccactcttagcaagttcttccttgtactaagctaaaatcagcctgtctcttccctgcattgttcctggccctgcccctcagagcccacaagacaaatccaccttctagtccccatgacagcccttcagggatggagggtcagattctgtcctacctgagtgcttcccttttcaggctaaaagccccagcgccttcacgtcttcctcagagcatgctgcttcacattgccatcctacgctctggctcagtctccaaagaattctgtacgcttggagtatggtaccaggctgactccagataatccacttggccacagttcttggtccaacagggctgtcttctcccttattctagagcttatacttttcttttctttctttctttttttttttcctttgagacagagtattgctctgtcgcccaggctggagtgcagtggcgtgatcttggctcactgcaacctccactcccaggttcaagcgattctcctgcctcagcttcctgagtagctgggattacaggcgtgtgccaccacacccagctaaattttttgtatttttagtagagatggggtttcaccatgttggtcaggctggtctcgatctcctgacctcgtgatccacctgcctcggcctcccaaagtgctgggattacaggcataagccaccgcgcctggcctatacttttcttaatgtagccaatgaccattctaatgttgcttcttttgcagtaacattacatcattgtctcatattgagttaggcctggattttagttcctgcttcaccattaccattatctgcctcaccattcgcaattaccattacagcaggtgatcagagccacctgccgtgtgggtctgagcaagtcactttccctctcaggaccttccccatcagtaaaattaacgattaaattttctttaaggatgctcacttccattcatggcttccctacctgagcacacccaagaataaatttatattctttccattttattggggaaagctattagaagggccaggcgctgagttggagtggctgaggctttagcctttatttatgtaactcttgctccagttaaaaggcagcctccctgaaagccacaattataccttcatttcacccacaaacttcccagctctacttttacataccaggtactatgcaaggcatggacacaaagacacaatgagcatgggcccagctttcggtggaggagaccatctggtagggaagccagaaaaatatgtctcatgaaatcattgtaagggctctgtaagaacatattgaaagagagcagctaagctaggacagtggttgaaggcttcccagatgaggggccatatgagctggattcctggtggataaggaaaaggaaggccaggcagggggcagcacattcagatgcagacgcacacctgagtgaggcgtggtcagcaaaacacatctggggcagatcaatctccacatcccgccattcccatcccatccccaagccgggttctggtgttcctggctgaacagtcttccctacaggtggtggagcttcagcagaccctggcccagaaagaccaggccctgggcaagctggagcagagcttgcgcctcatggaggaggcctccttcgatggcactttcctgtggaagatcaccaatgtcaccaggcggtgccatgagtcggcctgtggcaggaccgtcagcctcttctccccaggtaacacctcccaggggcacagagacctgcctggggaaacaggccccacaggacccaggaagcaagcagtgaaaactgccagctctgtgacagacacgctgtgtccagtttaggccagtgcccattcaggccactcaccatgggcaggaaccatgctgggatcttcaggttggtgggtgaaccgtgctctgccctgtggctctcagccacacatagcggtggccccagctgactgacattcaggccctttctcctccctgaatgtcagtcccattctgcaaataggaatcaaaactgttacccacttcatgggtttgggatgtgaaggaaagtgtgctgtgggccacagtatgtgcagatgagatggatgtggatgatgattttcacaagtgaacaccgtggcctcagagagccgacagtctgaaataagattagagaactgagtaagacacatgcacttgtgtatgattgcaggtagcatatgtgaatgagtgtcttactcagttcttactcatttctggggcccctgggcttggcacaatgtcttgcataaagtaattacttggcaagtgtttctcttaactaaatgatatctgttaatataacagtgcatatatttgtgcaaaaaatgaggcagcagactgcgtgcagtggctcatgtctataatcctaacactttgggaggctgaggcaagaggatcatttgaggccaggagttcaagaccagcctgggcaacgtaacaagatcccatctccacaaaattttttttaaattagccaggcatggtggcctgcacctgtggtcctagctacttgagaggctgagatgggaggatagcttaaggagtttgagtctgcagtgagctatgatggtgccactgaactccagtccaggcaacaaagcaagaccctctcaaaaaacaatttttttttaacgaggcagcggagtgtgtcacaatcccagagcagggctgggactcctttcctgcaggagtagcgctcatcccactgtgttgggacagctctcttcatggggtggcctcgagccctacttgtagacctttttccctcaattcttttcaaagagggaaaaagcaagcagtacctcgtgcttcctgttctaccaaaacgtaatgggcaaagatgagtcagactgccagcctgtccctcctccaccctcttcctgcctgcccccaattcatgtccccagtcagcctctcccagaagggcgctctgccagaggacatgctctcatgggatggcccctttagctgcccagggggtttctgtgcatgttcaccaggtatgattcagccctcaaagggttttgccacctgagaatggctggcagaactgcgagtcaccccatgtacccccagcctccaggggaccccagccagttggcatagggcagaactgtgagtcaccccatgtaccctcagcctccaggggaccccagccagttggcatagggcagcagaaagaaactgctgctgggaggcaggaagcctggcccctcattcttgctgggtccccaacataccgtgagatggtgaccagccactttgtttttctcagcttggtttccagactgtaaaacataggttggttagatcagtggttctcagagtgtggtcctaggaccagtggcattggcaacccctgcaaacttgctggaagtgccaactctcagttctcaccccagggtcactgagtgagaaactctgagggtggggcccggcagtgtatgacttggatggccagctgacaaacactaagctagatgacccccaagagcccattcctgtctgacaccctactcgagaagaatgctgggttctaaccccatctttcatggttttgagccgctgaccttgggcatgcctgaccactggatcccagtcccacatctgcaaagtccagcacttcccaactgcctctggcttctgcgtttcagccttctacactgccaagtatggctacaagttgtgcctgcggctgtacctgaatggagatggcactggaaagagaacccatctgtcgctcttcatcgtgatcatgagaggggagtatgatgcgctgctgccgtggcccttccggaacaaggtatgggtgtgaaggtgatgggggtaaggtggggagcatggaagcctgagtcctagtcctggtttggcaatgaattggccatgtgacctggcaagtcccccaccctctctgtgttatcagtttccctttttataaaacaatcagatctagtaactagggctccctccagctccatgagtccaggagctaaaatgtctggaatcttcctgaaggttatatagaaataaaattcatggccaggtgcagtgccccacacctgtaatcccagcactttgggagactgaggtgggaggattgcttgagctcaggagtttgagacagcctgggcaacatggcaagacttcatctctgctaaaaataaaaaccatctggccaggcatggtggctcaagcctgtaatctcaacaatttgggaggccgaggcgggcggatcacttgagaccaggagtttgagaccagcctggccaacatggtgagaccccgtctctactaaaaataaaaaaattagctgggtgtggtggcatgcacctgtaatcccagctactggggaggctgaggcaggagaatcgctagaacctgggaggcggaggttgcagttagccaagatagcgccactgcactccagcctgggtgacagagcgagactccatctcagaaaaaaaaaagaatgtgggaactaaaattttcatttttaatgtaatccccaagattttctccaagaaataaattgttgttttgtattttgtaacttaaaagcagctattggtaaatttctgagatatagcaggagaccaaaacatgtttggaaagagaataaatatatgaagagagactggttgttttattttcaatgtattgaatatattagattacaatttattttctgagtggatgtgattaaatattcagacgtttagtgtatgattaacagtgagatagagatttctttggagttattaaatccatcctgtcttttacataatggacaaatcaagttaaaaaaatttttagatagcttagcttattttctggtgctgttgacctgcaagagaatatactttcgcatatacaggtgaaagttttgcaatttatgtatacaagaaattgtaggcattaaaaatattttattgataaaataataataataaaataataataataataaaaaccatcagctgggcgtggtggcacatgcctgtagtctcagctacttgggaggcttaggtgggaagattgcttgagcctgggaggttgaggctgcagtgtgccataaccttgccactgcactctagcttgggtgacagagtgagaccttgcctcaaagaaagaggagagagagagagaaagaaagaaatggaggaacggaaggaagaaaggaagggaaggaaagagggagggagggatggaatgaatggccagtggctgcccactcttcttcctccttcacatcgtggggtaaataaggaaaacttctgggaggaggtgccgtgaggctagcctgaactagcagaattttcaggaaaaaggaaggaggcaggtatcactacatattaatacatactagaatggccaaaatctggaacactgacagtaccaaatgctgacgaggatgtggagcaacaggaattctcattcatttctggtgggaatgcaaaatggtacggccactttgaaagacagtttggcaggatcttacaaaaccaaacacactcttaccaaacgatatagccagttgctctccttggactcaaaggagtttacttagaggagttgaaaacttatgttacacaaaaacctgcacaaggatgtctatagcagctttagtcataattgccaaaacttggaagcaaccaagatgtccttcagtaggtggatggataaataaactgtggtgcatccagacagtggaatattattcagtgctaaaaagaaatgagctatcaagccatgaaaatacagggaggaaacttaaacacatattactaagtaaaagaagtcaatttgaaaagactatgttctgaatgcttccaactatatgacattctggaaaagccaaagctatgaagataggccgggcacagaggctctcgcctgtaatatcagcactttgggaggccgaggcaggtggagcgcttgagcccaggagttcgaggccagccataacgaaaccctgtctctacaaaaaatacaaaaaattagctgggcattgtgatgtgtgcctgtaatcccatctactctggaggctgaggcacgagaatcgcttgaactcaggaggtggaggttgcagtgagctgagatcgcgccactgtactccagcctgggggacggagtgagacttggtctcaaaacaaaaacaaaaacaaaaacaaaagctatggagacagtaagatcagtgattgtccaagagtaggtgccgggagagatgaatagagcacaggggattttgggagcagtgaaactattctgtttgatactgttatggtggatacatgtccttatgcatttgtcaaaacccatagaaagtgaaataccaagagtaaatgccaatgtaaactgtggactctgggtgataattatgtgtcaatgcagcttcatcaattgttacaaaactaccactctggtggggatgttgatagtgggggaggttgtgcactaggtgggggcaggaggtatatgggaactctgtattttctaatcagttttgctgtgaacctaaaactgctctaaaaaatacaatctattaaaaattctttgccgggtatggtggcgcacgcctgtaattctggcactttggaaggccgaggtgggtggatcacctgaggtcagcagttcaagatcagcctgaccaacatggtgaaaccctgtctctactaaatacaaaaaattatctgggcatagtggtacatgcctgtaatcccagttacttgggaggctgagtcaggagaatcgcttgaacccaggaggcagaggttgcagttagccaagattgtgccattgcactccagcctggacaacaagagcgaaactctgtctcaaaaaaaaaaaaaaaaaaaaaaacacaccataattcttatagaggggtttgggggataggcatttcctgtgggtgaacagcagcattgcatgaggggagggtgtcaagaatagagacctcaggtctggggaaacaggtggggcagggcaggtgtgccgctttggtctggatgtgagtcagtaggttctcctacccccggcagttcccaaaggtgctggggagatttttaaaacaccagtgacagaatctcacccccgtaagtgataaggcctgagcatcaggatgaagtctccgcagggggtcctaatgtgcagggtgaggatgcttcagttggcaacgggaagccattcagcttcctgatggacatttcaggggcatgtgccagggaagagggtttgtgtcacttttagacaatcggcttctcaggggaacctccgtctgtgctgtgtataccagaagctccacaaatgtctcaggacatcgatgacagcccctcagtagaagacctctctgttctggcccttctgccttgccccaggaggttccagctgtagttgatgaagcaaaactttccaagccagagggggtgttacaggttattgcctccacccaccttgtcagtgcttcagtcacaccctctgcccccaacagccagtcacacttgactggggcatcagaaccttcccctgcttcctgctggctggagggaacatctgatcctcatcatggaacagcccctgaagtgcactcagaataccaggtgccgctggctccctgggtctggccatacgccaggtgcgctccttacttggtttctctgactcctaatccaaatgagccaagggtctgaggggctgcacaggcagtaggtgtggagcacagctctgagcccaagcctgggcctccaagctgcgctgctgctgtagggcctgatctcccacctatcccttccctgcaggtcaccttcatgctgctggaccagaacaaccgtgagcacgccattgacgccttccggcctgacctaagctcagcgtccttccagaggccccagagtgaaaccaacgtggccagtggatgcccactcttcttccccctcagcaaactgcagtcacccaagcacgcctacgtgaaggacgacacaatgttcctcaagtgcattgtggagaccagcacttagggtgggcggggctcctgagggagctccaactcagaagggagctagccagaggactgtgatgccctgcccttggcacccaagacctcagggcacaaagatgggtgaaggctggcatgatccaagcaagactgaggggtcgacttcgggctggccatctggttaggatggcaggacgtgggctgggcccacaaaggcaaagggtccagaaggagacaggcagagctgctcccctctgcacggaccatgcgacactgggaggccagtgagccactccggccccgaatgttgaggtggactctcaccaaatgagaagaaaatggaaccaggcttggaaccgtaggacccaagcagagaagctctcgggctaggaagatctctgcagggccgccagggagacctggacacaggcctgctctctttttctccagggtcagaaacaggaccgggtggaagggatggggtgccagtttgaatgcagtctgtccaggctcgtcattggaggtgaacaagcaaacccagagggctccactaggacttcaaattgggggttggatttgaagacttttaagtttccttccagcccagaaagtctctcattctaggcctcctggcccaggtgagtcctagagctacaggggttctggaaacattcaggagcttcctgtcctcccagctcctcactcaccttcagtaacccccactggactgacctggtccacagggcacctgccaccctgggcctggcagctcagcttccccaacacgcaggagcacacccagcccccacatcctgtgcctccatcagctaaacaccacgtcacttcatgcaggtgaaacccagtcactgtgagctcccaggtgcagccagaggcacctcaagaagaagaggggcataaactttcctcttcctgcctagaggccccacctttggtgctttccagaatcccgtaacacctgattaactgaggcatccacttctttcagcagactgatcaggacctccaagccactgagcaatgtataaccccaaagaaataatttttagaatctctttcgaagttttcctaaagtgtatggtttgggagttgtttgtactgagccaggtttgaaaaggccattgctgagtttgaggtggtgccaccagttttgcaggtggcatcagaggctggcatgctggcaggaacatcccctcttagccccagtcttctcttttctataatgagacccaccccagcttgcctccctccctggcttctctgaccctcaaaggagatgccacgcaggacagactggagagagaagcctgggcaatactgcccgcctgtcatggcctggtggtggcccacacctatcttctcaccttggaggccacacccaactttccaaagaccctgagacaagtcaggaccctactactctcccctgctgctttcctgacagcttactcttcctccacctgctgagcctgtgccagactccattgctcaaatcgttagggttgcttctataaaaatgggtcagtagcccttcctgttctctccagcccagcatacaggaggatcaaaggaggtgacggagcatcgtggcacggcagtctcaatgggtcagaaacccaggccagctgggctctaagcctggcatcctgtcatgcttagtccttcagctgaagatcagaggaagcctctcccttgccctctccagctctaggggttttcaggaggcccaactgcaataatggagcactagtgcttttatgtgcaatggtgtcgtccatgcacgacagcagcaaacattctggggctgctttttattgttcccacggctgacagcgtggcagcggagactgtggaggcagtggagactgacttcttcctgctgacagctggatgtcacacatgaaggtctggcctagcgagtgatgggtctaggccctgaaactgatgtcctagcaataacctcttgatccctactcaccgagtgttgagcccaaggggggatttgtagaacaagcccccatgagaaacagctgttactctacacttttgattgcctatttctgatggcaagagatacatactctcttcaaagagcatgagatgcagccattctttcagcaaagcttcattgacacctgcacctgttaactgtgttcgacattgaagggagaaaggcaagatgtgcactctggactcaagaaactcttagttcagtggaggaaatgagcagataagtagatcattatgattgagagtaggagaagcttagagaaagcacagaaccccagatccagctggtgaaggagggaaggcttcaggcctttaagctcagcctgagaatattgtgaaatgcagaggatggggaaaagggaagagtaccgacttgaaaacggagagctgtcttggctgagggcagggtctgtgtggcaggatgggggagggagtcagaagggtcagatgaactggagtgtagacagcatcagatgcagcagtgcccaccgcccccccccccaccccccgccctgcccacagagcacctgctggtaaccctgggcctattgaaagcaggatgagatgataatttaagacactgaatgatttcttttccaacaaagctctatgttaagtgcatcaaagatgtgacattgcatcttttacaggtgattcaagggtgggggaggcaagatgcaggcaaagccaccgtttcactgggtggattcagtaggtcccccacccccagcagttcccgaaggtgctggggagatttttaaaacaccagtgacagaatctcacccccgtaagtgataaagcctgagcatcaggatgaagtctccgcagggggttctaatgtacagggtgaggatgcttcagttggcaacgggaagccattcaggtttctgatgggcttttcgggggcacgtggcagggaagagggtttgtgtcacttttagacaatcagcttctcaggggaaactgtctgcactgtgtataccagaagctccacaaatgtctcaggacatcgatgacagcccctcagta

SEQ ID NO: 15650 - DNA, 29742 bp, Human
atcttaaacccacctgttttgcagacactaagattttttttaacttcttcattagctctagggaaatatgcatcattcacacatcctcccacagtttccagcaagcttaagagtggctgattttatatcacccatcacctcttttatcactaccaaagcatcggcaatattgtactgttgccatgcttctttcagagtaaggtgagggttttttcaatacagtcagcaaagtggtcaaacatatgcttgattatgttcaaatgcttcagttataccctgacccaagggctgaagaaagctagggccttcctgagggagaaacacagtatcaacattagaatgaacaaagaataatgaatctgggtgattgggacctctgtccacagttagcaacattctgatttccagattttttttgttaaatgacttcggatttgatggataaaaaaattgtaaaactaatccaaaaagtggcagtggtgattctgggtgtgattacaagaaaacaggaaggcgtttatctctaaaagacaagtggggtgttagagtctttgtaaagcagcagtggttttatcattttgtcacctgaggcactgccacaaaaaaatgagggaaatcctgtccttagcttcctctaagctttccagatttttgtcttttgccccaaaagtaggaaggcatgcactgcaaaagatgggtcatctccttggcgttgaagacctgttgaggcacaaagcctctctccagttgcttggaatactcgatacccactcaggatttaagggtccttcctccccatcaacttcgtatgttgcaaaacagcagcgatttttaaagttctcaaaccatcccttgctcgcatgatacttatttgggttgtcctccccagatgtttcccattggttccctgtagatgtatttggcctggttgcagagggccttccgggtcagatgccgccctctgtcatctggccttccacctaaaaggttaactgggtctccaccttcacgatgtttacattacaggggaatacacagcagcttagagcagatgggcgaccaactctccacgctggtctttcttggttttctgagggtagtggaggacaagaggggaaagcagggtcttgctctgtcgcccaggctggagtgcagtggcacaatcaccgctcactgaagcctcgacctcctagacttaggggaccctcccgcttcagcctcccgagtagctgggactacaggtgcgtgccaccacaccgcactaatttttttcctttttttttttttttctttttggtagagacgggtttctcactatgttgcccaggctggtctcgaactcccgggctcaagcgatcctcccgccgcggcctcccaaagcgctgggattacaggtacggccactgcgaccagctgcttctccttggtggactgatcaacaccaacaaggcggcgcacgtccctattactcacgccttcgtcaggctcctggagaatattcatccagtcttccagaggcatgacgctccgcctcctcttgacaggtggctggcccaggatcaagattcccctccaggccaccgctccacctggggaggcctcagccgcggccgtagccgcggtggcctccataacggctgcagtcgtccccgcctagagcctggttttggagcctcgaggacgccgacgaggctgtttaacttcccgtgagtccccaccctcgccgctccgctggccgggaatttggcaaggctttgccctacgcggtaaacacgtaagcctactggcctccgcatttccctgagcagcgacctagatgacgccagactgagggagccgcaaccactggctacagttgacacggccctaacggaggcttctcgcgaggcttggcagccccatagccatctcagggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggagctacgcgcgcttcactccgtgctgcaggcagtgccgctcaacgagcttcgccagcaagcggcggagctgcgcctcggcccgctcttctccctgcttaacgagaaccataggtgagaggaccccgggggcttgagccgaggagaggggcacccctaaatatggacatgagagtggttgagggcaagaacagcgcttttcccagtcacaggggaggtggaaagtagccgaaatttgcagagaaggaaggatcctgggttcagaggcaggagatggggttcaggttcagcctctgagagtgccccagggtgttttctcccgtcgcctggcctcgctgcctctgagcagtgaggcactgccttcttcatcaaatagaaattaaaggaggaaagcaaagctgtccacttacaaggagcattccacatctctttgtacaggttcttgatttgtttccccttctaaaaggatcctatcctggcaatgtggcaagaaccatcagcattttaaattcacatgctttttcatccagtcattcttgttaaaaaaatttaatgcaagtatacgcgcacaaaatgtgcagttactttgttctttcgaacccgaggctggaatcgccccaaaagcagcggcaagagagttcccacgagggagtgcttcaaaccttcccgagatgtggctggttgggatgacagaaaaagaagcactgaatgccaaggcgatcagtccaaaagcgtttagggggaaacctgcagagggctgcagaaattgtcaagacggacaccgggagaaaggtgttcctgggtatgtccgcagtgagggggtcagggtatggagttcagatgagagtttaaaggaatttggctcagggttgaggccagtttcttccagtgttttgggcaacaacctaggtacctttatcaggcctgtgaatgttcaaggcccctggtttatggtcaagcctgctagggaaacctgccgctggctaggtcagagagcaatcaaggcactctgattttccatcaggacagagaaagaaagggggcgactggaggaccctacaacattatatgcaagaatataacatatcgtgtgtggcaccagaacactagaaacaatctaaatatccgttaacagaggattccaaattatgcgctattactctgtaacactgtgcagttatttaagttattgaggtagatgtatatatatgtatgtggacatggaaagatctctgtgttttgttttgttttgttttgtttgtttgtttgttttcagacgagtctcgctctgtctcccaggttggagtgcagtggcgcgatctcggctcactgcaacctccgcctccctgattcacgccattctcctgcctcagcctgccgagtacctgggactacaggcgcccgccaccacgcccggctaattttttgtatttttagtagagacggggtttcaccatgttagccaggatggtctcgatctacggacctcgtgatccgcccgcctcggcctcccaaagtgctgggattacaggcgtgagccactgcgcccggccaatctctgtgttgttgaatgaaaaagaaaatcgcagggtatatcaatctataattttaacctgtaatttttaaaaaggattacaatcttcccaacccccacaggcatgtaaaacttgtataacattgcaaatatctgcaaaggtacaccagaaactattaatagggaagtgggtctgaaaatagtaggacaacttttatttttgattttttacacatccgtagtgtttgattaaaaacactttgtaggcccggtgcagtggctcacgcctgtattcccaacactttgggaggctgaggcgggcagatcaccaggtcaagagatcgagaccatcctggccaacatggtgaaactccgtctctactaaaaatacaaaagttaggccaggcacggtggctcacgcctgtaatcccagcactttgggaggccgaggcgggtggatcacaaggtcaagagttcgagaccaacccggccaacatagtgaaaccctgtctctactaaaaatacaaaaattagccgggcatggtggcacgtgcctgtagtcccagctactctggaggctgaggcaggagaatctcttgaacctgggaggcagaggttgcggtgagacgagatcgctccactgcacttcagcctgggcaacagagtgagattccgtctcaaaaaaaaaaaaaaaaaagcaaaaattagctgggcttggtagcgcacacctgtagtcccagctagttgggaggctgaggcaggacaatcacttgaacctgagaggtggaggttgcagtgagccaagattgcaccactgcactccagcctggcaacacagtgagactccatctcaagataataataataatataataataataataaaaacactttgtagaccgggagcagtggctcacacgtgtaatcctaacactttgggaggctgaggcgggtggatcgcttgagctttggagtttgagaccagcctgagcaacatggtgaaaccctgtctctacaaaacaaaacaaaaaattaactgggcgtgcgtgcctatagtcccagctacttagagggctgagggggaggatcccttgagcccaggaggcagaggttgcagtgagccaagattgcaccactgcactccagcctgggtgacagagtgaggcccttttttttttttttttttttttgagacgggttctcgttctgttgcccaggctggagtgcagtggcaggatgtaagctcactgtaacctcgcctcccaggttgaagcaattctcctgcctcagcctcctgagtagctgggactataggcacgtgccaccaccacaacgcccagctaattttttgtgtttttaatagagatgcagtttcaccatgttggccaggctggtgtcgaactcctgacctcaagtgatctgccttgcctgcctcggcctcccaaagtgctgggattacaggcatgagccactgcgcccagccaagactctgtctaaaaaaaaaaaaaaaaaaaaaagattaaaaaaacattttataattcttacctggattctggggaaaaaaaggaaaaaaaaaccactttgtatttgataatttgatcatttaaaagagttttgaaatgtttgtgatcaaagactttcaagtgaccttactacttgaaaagattatgaaccactgaatcaacagtggatgatttcagagcgctttcttggctctgaccttctaagattccttccttttctgtaagtgttctccattcatgatgtctatcagttaacattatttgggtctgcctatgaaatgtctcttatttgtctcctctttaattcaagccctcattttttccctattgctaggtctgtagtgttagtctgacttctccttacctctgaaattccttttctagcaaattccttttctagcaaattccttcccaccttgtaaccccagtgagcatacatctcgagtcagctggtgctaatcttttccgtggtttcccattgcctgtagtgagtttttagaatgccatttgggccctttacagtatatttccatcctacttttccaacctcacttttttcctccactccacttcttttcatctgctccagctaccatgtggcacccttatttttccttaagcctgacttgcactttcctaactttactcataccagcctttctaactgaaatactttgctgtctgtccatattctgtccatccttttaggcccactaaagagccatctcctccaaaatatttttctcaattattccagttgcaaatgactgctccttagatctgctaaaggacattattgttatttctgttaatgataattgacactattacctatgttatagttctctgtgtgtctatttccagtttgtaaattctttgaaggcagtgaccgcattttgttcatgtctgcatccctcttagggcccagcacataatgcagtatacgcccaattaaatttgagactcacagagtttagagtggccaccttgtccaacctctcctattagagatgaagagacttccagaggtcataccgcaagttgacagcagagatgcagtaggaactgaagtgaggcagaatttgaggattcaggtccatggggaagatagtttgctgaatgaaggagcagtgctttagggaacaattttaatggaatttaaagacagaataattcagaactggatacatagtagataccaactgcaccttgtgggaataattctctggatagtatctggcagtcttcagatactttgctgttatcctggctaaaccacataagttgttgtgtgttggttcacaatctgatcttgcagatgtaagttagaatcttgacagttttttttgagagagtttaagtcctaagattactgctttagaacatgaaaatcaaacaagactaattttaagcattaactctttggctcgttggcaaagaagggtcacataggatctgaaatttgtgcactgtgcagtttaacgtaccactacttttttttaaacagctttcaaaggtataatttatatacaatgaactgcacttaataaaacgtacaagttggcaagttttgacatatgtatatacccatgaaaccatcgccacaattaagatagtgaatgtatctttcactcccagaggctccctcataccccttgctaatctctccctgtttcaaccagtcaaccactgatctgctttctctcactgtagatgaacttgccctttattttggccagacatggggggaagggatcatacaaatggagtcatacattatgtattcttttgtttggtttccttcacatagcatagttattttgagatttatctatgtggcatgaataaatagttcattcctttttattgttgagtgtaagtccattgtatgaatgtactacagttttttatccattcccctgttggtgaacatttgagatttgaattgttttctgtttggagatattacaaatgacagtgccgtgagcattcatgtacaagtctttacataaaaatattctttcttttctctttgagtaaatagctaggaatgaaatggctagatggtatggtaggtgtatatttaactttttaagcaactggcaaactgttttccaaagtggttatagtattttacatttctaccagcagtgtatgagagtagatcatagacctaaatataaaacctaaaactacaaaacttctagaagaaaacaggaaaaaaaaatgtatgactttgagttaaacagacttctttaatatgacaccaaaagcatgatctatacaagaataaattgagctgggtgtggtggctcatgcctgtggtcccagctattcaggaggctgaggtggaggctacagtgacctgtgattgctccactacaccagcctgggtgacagagagagcttgtctaaaaaaaagaacaaagtgatacaaagtagaattaatcaaaattaaacattcggttcttcaggctaggtggtggctaacgcctgtaatcccagcactttggaaggctgaggtgggcggatcatgaggtcaggagtttcagaccagcctgaccaacatggtgaaaccctgtctctactaaaaatacaaaaattggctgggcgcggtggctaacgcctgtaatcccagcattttgggaggccaaggtgggcagatcacgaggtcaggagatagagaccatcctggctaacacagtgaaaccccatctctactaaaaataccaaaaattagccaggcatagtggcaggcacctgtagtcccagctactcgggaggctgaggcaggagaatcgcttgaacctgggaggcagaggttgcagtgagccaagatcgcaccactgcactctagcctgggcaacagagtgagactcagtctcaaaaaaaaaaaaaaaaatcggttcttcgaaggttacatacagttaagagaatgaaaagaaaagtcacaaatggagaaaaatctttgtgaagaatatatctgataaaagacttcttttcagaatatgtaaggagctttcaaaactaaatagcaagaaaataaataacccaattaaaacatgggccaaagatttgaacaagaagtacagatggggccaggcatggtggctcacacctgtaatcccagcactttgggaggccaaggcaggtggatcacctgaggtcaggaattcgaggccagcctggccaacctggtgaaaccccatctctactaaaaatacaaaaattagctgggcttggtggcagacacctgtgatcccagctactcgggaggctgaggcaggagaatcacttgaacccaggaggtggaggttgcagtgagccaagatcacgccatcgcactccagcctgggcaacagagcgagactccatctcaaaaaaaaaaaaaaaaagtacagatgataaatatgcacgtagaaagatattcaacattaaatagggaaatacaaattaaaattacagtgagattctactgcacactattagattggctaaaattttaaaaggcacagaagcaatgcaacccacatgtgcaaccaaagtgtctatgaagggatgaatggataaacaaaatggggtatatacatatgatgggatattgtacatcttgcctcaaaaagaaaggaaattctgacagatgaactttgaagacgttgtgctaaatgaaataaaccagacacaaaaggataaatgttgtatgcttttacttacatacctagagtagtcaaatctagagagacagaaagtggaatggtggttgccaggtgcttggggaggggagaatagggagtgttcaatggatgcagagtttctggttgggaagaggaaaatgttctggagatggacgatggtgatggctggacaacaaagtgaatgtacttattcccacagaactgtgcgtttaagagtggttaaaatggtaaattttacctgtaatcacattttttttttaaaggaaaagaaaaccatacttgtaagtatcctcattcctcctcttccccgttcctccagcctctggcaaccaggaatctactttgttttattttattttatttttttgagacagagtttcgttcttgtcgcctaggctggagtgcgatggcgctatctcgactcactgcaactgccgcctcctgggttcaagcgattctcctgcctcagcctcctgaagtaggtgggattacaggcgcccactaccacacccagctaattttttttgtatttttagttgagatggggtttcaccatgttggccagtctggtcttgaactcctgacctcaggtgacccacctgctatggcctcccaaagtgctgggattacaggcgtgagtcaccgagcctagcggaatctactttctatatggattcgtctattctggacatttcatataaacagaatcattctcaaaaggaagccttttgtgtctggcttatttcacttagcataatattttaaaggtttattcatattgtgatatgtatcattacttcattgctttttatggctgaataatattcattatatgcacataacacatgtttatcctttcatcacttggtggacatttggattgtttccactgctgtgaacatttgtgtacaagttttgtgaaaatagcatgttttcaattatctttggtataaaaacattcttaatactaccttaggttcaattatgcaaagtgaaattcctgaattaaaagagtatgttcatttttaaggcttttcatttgtatcatgtagttacctacccaaaaggttgtatcagttgaattgtgtactactactaacaatatattagcccatttatttgtagtgtctattaagagacaagaaaattgttctgaaaacatcttctgtatctaccactggtagtcatcagtttctcttacatagttcttccctcttctctctatcctcactgctgctcccctggtttactccttcatcacctctcaccatttactgccttgtaattgaaaattcttcccctaacactggtgcagagtgaattctataagtcagatctcgtcattttacttctttaagaccacttatggcctgccattgattttctggaagaagtctaaattccaagcatgacataaaatacctgttagaatctggcttctgtgcatcttttcagtttcagttcttgtccttcacctcacccttttaccttctcaccacctctctcccattctgaccccaatcataccaaactacttgttccttgaaagtataatactatgtcttattcctctctgccttttcatgtgctgctactccctctacctagaacacttttcttctggataactcctactttttcttaaaatttagtttagatgttacccttctgggaagccttccctgtaccctctgttcttttttaagctcctatagtttctagtcttagcccatagcgtttatttatctggattacagttgccttttttttctgtatctttcattgtattgagctccttaagactagagaatatatcgggccaggcacggtgtctcacacctgtaatcccagcactttgggaggctgaggtgggagaatcacaaggtcaggagatcgagatcatcatggctaacacagtgaaacccccgtctctgctaaaaatacaaaaagttagccgggtgtggtggcatgcacctgtagtcccagctactcgggaggctgaggcaggggaattgtttgaacccaggaggcggaggttgcagtgagcagagatcgtgccactgtactccagcctgggcaacagagcgagactctgtctcaaaaaaaaaaaaaaaaaaaaaaggccaggtgcggtggcccaagcctgtaatcccagcattttgggaggccgaggcaggtggatcacctgaggtcaggagttcgagaccagcctggccaacatggtgaaacctcgtctctaaaaatacaaaaattatcccagcatggtggcaggcccctgtaatcccagctactcgggaggctgaggcaggagaattgcttgaacctgggaggtggaggttgcagtgagccaagatcaggccattgcactccagcctgggcgacagagcaaaactccacctcaaaaaaaaaaaaaaaaaaaaaaaagaagactagagtgcatatcttattcttctctgttgccccagcacaggcaatgcgcataataggtacttagcaaatgtttagtaggtgagtgaaagctgctgtttcaaaaagaagtctgtgtggaggagacgctgacgcaagcttcagctattattaggttgttacttcctacctgggcaggatatgaactaataagatttatgatgtctccttcagggaaaagactactttgtgtgtatccattctggagagattgctccaagctatggaaccggttcacgtggcccggaacctcagggttgacctgcagaggggactaattcaccctgatgattctgtaaaaatcctcactctttcccaggtatgaaattctactaggaaccgacattgaccacctgctctgggccaggttctgcactgggacagaaagatgaagaaagcacagtatttctctctctccttccctcttccttctccccctctcctctgctccctctttccccctaggaaatgtgtggtctattccaatgtgcatagctaactataacctgggagatacaagctaaagaaagaagttccattaagtaccatctaaatcattcattaatcagatactgactgagttccttttacatgccaggcatggtgccatatgctgttagagttaccaagataaacaaaactgattactttccttcaaggagctcctagtgtaaagaaaaagattcctatgtgttcaaatagctctctgccattttagattctttacactggatgaaccaaatgctattgtaaaggtcactaaaccaacaattaagacagtaactcttatcatcctggtaaccaaagcatccttgctatttgagtgaagagctgctgctaaggattatcttgttgaaatgttaggagctaaacagttactcagtagatactgaactactgtttttccttttctgtgtttattcagcaaaaaagggcgctgggcacagtggctcacgcctgtaatcccagcactttgggaagccaaggcaggcggatcacctgaggtcaggagttcaagaccagcctggccaacatggtgaaaccctgtctctacacaaatacagaaattagccgggcatgatggcaggtgcctgtaatcccagctactcaggagcctgaggtgggagaatcgtttgaacccaggaggcagaggttgtagtgagctgagatcgcgccactgcactccagcctgggcgaaagagtgagactccatctcaaaaaaaaaaaaaaaaaaaaaggttgggggaaagggggaagatatcagtttattcactggccatttatatgccagacactgtagcaggtgctttgcctgttcggtctcatttaatcttcgtaactatcctggaattaaatattgtgttcccattttacggataagaaatggggctaaaatttgtgcaaggtcagtgtagctaaacatagagctgggtttgtattgttttcactcactgaactatcttacctctttacccactttcttttttctttcctttcaaagatgtgactataccatatgtgtgtttgactgaatgaatttaggtcattttgattttttaatgaattgatatatagctgtgatcactaactcctaaaataactgtgcactaaggaaattggaccatcgtgtgtttaccgtatgttgccctactttagaagagtgtttctgattgtttttctttcagattggaagaattgttgaaaattctgatgctgttactgagattctaaataatgctgaattactaaaacaaattgtttattgcattggtggagagaatctatctgtagcaaaagcggtgagtctactagaatcattgacttaaatgtgcagagacatcggtgtcccaaaagataaagaaaggccttctgaattgagaggtgaaggtttagaatggatgatttgcgtaatggaatttacaacttcatatggattgtgtaaaataaatggttgtcaagtaaatactagtaaacccctttcattttctaggatatacatatctacagtatccatcataattctatgggggataccttgcgtcttttccaattataaataatagctaaaacatgggcaaggtgcattccatgcactatttttacatcactcttatgaagtagataataacctgcattttgggaatgtaagagatattttctttcgttataaggctatcaaatccctgtcaagaatatcactaacccaagctggactggaggctttatttgaaagcaatctgctggatgatttgaaaagtgtaatgaaaacaaatgacattgttcgatacagggtgtatgaggtaagataaaaagcacactttctcatgcttacaaagcagaatgcagtttggcttatgctgaaaagcaagatggctcattaagtatataatctgtgtttggccctacagtaggtgctgggaatataaggatgcattcccagcctagtatgtgagacagtcataaaaaatacttacagcccagctctatgggaggcaagggcaggaggaccccttgaggccaggagtttcagaccagcctgggcaacatagtgagaccccatctctacaacgattttaaaaattagctgtgcatggtggtatgtgcatgtcgtcccagctactcaggaggttgaagtgggaggatcaactgagcccagaaagttgaagcagcagtgagccgtggttgcactactgcactccagcctggccaacagagcaagaccctttttatatatatatatatatttacagtgcaatataattactatgatagagaagatattgaaaccagacttgaaaaaatttgtagtagtaataagaaatggcccttatttgtaccagctttgtactaagcactatgctaaaatactcacatatattatctttaattcttacagtaaactttgtatgttgttatcattaacctcatattgatggagcaattgatccaagaccacacagttaatagggtgcatgtttgaaatagaatcctctatagtctaattccatcttcagaacactttcttactttgcatgtcatgataccatactatgctgcttttccttctacctctcagtttcttctcagcctcctggctcattatcctccgttgaatctttaattgttggagttgatgaaaacagagttccaagccctgctttcacggtactctactcattcctaggcagttttactcacttatgatttcacttcccatcagtgatgatgcctctcagatgtaaacttccaactgagacctttcttctgagctcgaaccttcatgctcaactgcttactcactcttggccccttgggtatattctaggccactcaaactcatgctgaaatcaaattcctgatcttccttatccaccctatccccctaataaaaaataagacaacaaactggctgtgtctcacagtctgcttagttgggtattagaccttggctcattctgaggcctgttttccttgccacatatccattcggtcatcatattttgttgattttatttaaacccctgcatttctcttcattagtacagcttctaccaccctagactaacttactggtgtcactcacctgggctactatatttgcatccaaactggtctccactcatccatttttatcatccctagtctatcttctcatgcagtcagaatggtcttttaaaagtccaaatctgattgtgtcatttctctgcttaaaacccttcagtgtcttcctatatctctcagtaagacctcagaacatacttgctgaatgagtgagtgaatgactgactgactgactgacaggatgcctgaatgagtgaatggttttataatctgtttgttgtggctgattcaggcttttgtaccctgattgatgattgcttgggcgggaaagtgctgatacacctagatataatggaacatttctgtgccaaggtggcagggcatggtggctcatgcctgtaatctcaacacttcaggaggccagggcgggcagatcacttgagggcaggagttcaagacaagcctggccaacatagcaaaaccccatcgctactaaaaatacaaaacaattagccaggtgtggtggtgcatgcctgtaatcccagctactggggaggctgaggcacgagaatcgcttgaactcaagaggcagaggttgcagtgagctgagatcacgccactgcactccagcctaggtgacagagtgagactctgtctcaaaaataataataataataatctgtgccaaagtaatttcttatgcgttcactgaagtttttctacttaaagagacaaataatggattttttaaaactcatttataaaaagtacctagtcctacatttaacttaaaatgagatctatcaggcgtagggctgatttgacctttttcttttttctgtgtttttttttttatttcagctaattatagagatttcttccgtgtcaccagaatctttaaactactgtaccacaagtggattggtaacccagctcctgagagagctgactggtgaggatgtgttggtcaggtgtgttgactgagttcttaaagtgaaatatcctcttttgaagggctgggaaacaaccttgggacatctgtgattttctctattagagactttgcccaggttgcaatctcatgactgatgtgtgtcctgaaggagggatctttagaaaattgttcaagttacatcgtgacaacatactggaacttgggaaagccccacatgacaattcagctactttcaagtgactctgttccatgtccctaggcctgtgtgctcttaaaaagttgcaatcatgtggtaactgccattttgaattactaatattttatcatattcatttattttggcattgttaaatagcaacactatggcatgatagaaaaaacatgggctaggccgggtgcggtggctcacgcctgtaatcccagcactttgggaggctgaggtgggcgattcatgaggtcaggagttcaagaccagcctggccaacatagtgaaaccctgtccctactaaaaatacaaaaattagctgggtatggtggcatgtgcctatattcccagctactcaggaggctgaggaaggagaattgcttgaacctgggaggtggaggttgcaccactgtactccagcctgggcaacagagtaagactctgtctcaaaaaaaaaaaaaaaaaaagaatatgagcttttcaaaatgaggaagacttggcttgcatgcctctctactatttattagctgtttggccttggacagataattataagctttctacatctcagtttcctcatctctcagaacagtaactaaaaaagatattgtgccaggtgcagtggctcacagcctgtaatcccagcactttgggaggctgaggcggatggattacctgaggtcaggaattcaggaccagcctggccaatacggtgaaaccctgtctctactaaaaaaatacaaaaaattagctgggcgtggtggtgggtgcctgtaatcctagctactgggaaggctgagacaagagaattgcttaaacccgggaggtgaagattgcagggagccaagatcgtgccattgcactccagcctgggcaacaagagcaaaactccgtctcaaaaaaaataaaaagatattgtaagaattaagctaattgaccatagaaagcagtacaatggctgacataggttctcaaagaaatgttaattccagtctcttccacccgctattccctaaatcccctttaatatctgccaaatgttcttttgttgatattccacagtttactaatacctcctcactgttgaacagttgatttgcttcaagtattttgctgttatgatagcattatagttatctttgtgtatataggttttgatttttcttatcttaaatgattttctgattgtcctgtgttctttaaacatggctgaatttattaaacccatatgagtaaatcagtcactagttacattgcttcagtgcatttgagtgtctcaacctaatgagacaattaattttgttaattattttttagcattgtatcaaattttgtgacatagaaaaaaacctgtaaatggtcagtcaaaacagtttaggatcaaccaccaactaaataaattttttagttattttctttgatcatggttggatatgagatgataccaaagaattattgttaatttcttaatatgtggcagtggcattataattgtgtaaggaaacatatgtgttttgtagagatgcatactaaagtatgcaggggtaaatggcagggtgactaggatttgctttaaaatagttcagcaaaaagtagggaaaagagatgaaataagtaaagcaaaatcttcataaccataaaatcaggttatgtgtatatgggggcttattgtattctcattacttttgtgtatgatatttcaaaataaaacacaaatttagaaaatattttaggaagcagctaggttatagtggaaacaatagtggacttcaaatcagaaggtcaagatttaaatctaaactctgcctataataacaatatgattacagagaagtcactgcaaatttctaggccttagggcttcatgtgaaaagaggagccaagattattgacctttcgaatgtgataagaagaattaaataagataacctgtatgagagcaatttataaactatgcaaatcctgtgcaaaatctccttgtttttgtccttctgacattttagagccacctgtatagaaatggtgacatcactggcatatactcatcatgggcgacaatatcttgctcaagaaggagtaattgaccaaatttctaatataattgttggggcagattcagaccctttctctagcttctatctgccaggtaaggaacactgatgcctatggaaatgatggtgcgtgttttatttctgagttatctctgacatcagggggttggggtagggagtggacagggattgttttcctttagagctgatttccttaatgagctgatttcgtttagaagatatctagagcaaccaagttcaaattcaacagcacattaaaagggtcatccaccctgatgaagtgggatttatcctatggatgcagggagggttcagcatatacaaatcaataaataagatatactatgttaacagaataaagacagcaaccaagtaatgcgggaaaagcatttcacaaatttcacctttcttttatgataaaaactcttaacaaataaagtatagaaggaatctatctcaacacaataaaggccatgtatgacaaacccacagctaacatactcagcggtgaaaagttgaaagcgttcctctaagatcaggaacaaggccgggcgcagtggctcatgcctgtaatcccaacactctgggaggccaaggcaggcagatcatgaggtcaggtgatcgagaccatcctggctaacacagtgaaaccccatctcaactaaaaatacaaaaaattagccgggcatggtggtgggtgccggtagtcccagctactcaggaggctgaggcaggagaatcctttgaacctgggaggtggagattgcagtgagccaggatcgcgccactgcactccagcctggacaacagagtgagactccatctcaaaaaaaaaaaaaaaaaaagatcaggacaaggatgcccacaattaccacttctattcagcaaagtacaagaagttatagccagagcaattaggcaagataaataaataaaaggcatccaaatcggaaagaaagaagtgaaaatttccctgtttgcaagtgatgtaatgttttattaatatatagaataaagtttccaccaaaaaactgttagaatgaataaataaattcaataaagctgcaggatacaaaatcagtgcataaaaatccgtagcatttctatacactaacagtgaactctgaaaaagtaatcaaagatacattcccatttacaatagcattcaaaaaaaattaaatatttatgaataaatttaaggaggtgaaagatctgtacactgaaaactataaaaactgatgaaggaaattgaagaagacacaaataaatggaaaggtatcctatgttcatggattggaaggattaatattattaaaatgttcatgctgcccaaagcactatatagattcagtgcattccctccaaaatttttaaatttaatgacatttttcacgaaagcagaaaaaataatttttaaatatacatatttcagaatacattgttcacaataaagatatatgattttttgtcagttaaaagttaatttttttaaaaagatacctatagcctcttattgaggtggaatctgttgctcttggagctacgtactgttgactttggttttctggaaacatcagtgctatttagaacattaggatatttttctttttgaatatcaacaaaaacataaataaaaatactagtaatgacatttacagtatgtttcacagattaatcacatctctgagtgggagtctttatctgttgtaggatctactcttgccattctattctgggttttggttgattagtctttcttgaacacttccagaaattggagatgtatgcctgccttaggtagcctagcttattttattaatgaacatatccatttaaaaatttcttcctggtaatgagtctaaacttgccttcctgtaatttgtatccactggtcctttttctttgttctccctcttgcatatgccagtacttcaatagctggtcccagctccattgacgccctctctcaggatcacacatcacaggtccttcagaatctcctaatggtctctctgatctccaggcaacacactactctaacctttctatgcttttctggcctgcagttcatttctgttcctgtgaagtcatagagcccgcaattcatgctgtcttgttcccctattaaaatatatttttgtaaatctctttaggattcgtgaagttttttggaaacctggctgtcatggatagtcctcaacagatctgtgagcgttatcctatctttgtggaaaaagtctttgaaatgatagaaagtcaggaccccactatgattggtgtagctgtagacacagttggaatcttgggatccaatgttgaaggaaaacaggttttacagaaaacaggttggtatgacttggccctgttcagggatatcttaatctttgacaggggttcaatatgtaagttcatttgctggtgggttaactacattgtagaaactattttatgggtggcagtcttgttaaccatgaccttgtactcatgtctgaaaatctaataattattacggaaaacctttttttttttttttttgacttttcactggtttaggttttcattggtttaggtttctaccaatcgatttcaaccaaacattgtttcctgtttcccctctatgatgtcttctttgactagatttcatggtacaaagaccacgggctagagtcagaaaggtctggattcatgtccttgggttttctattctttttttttttttttttttttttaagagattgagagtgtctctctgttacccaggctggccccgaactcccgggctcaagcaatcctcctgcctcatcctcttgattggctgggtctacaggtccacaccattgtatccagccctgactttgctttttgaacttcatttactcacttcacttttctaggcctcattttcttcatttataaaaatggcataacaactgcttctcagggttgttgtgaatatttatgaaattttgagaaaggaaaataaaagtttgttataagatttcatgttaagagatacttttggcatgttaagagatacaatggttcatgcctgtaatccagcactttgggaggctaaggtgggtgggttgcctgagctcaggagttcaagaccaggctgggcaacatggcaaaatcctatctctactcaagaatacaaaaattaaccaggcatggtactgcacaactgtagtcccagctacttgagaagctgaggaaggagaatctcttgaacctggcaggtggaggttgcagtgagctgagatcatgccactacactccagcctgggtgacagagtgaaattctatctcaaaaaaaaaaaaaaaaaaagaggccaggtatggtggctcatgcctgtaatcccagcattttgggaggccaaagcaggtggatcacttgaggtcaggagctcgagaccagcctggccaacatggtgaaaccctgtctctactaaaagtacaaaaatcagccaagcgtggtggtgcatgcctgcagtcccagctactcgggaggctgaggcaggagaatggcatgaacacaggaggtaaaggttgcagtgagccgagatcacaccactgcactccagcctgggcgacagtgcgagactctgtaaaaaaaaaaaaaaagaaagaaagaaagatacttttatggaacatccatgaggatcaacagcacaacaaattttacacacaaaataatatgcagcccaattattaaaattcttgagacacatatgttgaaaattatctcacctgtaatcccagcacttcaggaggccaaggcgggaggatcgtttgagcccaggaattcaagaccagcttcgtcaacaacaacaacaaaaaaaattagccagctgtggtggtgcatgcctatagtcccagccactcgggaggctgaggtgggagaatcatttgagcccaggaggtgaaggctgtagtgagccttgatcactcagttgcactgcagcctaggtgacagagtgagaccccatctcaaaaaaaaaatttaaaaagaggccaggcgaggtggctcatgcctgtaatcccaacactttgggaggccaaggtgggtagattacctgaggtcaagagttcgagaccagcctggccaacatggtctctactaaaaatacaaaaattagctaggtgtgatggcaggcgcctgtaatcccagctactcgggaggttgaggcaggagaatcgcttgaacctgggccgtgagtcgagattgcgccattgcactccagcctgggtgacacagcgagactccatctcaaaaaaataaaaattagaaaatagaaaaagaaaaaaagaaaattaatacgctgttgtgtatcacagctaatatttttgttatatgtcgttttctaagtgcttttacctatgacaatcgttttacagtcctgcaaagaacatacattgtcattttcattttccagataaggtagatgaaacttagaggagttaagaaaatttctaaggtcatacaaattatggcagctgctactcaagtccaggtcctttgattccagttttataactttgccttatatatgctgtgttgcgtgtaattatgtgttctaggcctgtcactggttctctgactacatgcttatttttgtattggtttaggttggtagaggtcatagtgtatgagagcatactttaaaaaaatctcatttttcacttcatatccattaggatggctattactttaaaaaaaaacccataaaataataagtgttaggatgtggagaaattgtaacccttgtacattttatatttccttcatccagcagctccactttcaggtatataccaaaaaaaattgaaagcagagactcaaacaaatgtttgtacagtcatgttcatagcagcgttattcacaataaccaaaaaaaggtgcaagcaacccaatgttcattgatagatgaatcaataaacaaaatgtggtatatacatacaattgaatattactcagcctttaaaaagaatgagattctggcacatgctacagcatggaggaagcctgcgccactgataacattatgctaagtgaagtaagccaaacacataaggacagatattgtatgattccacttagatgagatgcctaaaagagtccagttcacaggaggtagaatagtggttggcaggggatgagggtagagaagaaagggaattattgtttgatggatacagagtttcagtttgggttgatgaaaaagttctagagatggatggttatgatggttgcccaacagtgtgaatgtacttaatagcactgaactatacactaaaaatggttaaaatggtaaattttatgttgtgtatattttaccataataaagaagaatctcactgttatccttcaaaggaactcgctttgaacgcttgcttatgagaataggacatcaatcaaagaatgccccagtggagctaaaaattagatgtttggatgcaatttcatctcttctgtacttaccagtaagtaggtagggaaataatgaaggacagtgggatatgtttgggagaataaatctgtatgaatcaacatgataaatgtgatgaagtaaatacaagaagataaccctcattatatgactagtgacatttttaatttaaaatggaatcatagagtgttagaactgaagagactctagagactgcttaatcaaccacattcaaagaaaactgggaaaggtctgggctggatttgagaaagagtcctccagacttagccagtttcacacaacaaattaatgacagagtgccatcagcactcaggtgtctgacttctaaataagtgcttttctccagatcagttaacttttgatgagattttccttttctttcctgtagcctgagcagcagactgatgaccttctgaggatgacagaatcctggttttcttctttatctcgggatccactggagctcttccgtggcattagtagtcagcccttccctgaactacactgtgctgccttaaaagtgtttacggtaggtattcacttccataggtccttctgggaccctgccagctcaacacttgagtacttaacagtgagccagagcctgtgccatctctggggatgcacaagtgcatagtatagtttctaccttctgctaccttagagactaagtaaggagacagatgtgtaaacagattgtttcagtaaaagatattaggtgctgtttgaggtttgaacaggatgctatgggatcacacagttaattccagactttttatctgccatcctctattaacctagccctggtcttcctaatccttatttcccgtgcagaaaataaggcttctggcacctaatgctccagtggtaccaaactgtttgttttgtgtctctggacctttgctggggtctccgtatctaacactcttccttaactttgcttcttaacctcttactcactcgtcaaggactaactccttgtcttcagcacactttgcccagattgacaaggttgagttaaacaatgttggttctcatatgttgcatttatttattcagcaaatatttgttgagtttccgtttttgctcagtgaagggcatacaacagtgaagaaaatatataaagaccttcctttcatgtagtttcctgtctattgaaggagccaggcagtaaatataattgtacagttacttatataattacagctgtggtaaggattatacctttgtgttctatttgttatattattttgcaaatgtttatttatcgacttgtcttacctattaagtagagttggctgagagcaggaagcatatctgatttatctttgtagccccagcatagcaagatagtaatcgctttagtaatcatatcaataatgggatctcagacagcatacatggcctagactgggagggaataaggaaaatggcagggacaaaagagggaaggcttcctgaggatgcgatacaggatctgggtcttgaaggatacaggtattcctataatcttcagaaacatttttttttttgagacagagtctcgctctgtcgcccaggctggaatgcagtggcgtgatcttggctcactgcaagcaccacctcccgggttcacgccattctcctgcctcagcctcccgagcagctagcctacgggcgcccaccaccatgcccgactaatttctttttgtatttctagtagagacggggtttcactgtgttagccaggatggtctcgatctcctgaccttgtgatccgcccgcctcggcctcccagagtgctgggattacaggcgtgagccaccgcgcctagccagaaacatttctttaagactgcttcacccttgtaaatggtcattgtatgagatggccattttggatcctgcttagtattttcattattagtttattttggttttgctcttctaccttatcctgtgcttagctggttccattgtagaaataattttctatttactggttgggataactatttttatttctgcctactttcatgcttggttgtgaagcaggccaaagtttctcaaacattaatcttaggaatcttattaaaatgtagattctaattcagtagttgtggggcagagcctgggatcctgaaagtctaacaagctcgcaggtgttgctgatgctacttgtctgtggaacacattttgagaggaaaaaactaggccataaacttgttacttctttttcattaaaacgtaataggttttgaaaaacttaatcttaaaatttggaaaagacttagaagtagaattttttaaaatcacagaaagttctaccttttggtgtatttccttttagtttttgtattagtgtgtgtttatttttggtgaaatatttcaaatatagttgtatcttgctacctctgcccagtcctattccccttcctctgttcttagataaaatcactatcacaaagtcagggcccataaatgatttcatatttctactacatattgtgtgtatccttaaataaaacacagtattttagatattcataaactttgtaagtggtatcatgctgtttgtatcattccattaggttggtgcaaaagtaattgcagtttttgctttttttttttttctcttcaatgttacgtttttttaaaatttgtctatgttaaaagaggcagttagaaagttggtatttcattgaatagccacaatatatcattctcctataaatgaagatttagatagtatcttacaaatgataccacaatgaacattcttgaaaatgtttgtgcactatatgagtatcttgaggttagtcttttctactttagtttttatttttccactgttgtaatcatgcattgtttataatttgaatctgctttttttatataacaggtttacctgtatcatttcctattttttgtaaacattattgttaatgtttatttttattgctatataccataatttacttaaccattctcccattattagatatttatattgtaactttcacactattatgaacatttttgtatacaaagatttttcatatttaagattattttattaagttagattctcaggaaggaatttacttagacaaaaggtaacatttttaaagttcatgttgccagatttctttgtaaatattgtgccatcccattaacaaacaacttccactcaggggaattgtattctttctgccttccatttcaggccattgcaaaccaaccctgggctcagaaacttatgtttaacagtccaggttttgtagaatatgtggtggaccggtctgtggagcatgacaaagcttcaaaggatgccaaatatgaactagtgaaagcacttgccaattccaagacaattgcagaaatctttgggaacccaaattatttgaggctcagaacttacctgagtgaagggccatactatgtgaaacctgtttccacgacagcagtagaaggagccgaatgatttcttctagagctcatgtagaggaccacgttttgaccaaaacttctcctaaggcatttgactccatctatatttcacaaaagagacttcctttccccaagaattatcatggaatgtcagatgttactttgttaccaacactgttatatttctacattgaaatgcaaagtggaactaggagtttggaatgcattaagagcagacaagcttggtcataatagatccagtgtttttcagattcctttcactgccttaatctttgcaacagggtggaagtttttttcttccctcaaaattttcatggacatgcaatcttatctaaaagcctgcttcagggctgggcgcggtggctaacacctataattcccagcactttgggaggccaagatgggcaaatcacttgagtctaggagttcaagaccagcctggccaatatggcaaaaccctgtctctactaaaaatataaaatcagccaggcatggtggcgcacacctataatctcagctactcaggaggctgaggcacgagaatcgcttgagcctgggaggcagaggttgcagtgagctgagatcttgccactgcacaccagcctgggcaacacagcaagactctgtctcaaaaataaatgaataaaataaaaacctgccaccaaattatttctggattctcttcactatctttttttttctttttggtcctttttccatttctgattccactttcaaagtcttggatatattctttgaaaaatgagtagtatggaatattaagattatgttccttatactcagaatactttttatgagctctcttgtttttttgttactattattcctttgaaaaaaagacaaaatatctaaaaaatgtttatagtgttcatgtaattttttttgctgtttaccaatgaactttgccctgttgtggttttgggggatcagaaggattcctaaactgtcatttcatttattggtaggtcatgattgctgagggttttgctttggatttttcatacctataaagtcaatcttgagttgatcagagaaagggaaacttactcctaataaacagactcagaacagaagggacatatgcataaatcaggataccatctcattaatttacaaaggataatctttcttttcattgacaacacctacacccacctgttttccagtgttcttctctctaaacagcaaagccaaagcactctgcacaccaaatcacctgttcagaggtttatgcatgagcatatttcttttaggccgtggtgaagttgataaaccacccctgctttgtaacaaaattattttaaagtgactggaattatctagtccccagattgatcatctcccctggcaacgtgactctgttttttgtgtgtgtttccatgctgactagtcccctactgttaatatcactactaattaggctataaccaggtctttcctggcctgagaaatattctcttaaaatgacctttgttttaatctcattcatgatgttgattttttttcaatgtggtgcaatatatacaataaaatttgtcataactattttaagtgtacagttcagtatattacatatgttcataagttgtacaaccatcaccaccatccatcttcagaattattttcatcttatacaattgaaactgtattcattaaacaataactgtctattccctcttttccccagcctctggcaaccaccattctgcttcatgacattgattttattcacttaacatcagattttggggggatgccctctctcctatgtatggtctacacattctgattttttttttagattgaataaaatttgtaaatcattattttcatttcataagtaaacacctgttgactgcctattatgttcttgggattggggaaggtgctagacattggcctaagtgccaagtgcatctcatttaatttttacatccctgtttcacagatgaggaaaccaagactttagtagcttatctgaaaatcacacaagaagaaagtgtcttatattggaagaaaataggtcaatagaaaattagagagtataagaagtacaataatagaggaaaacagaaaacacgtcccctgactttaggaaatgttttccagggaaggaaacacctgcatcttgaagaactagtaggaggcaatcaagtgaagaatacagtggagtagcaaagcaagacagcaggtacacatgaaaacaagagaacatgtttgagaaactacaagtaattcaatatgaccaacgcctaggatttaaagggaaatttttgcaaaattctttatcattattactaataatagctaccatttcttagcattgattttatgttaggcacttggcatgcatttcttactttatcatcataatagccataaaagttacgtatcatttcacagacaaaggcactaaactgggaaattaagtactttgtacaggtcgcaaagccagaatattaatctgattttctgaggattagttgtactccccttttgtcacttggttatattttgaaggtaatagtagctaacagttactgagtttttaatgtgtcccaagcattttctaagaggttttcatgtatgaactcatgtggccatcgtcacacttccaggagttatataacaaaaccaaggcacagcaaaattcaggaacttgcacgggatcgcatagcaaataagagaagtcaacatttcaacctaggctgtttaacatagaatatat

SEQ ID NO: 15651 - DNA, 9275 bp, Human
ggacactcagccctctcgccctgtgatgccctacaccaccttgggcctctgcaaagaatccccacaagcaagaaggccctcacaagatacacttcctggacctcagacttcccagcctcgaaaactgtaagaaataaatgttgttctcataaattacacagttccaggtattctgttattagcaacagaaaagagactaggacagatatcacagttagattgtattctacacattgtgactggttctccagagaagcaatgcataaaaagaggaataatcggccgggcacggtggctcacacctgtaattccagcactctgggaggccaaggcaggcgaatcacgaggtcaggagttcaagaccagtctggtcaatatggtgaaaccccatctctactaaaaatacaaaaattagccaggcgtggtggtgcgcgcctgtagtcccagctcctctggaggctgaggcagaggaatcacttgaacccaggaggcagacattgcagtgagctgcgattgcgccactgcactccagcctgaacaacagagccagactccgtctcaaaaaaaaaaaaagaggaataatctccaaaatagtaaacaaattcctgcagacaggaaatataatggtagatacctgagctaggagagggggaatggggaactattattcaatggatacagtttcagtttaggaagataaacaagctctgggaataaacagtagtaatggttacacaatgtgaaggtacttaatgctactgaactcaaagttggttaaaatggtacttgctatgtgaggtatattttaccacttaaaaaactataggtgattgtgcttctaaaagagttatcagtttaatcttcaatagaaatcaatggactttgttcatttttaacaaagtcaaaatatgcatacgaaaaggttatggggtaaaggcagaggtaattatttttttccccgaaaggtattttctacaatgaatgtttttatgtaataaaaaatgaaatgacaaaagtttagaatgtttgtgggttttgttccttaaatccttaattacataaattaatatctacattatacagattaagatacatatttttcctctatctacaacatttctccattctctgtatcttaaatcctgacattaaatgtcattaaatttcttaaatctcaagagaacgacttggttaccaaggaagatataatccatagcctagagagtgggcgaataaaagcagcttctaatgttctcaactgcttttctcctgtcaaccaaatgtttctgtaaataactcatttctgttggttttgggtaagacgtgggagaaggaagaatccctgaatggaggagtctggaaaggatgcttgacaaaacgcccgcgctctctggagacgcagccagtctcctccctcctagggtctggtcttgacgatagcatctcgtgttttggggatgcctttccttaccagattcttctaaagcccagctgcacccacccttaagtgggagataaggcttctgcccgcgggctctgcgttcgtccacccggccccacgtttgctgtggactaaacaggagccactggactagagtacacttgactctcggctctgcggaccaaaaattccaggactaaggaatagcaaggttaggctgaaacagtccacacagggcttgcggtaaacgtcttttcaggagccactcgcccagtgcagtaagtcgtgtacttagttgactcgagcgctccagggagacgcccgaccctactctgcgccgccccggggcaccagctctgcttcctccaggtccactgaggcaggcacgcccagctctgggacagtcagtaaacaagccacgaaccgcgccagggatcagagcacccagagtccccgcccagctgccggcacagccaatcgcagcgcagccaggcggcggggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggtaccgcagccaggccgcgccgcgccgactcagggcctggcccggccagacagggaagctcagtccccgcacgccagacagcggtactcctgctggcgtcaccgcaaacatcctctgaccgctacagccagtgtgtggcgcaggcgtcatgtccccggccctgccacgcctggagccctggaagctggctgcagggcgctggcttcccgcgtgcggccatatgaccccgtccctgatttaggggagcagtttggggtgtcggcagcacaggcccaagtgaatgaaggagggagcagtgcgtgctctccttcccagtttttcctgggaaagcatttcagaaaggtttcatttaaggagaggttggggcggcgcggtggctcactcctgtaatcccagcactttgggaggctgaggtgggcggatcacctgaggtcagtagttcgagaccagcctggccaacatggtgaaaccccgtctctactgaaaatacaaaattagacgggcgaggcggcgcacgcctgtagttccagctattcaagaggctgaggaagaatggcttgaacccgggaggcagaggttgctgtgagccgatatcgcgccgttgaactccagcctgggccacagagcaagactccatctcaaaaaataaataaataaataaataaataaataaataaataaataggagagattggaaaacttatctcagcttttggtgtttgttagtcaggaagatgtgtgaaggcctcctaactcttggggatctctttgtccctacttgggaatcccaccttatcattagtgaggttttgcctgggcacgaaacctggattttttgcgattggtacaaaacctggatcaaccgtttcccggtttcctagttgttgccttaagcttctcacacacaaggtagtttcataccgttctcataacctaaattgtcatcgcataaactgtttcagctcctacagctctggacaggctgcttttcattttggtgagtccatccagtacctccacgtgccctgtttttctccaggcacatccttggcctcttccacagtccttgggtaaatgcttgggagaataatttaaatatttttattctaccatggtggccctaatttttcagggggcagtaagatggctttttaggattggtctaatcagatcctcatttttgttcccttcctaggttttaaaacatgaatcctacactcatccttgctgccttttgcctgggaattgcctcagctactctaacatttgatcacagtttagaggcacagtggaccaagtggaaggcgatgcacaacagattatacggcatggttagtgaaacttccccagaaagaatagtcttggctgttgagaagttttagtcagagagtagcttctagaggccagcttttaccaatagcctaatgtaataacctaatggcgtggattatgagcacaatgtggacattcatccttgttgtgtctcagtttggagaacagcatccccagaggtgtcaagccttcccttgccatggtttctcttccatctctgtctgcagattcacttggtgaggatgagttgggttttaggtagaagtaaagagcatcagttacatgtttgcctctagaatgaagaaggatggaggagagcagtgtgggagaagaacatgaagatgattgaactgcacaatcaggaatacagggaagggaaacacagcttcacaatggccatgaacgcctttggagacatggtaagtgtgctgtggactgccgagctctgtgcttcctctcttcggttctttactaaggtaatctcttgcttttcaacattttatttccttttccttgaagaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcaggtgagacagtgtcaggttcagacctcccatcttcccaggaaagccaagaagtgattgacatctttgttttggtagactttaaagtgatgtacagttcactttttaacagtattcagatgtgtgagctgttgtcaaagtcttattattttttttttgtggatgacagctttttttaattcccttttcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagtaagtggagctccttgtcatcattccagctcagcttttggaaggtggacactttaagagataacagatacctttttcggaattcatatattagggctgggtggggtggctcacgcctgtaatcccagccctttaggaggctgagccaggcagatggcttaagctcaggagtttgagaccagcctgggcaacaaggtgaaaccttgactctatcaaaaatacaacgaaaattagccggctgtggtggtgtgcgtctgtggtcccagctatgctgaggtagggcgattgcttgagtgtgggaggtggttgtgcaaatgcactctccagtctgagtgacagaatgagaccctgtctccaaaaaaaaaaaaaagttcacatattagatggcagaatatatatctgcaaattgtcagtactgtcattataaattattagcctttgcacaatcctgtgattagatgggtaacatatagctgttcttgcttctatgtaacgtgaagaatatacaagccattctaaatatacacatttctctattgtgaaaaatgtcttatggaagtaaacccagaggtctcattgaagagactggagtcaattttcagtttcagattaactaatagcatttcacttcctgggatgatttataacagtggtgacttggaaatactaagctgcacactgctgagtgttgtggttctaactcatgttctccaggaggaggacagcagtaatcaagtcttttttttccctttacctttgaaaggaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggtaagcatatttttctttgtagaaattgatgcagaaaaagagtatcatgacatacgagcatgatagactctggtttgcaagtaaagttcagtgtagatatttaggtgcttagcatcatagttgttcattctgtacatgcaatatttatacctgatgtttccatttgacattatgttgcgtatatctccatgaatataagtacttcataactttttataaatagctatatttactgtgtagtttaatatacttaaaatattctgcaattgttggatttttataatttttccaaagatttttacttctattattaaatccgaaaagagccttttgattcaaggattttagtgttctgtgctatttttttagattgatatcctagagtagaattacaagcttacaaagaggggtctttttttcctctaggaaagcttttttttaatgaaggatttatgctgatttctatttctgctagttgtaaatgagagcttaaatccctggccttcttattgttgttaagtactatctggaatgtgtgtcacttcactgaattcagagatgcctcattccctgtgggtgacaggatgggttactgtcatgtgtcctctggagcttctcaccccagccctcattttaccatcccaggcatttattttgagccagactgtagcagtgaagacatggatcatggtgtgctggtggttggctacggatttgaaagcacagaatcagataacaataaatattggctggtgaagaacaggtataaattgccagaaatacttacatttgaaattcaaaagagaatacttatttgcaaacagtgtttggatacagttccacatgcccttaggcatacttctgaaatccccagaagtctaagttgaacatataatattaatgtttgattataaaagtaagaaactgtcacaaatatcttgggagtatgaatatagtatttgttccattgtataaaggtgtatctaaatctgaacagtttttaaattctgaggcatatctggctgcaaagacatcctattgttttcctgtctctgatctgtagttctgtgaaaggtcacagtttggaggctgggatggaaattatgtccaggttatgtcaagaattttttaaggataaacaggaacattgcctgtcctgattctttctgttaagtctatggcctctggcacagtgtttaagttgggtgttcctgttaataaccctttgggctttattctttctctgaaatggaaaacctgctcttttttcagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataactgctgtgccagtggctcactaggaggaagagtgggtggccttctgggtcttctagtcacagatgtacagatctcatgtcagctgcccagtggctatgtcttaaccaatccttgattgcagcaaaatttgaaaatgatctatgaggacaaaggaaaattgtttgaataaagaaaaatattcactttttagaaaagtgaacatacatatatataattttaatactagaaaaggactttagtgatcgtgtttatttcacccaaagtggttgcatctcagtcaagttacagggcaaaggtctcagcctgtttctggagcatcttcgcccactgctggtgaaggccctgtggacactttgcagtcaaggtgggttaagaactagtgcattgccaaggctgtttgtttttgggtcctcaagggatgaggaataaacttcagggtttgaggctggggttcagaagtggtgctctggcctcagaaaataaaagacaagtgagaggctagaaatgacaatctgttgccctatttagagcaagctacctgaaaatacctgatttatttttttttaaatagaaaaacttcccacatcgcactagctaaacagcccatacttccatcacctgtgtgttttcagaagtctcttgttccaactgaaggaaatataaagaacagatgagaatgtccaatgaatagactccatatcacagaggagggtaaccaggtgtacaatggagtctcagcttacaaagcccccgggaggttctgtccaagtccatctcgattggaccacatgccttgctggactctcatgtgcccttcccgagtagttgctaaaatttcaaactttttgacctaaaatggcaaatgtggcatctgtgaaattctttgggtattgtaataaaagtcaccaggggtagcaagatttggggaggttcccaggctaaatccctcgtgcaggttggggcttagatttgataaactggaatttatatacaacacccactacatgctggtcatcaccactgtggaagagacagaccctgacctcaaggagctgaacagttagggagagtgaggttagcagggagggcttccaggaagaagttaaagcagatggctagagcagctagtcaataagggaagatgaagaggtgagcatcttagcagagactagcacatcagcaaccctgagaaaagaccctgtggttacagacccagtaaaagtcactgggtccaggtgttgggagatgaagctggtcaagaggtagattttcaggataaaggagccactgggagtgcagtgaacagactgttttggttctgttactgtaaaacaaaccacccagaaacccaatggctgggaaggaacatctttcacatgattctgcctggacttggctgtgtggttttcacgtggaggtctatatctgtgcttgagacatctgcaggtttgagtgaactggacatctgcaaaggctcactcacatggctggctgcagatgctggtgctggctggacgttcaacttgggctattgaccagagcacctgcccggggcctccccatggcttgggcttcccacagcattgatactgggggaaatacatatatagtgcaattcagtgttttaagtttgccaacttggaaggtgtatatatacagctttaaaccctgaatttcacaaatgttcatgattatctctttgttaataagttaataagaaaaataatttccaggagacttggtctcttttctccagtaatacagcttaaacattccataattcacatgtttaagattgttttatttacactttcaacaagtattcattgggcaccatttatgaggcagtgctgtgctgccaacacaaaagtgaagcaaatactcatgaccccttcctctgtagctcatgttcccattgaaaaat

SEQ ID NO: 15652 - DNA, 5623 bp, Human
tgggattacaggtgtgagccactgtgcccagactgaagttatctttgtagggtgcttctttcacatgggagatggaacatacagatccaatacagatgggattgttctatagagtaaaacgaacaagtgcataattaattcccatgtaagccattctctggtcaaaagtttgccaaaagtttctaccatttgatcctctatctctgaagtgaatacagaagcagtacaatgaggcagctattagcagaggaagggacctacatgggactcttgtagctcatgtggatatggaactgcagaagagagaggctgaggttgacgtaaaataagaccctgaaatccaaaggcaatcaacgagatagcattggttagagttcaaaacctcagagatccatatggctttcttggggaaaaactcatttatcttgacctaaggcagaaagtgagaaggaggcagtagccaccaagacagaagaaaacttaagcatttgaagagggaaattcaatgggctccaggtgccttccatgtaaacatttcagaaaaactcccagaagtttgatagagctcatgcgtgtcaatgaaactgtaaaatccagtcaagtcgccatcctggttggactctaatagggaagaaagagaaaggattagagccagagagaaggaagactgcttccaaaaataaatttcaagaatatcttagggtaaaaggatggacatcttcactggggactgaagatggggagcaaatagcacagagaagaaaggtttataaggtttaggagcagaaaaatttgatttggaattcccaatcctgttcctctttcagagggccacttctgatgctgtctgttgctgttgtgcaaacttgtttttcctgcaaagccattgaggcatcttcacatgccataatgtctgtactgtttaactcccgagataattattctcaaaggaagaagtcactgatggaaatccctgtagctctattggatagcaaataaattgcatttattccttctgaaagaattgttttaaagcagaattacataaagggactctataaagaacaaatataggttaaaacttgaatttttctcaatactctagaaagatgacgggctgtcagtatcctgcaaatgtcccatctcttcctaggacctatgaaatctctctctctctctctcaagccatctggtgtttgcattatactttcatgtgttttttcactcacaacatcaggtcgtcacccgcactctttcatgccagaaatttcatcccactgatgtttggcccaccccttcctctctttccttcacatatttcttgaagtatcaggatgttcctgaatatgaaaagcctttttcttcctgtcctttttcttatacagggcctctaagtatgaaatcaaccatcatacacaaatagtgtacatattttgtttgttcattcatgggtattagttgctgtttgtgtgaatggtttagatgttctctgtagaattattctcttctattttgttaacaatgcccactttcaattgtaacatattgcaaggtagaaaatatattctttaaccaggatttttaaaaaataggtataaaggaatgttccctgagagagagaaatattggtgctcatacatttatgtatatatacaaaaatgtactcatatttatatacacacatagaaatgtacatgaatgaacatatatatacatgtatatgtgaatatacacatgtatgtgtctatcataatatcatcctttgttttatatttttgcgtatatttcaaaacattttcaagatttttataccgtggtacccaaatataatttatttatgttcaaaacagtgtctacaccatcatgaataagctgtggctgaaaaccatttgataatgaagcaatggcgctgacaatgatattcactcattgcctggtttttttgttttttgttttttgttttgatgcttttaaaaactgctgtctagggtcggaactgcaacttgctccggagggcacgggctccgtagtcaccaactgcaaggccccctccccctgcgggcgctcccctggcacaattcgcgttcgagagtgacctgcactcgctgcttcaactggatgcacccatccccaatgcaccccctgctcgctggcagcgcaaagccaagaaagccacaggcccggccccctcacccatgcgggccgccaaccgatcccacagcgccagcaggactccgggccgaactcctggcaaatccagttccaaggttcagaccactcctagcaaacctggcggtgaccgctatatcccccatcgcagtgctgcccagatggaggttgccagcttcctcctgagcaaggagaaccagcctgaaaacagccagacgcccaccaagaaggaacatcagaaagcctggactttgaacctgaacggttttgatgtagaggaagccaagatccttcggctcagtggaaaaccacaaaatgcgccagagggttaccagaacagactgaaagtactctacagccaaaaggccactcctggctccagccggaagacctaccattacattccttccctgccagaccataacctggatgcccctgaaatccgaaatgactactacctgaatcttgtggactggagctctgggaatgtattggccgtggcgctggacaacagtgtgtacctgtggagcgcaagctctggtgacatcctgcagcttttgcaaatggagcagactgggaaatatgtatcctctgcggcctggatcaaagagggcaactacttggctgtgggcatcagcagtgctgaggtgcagctttgggatgtgcagcagcagaaacggcttcgaaatatgaccattcactctgcccgagtgggctccctaagctggaacagctatatcctatccagtggttcacattctggccacatccaccaccatgatgttcgggtagcagaacaccacgtggccacactgagtggccacagccaggaagtgtgtgggctgcgctgggtcccagatggacgacatttggccagtggtggcaataacttggtcaaagtgtggcctagtgctcttggagagggtggctgggttcctctgcagacattcacccttcaaggggctgtcaaggccgtagcatggtgtccctggaagtccaatgtcccggcaacaggagggggcaccagtgatcgacacatttgcatctggaacgtgtgctctggggcctgtctgagtgccgtggatgccctttcccaggtgtgctccaccctctggtctccccactacaaggagctcatctcaggccatggctttgcacagaaccagctggttatttggaagtacccaaccatggccaaggtggctgaactcaaaggtcacacatcccgggtcctgactctgaccatgagcccagatggggccacagtggcatctgcagcagcagatgagaccccgaggctatggcactgttttgagttggaccctgtgtggcggcgggagcgggagaaggccagtgcagccaaaagcagcttcatccaccaaggcatccgctgaagaccaacccctcgcctcagttgttttttatttttctaataaagtcatgtctcccttcaaaaaaaaaaaaaacaaaactgctgtgtaattacagaattgtattcaatcctgttttaataaataagagacaatttacaataactcacttgcagcaacgtgctttgaatcatttcagagaagaaggacagaagagattggttgacaccacagtgtgattaaaaaaataggagtcagtggtatttatgaaattaataaataaagcacatgcccacccccattaacccactgcatggtcaagttcttagggaggtgatgaggcaacctctccaatattcccattatagagctccactaacattctgcttggtgatgacaaagttgcatttagattggttgatagttggtattgagcccaaaaccagggttgaagttgttccagggagaggctggattgaggcacaatgtacagctaacgttaacctcctcctgacttgaccaccccagcagaagggccttgacacaaacccggtgtatctgctgagtgggcaaatacaaggagcgatccaggctgtagttgcatggcctgagcagcaatgcaaggaggaccttccttttgcctttaagcctcctcttccagagaaacttctaccagtgacctggcagtgagacttgtgtttcatgtagtgatgaatgttttagacctccagactcttgttctactgaagaacctccctccagggtcctgcgttgaactggccttgctgcagacttcctgagtttgtcagcagtaaaggtaacagtacccagaatggagcattctagccaatggttaaaagtcctggtattttctccacaaagtgatgataagaaagggggttgacccctcagtcatatcaaaaatgtttagaggtcactgggtagacatgaaagacaacctgttgaaaatttagatggaggtctggagtcatcatacaagcagaggaaaaagactgaaaagaaataatgtcagaatgttaatgatatggtgatgttagaggtgattttagtttttttctttgtgcttttcagtgtgaattctctaaaatgagcattttttaaacaagaaaaaaatgttaaaataggcaccaaaaacctgaatacaataaaatacttttaaataagttcacactcatatctagaaactctaagcaaatctaggttgccaacagtcacaaaaggtaattctatttaggttaaaaatgtgagctacgactatctccctttcagatattcacagaatagaatagcaggactaaattgtgtgcatggctgaggaaacatagctttttgttttctctgtgtcaggtggtttctctctctttaaccaagattacatttccagagtatctacttctccatttctcctgccttttatttttccgtggttgcaatctcctgtaattatgagaaaaaagttttttcctggagcagcatctctgagattagccactttggagccaacctgacaattcccagttggtgctaataatcttctctgtagaaacataagttttcaggacattcagctctgctctgagacttaaaacagctggaaaatgcatgacttgagtttttagatctgacagcatttgaatccactgtcaaatagtacttaatacctgttaatctttttgtagtttattttcttgtgcttagatatttgctacagtaattaaaagcagttatgaattcctgaaatataattccaaatacctagttctaatgagtcaatccagtacttggataaacaaataccaaagttcaggagagggtaaaagttgggagttgtctttatttttgaaccacactatctttaaattgcacactattgtccttaaattgtatgaattcaacctggaaggataaaccattcctcaaattaaggtcttttgcactttggtgatacatctttatttatgaaaacctgacatctccatttcattacatttttagcactaatctgtgcttcttgctagatatttaacaaatgaagtttttattaatatattagtccgttctca

SEQ ID NO: 15653 - DNA, 6828 bp, Human; identical to SEQ ID NO: 12035
  misc_feature (1)...(6828): n = A,T,C or G

SEQ ID NO: 15654 - DNA, 194889 bp, Human
  misc_feature (1)...(194889): n = A,T,C or G
gacctaaattaggaggaaatcctaagttagacaaagctagactcccctgaagtcaggtggcccctatttctgggcttggcaggcagtgctggggctggacaccgaagcagatcgcgagtgggctttgccttatttccaagaacgaggtgatgagaccggggctcccagaggccagcgataactgcagccgttgctctcgtaggtgaagatcccggatctgttttgtggcctagagattgtccccgcgttgctccacggggatctctggtcgggaaacgtggctgaggacgacgtggggcccattatttacgacccggcttccttctatggccattccgagtttgaactggcaatcgccttgatgtttggggggttccccagatccttcttcaccgcctaccaccggaagatccccaaggctccgggcttcgaccagcggctgctgctctaccagctgtttaactacctgaaccactggaaccacttcgggcgggagtacaggagcccttccttgggcaccatgcgaaggctgctcaagtagcggcccctgccctcccttcccctgtccccgtccccgtctccgtctccccgtccctgtccccccgtcccccgtccctgtgcccccgtccctgtccccctgttcccgtctccccgtccctccgtctccatccccccgtccccccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccccgcccccgccccgccccccggcgtgttgtggctccgccccgctgtctccggccccaccgcaagccctgcccctcccacccacgcgtgcccgggccccgcccccgttgcgcgcagccccgccccctatcgcgtgctcaagccccgccctggcggcccccggccccatcccgaagccccgcccccccgcacaccgcctgctcaggctccgccccgctgtcctccggcggcggcctcaccccgcagcccggcccaccgcgtctcaggccccacctcctgtcctgccccgcccaccgcgtgctcaggccccgctgagcggtcccggctccgctcgcgccctgtggggtccacggcgcgctcttccagagcctttgggacccgtgcccgctcgcgtcctcaagtgcacgcgccgtcccgcgcgcggtattttggcggccgacgcgttccgtagcgaggccggcgagtggggtcggaggtcgcggggcggggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccgcctgcgggaggtgcacggcggcggcgcggagcgcgaggtggccctggagcggttccgcggtgcgtgggcggcgccgcgtgcccgcttcctcccccggcccgggttcggcgcgctgagtgcactttaccgggcggggaccgcagcccggcggcgccggccgctctgcgagggctgccggtgcgcggtcccgcgggccgtggtggggcgcggccttcctaggcgggagagggccaccccggcgcggcgttaggtgcacggggcagacgcgcgcctcccttggggggaccgtggcccgcggagcgcctgctctcgcacggggtgaagcctctgcggcctccccgggaggcggggtgcagaagccctccgtcccccgtctccgtcactggaggaggtccctgggctggggagactcgggccagatccctccggacagctggtcagccctgcagtgtggactcccaggcttgcctccaccgagcgcggtttctgtgaatgttgtgtggacagggagatagggaatgagagagggggacgcagggaacaaacctgctgcaaacaaagcgcgcctcgggtggggagggcagcagcctgtccgttccgtggacgccgtggacagagcgggctggccgggtccgtgcctctgcaggcggggtggggtgtaggtacccctgtggaggccattcgatgagtctaaattctccgagttcagacccacctttaccgctgtctataatgggttatttccaaacaagtccttaggagctcatagctaagtagttacatggggttttgtaattcagtaaaatcatctttgtagaccctttgagtaagaagaacttttgcattatttggccttcctcattttagaatgacagcgctttgattttaggagtcaggcagggtggggggccttgtgggaggagtgcgggttcggcgtcagatcctcctgcctgtgaattctggccctgtcgcttggacctgatacttgattgcctgtttcttcgggtgtaagctggggcggataacgatgcctctcgtgcagaactgttctgagggtgagggaccctcatccagggaccagtgaagccagattttttgttcctggtgtaacagcccaatggcttcttccttttttttttttttttttttttttgatacgaagtcttgctctgttgcccaggctggagtgcagtgcagtggtgcgatcttggctcactgcaacctcaacctctcaggttcaagctattctcctgtcttagcctcccgagtagctggggctacaggcgcgcgccaccacgcccggctaattttgtatttttagtagagggggtttcaccatgttggtcaggctggtctcaaactcctgacctcaagtggtcgcccgactcagcctcccaaagtgttgagattacaggtgtgagccactgcgctcggccccagtgggttctttctgcgggctgcccagatagagttgatttgtcagggcaggggagttgccatggagaagatttagttcacgcagagccggttgaaagggagactagactagaggtttttttttttttttttgaggcggagtctcactttgtcccccagggtggagtgcagtgatgagatctcagctcactgcaacctccacaacctccacctcccaggttcaagtgattctcctgcctcagcctcccgagtagctgggactacaggtgcgcgccaccacgcccacctaatttttcgtattattagtagtgacgggtttcatcgtgttagccaggatggtctcgatctcctgacctcgtgatccacccgcctcagcctcccaaagtgagccaccacgcccggctggagttttattattactcagatcagtctccctgagaatttgagggccagggttttttagaggtaatctgggggaaagggtgggggtggctgattggttaggggtatacaatcataggggagtcggaaatgatcctccgtgatgtgctgaatcgcgtctgcgtggggccccaggagcagtgggcgggtccaggtggagctatcatgggtccgtggatcctagtgtaggtgtcagacatggaaacaatctgaaaagatatctttaaaggccagtctcaggttctgcaatagtgacatggtctgcaggagtaactggggaactcgcatgtcttgtgatctcaagaataatggctggcaattaggttacgccttagcggaattcaggctcctctcctcctcctagcctggtggcctctcattaactttacaaaggcagttgagttttggggaagggctcttagcatttaaactataaattaaatgtctcccagaggtagcttggcagcttgaagactaaaggcatgagggggttgcctggatcagatctgccccattgccataatttcctcacagatcacttttgcaaaggcagttttgctgggaagcagtgggtgtgttcagatgtggaggtgggagctgccggattggacagaagcagtttcagctgctgagaggaggagaaagcggtggttcagggtctgggaggttgtgaagagctggcagctgtgtggaagggagcagtgcctggatatgtcaaccaaaaagtatctgagacgagtctcaatcagtttagaaggttaagggtgtgcccgtgaggcagcctcaggaggtcacatgtccccaaggaagtcgggctacagcttagttttacacgttttagggagacgtgagacatcaatcaatacctgtaagatgtacattggtctcgtcagggaaggcgggacatcttgggtgggagggcgtccagggcattggtggattcaaatatttcacgattggtgattggttgaaagagtttatctgaagacctggaatccatagaagggattgtctaggttaagataaattgtggagaccaaggtttttcttatgcagatgaaggttccagttagctggtttcagagagaatagattgtaaatgcttttcatcagactaaaaaggtaccagacttagttaattttctcttggatcagggaaaagacctagaaaaggaagggattctctacagaatgtagcttttcccagcaagagacaacttagcagaaccatttcaaaatatgtcaaatatattttagggaaaaatattttgatttctttcagggcctgctgtctgtcatgtgatgctgtactagagtcaggctggaatttggtgtcttattgctacttaagatcggttttaatgctaatactgatcagctgtgcctgaattccaacgagaggagggtataatgaggcctatgtggaccactccccacaatcccttaatatcatgaggcctgaactagtttttcaggttaagtttggaatgcccttggccaagaggaggggtctgttagatggctagggggcttagaattttgtttttagtttacaggcatgtttggcaggggagtgtgagaggagtgccagggatgtgtgtctcacaaggacagagttgagcttggcccttaacggctggcagaggcaggagagagtgaaggaaggaagaggcgaggaggagactctgttaggaagagtatcgaggcagtgggaaaagaggaacagtgtgccaagcaagtaaactgcacgaggctgggccacagtggccctcaaaaggctagagggaggtggggcattccctccaggtggcctgtgtggcctcctttagtgagaggggaggtgtgctcttgagagctggggaagaggtggagctgccctgtggaagctagcaagggaaaatggggtttctgaggctcatgggtatgtttggcctagtgataattaattttcatgttatatttgtttttagtaataatggacaaataccaggagcagcctcatctgttggacccgcaccttggtaagaatagaagctgctgattttgatcattcagttacagatgaccacggaggccttggtgtgtggtgctggcacatgcatgtgctttgccaggatcaaatgccaagaagtgtccctgtcttgcttgcctggctggttggttttagccgacctgtgatagtggcttgagttccagatgtcactctaggctggggggagatgtgtctgagctacttaattcctttctgctaaggaaacaacatctgctcctcatgtgttttttttgtttttttttcttttttttgagacggagtctcgctctgtctccaggctagagtgctgtggcgcgatctcagctcactgcatcctccagctccctggttcaagggattctcctgcctctgcctcccgagtagctgggattacaggcatgcgccaccatgcccagctaatttttgtatttttagtagagacggggtttcactatgttggccaggatggtcttgatctcctgacctcgtgatccgcctgcctcggcctcccaaagtgctgggattacaggcgtgagccaccgcgcctggcctcctcaagtgtttttagtttacattagtttattattttagtttacatttgggcacatgatgtttttctggtaatagtcatacagggtcaggtgttttacatgggtcatcatttaatcctcacagcagctaaggagggcatctgttgtcatctccagtttacagatggggacactgaggctcggttttcttactttagtgtaaggggtgtggtttcttattgttttctttatttttgatgtatttcacactgattaaaatttttctttttctacctacaaatgtgacacatgcttctggcagttcacctgggaaagaggaaggtggcaatagtcaccacgttgagagggagcaccctgggtgggggcaccctggcttcatagcccagtttcaccattcagtttttgagctgctctttgccggggtttcctcgccccccgtggtgttgagatctgtgtgagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccagttacttgggaggctgaggcaggagaatggcgtgaacccgggaggcggagcttgcagtgagctgagatcacgtcactgcactccagcctgggtgacagagtgagacttcatctcaaaaaaaaaaaaaaaccaaaaaaaaccctctaaattcgggattcaagaattcattgggatcagacttgtccttctgtcctagaaaaatttataggccttgtgaaggagaccaaagatagaggtccttgggagagggtcagctgcagggaacatgactctgacatctggtggaggggctagccatgctggatggcgtggcaggcactgggctccccaggccatatcttataggaggtcttgggttcctggagttcctgtgtgtgagcgctggttcccaggaaacagatgtggtcactgctcacaaggtagcgggtggtgtttttatatctcttcaagtaacaacgttggacctgtagttaaatgcctttattcttgccagacctctttccagagtggatcatggaatattaacacttgttgtgagctgcttagagtactgcgaatgatttttagagttattttctttctttgcaaaaactgtttttcgccgggtgtggtggcttatgcctgtaatcccagcactttgggaggccggggcgggtggatcacctgaggtcaggagtttgagaccagcctgaccaacatagtgaaaccccgtatctactaaaaatgcaaaaattagccgcgtgtggtgcacgcctgtaatcccagctacttggggctgaagcaggagaattgcccgaacccaggaggcagaggttgcagtgagccaagatcgtgccattgtactccagcctgggcaacaagaacgaaaacgtctcgggaaaaaaaaaaaaaaaaaaaaaaaaataaataaataaatttttttttttgtagagaaggggtcttgccgtgttgcccaggctggtctcatacctctgggttcaagcggttcacccaccttggcctcctaaagtgctgggatttcaggtgtgagccagcgtgcccagctgagttcattattttctggaattcctttttagaaaaaggaaaatgtagtcgtgggatgctggtcctttgtcatttgttgcacatttttccacccttttgcttttttttttttcttttttttttttttttttgagatgtagtctctctgttgcccaggctggagtatagtggcccaatcttggctcactgcaacttctgcctccagggttcaagcgattctcctgcctcagcctccagcgtagctgggattacaggcgtgtgctaccacgcctggctaattttttgcatttttagtagagacagggtttcaccatgttggccaggctggtctcaaactcctgacccccacgtgatctgcccaccttggtctcccaaaagtgctgggattacaggtgtgagccattgtgcccggcctgcttttgccttttaatattgtgtctggtgtattttatctactgaagttttttcgtgtttgtttttttaaagagatgggatctcgctctgtcacccaggctggagtgtagtggcgcagtcatagctcactgcagccttgagctcctgggattaagtgatcttctcacttcagcctcctgcagagctgggacaacaggcacaagctgccatgcctagttaattaaaaaacttttttttttggccaggcgcagtagctcatgcctctgatcctagcactttgggaggccgaggcgggtggattacaaggtcaggagttcaagaccagcctgaccaacatggtgaaaccctgtctctactaaaaatacaaaaattagctgggcatggtgaagcatgcctgtaatcccagctacttgagaggccgaggcaggagaattgcttgaactgggacccaggacgcggaggtagcagtgaacgagatcgtgccactgcactccagcgtgggctacagagccagactgtctcaaaaaaaaaaaaattttgtttttgcagggtcagggtcacgctgtgttcctcaggctggtctcgaacttctggccccaagcaatcctgccttggcctcccacagtgctgggatgacaggtgtgagccactgcacccagtctctactgaagttttagaaatatttagcttgtcaaactatcagtttctttgtgtttggcctttggtagtacggttagaaagtttatttttcctaatcagttatgtaagcctcatttattggatgatttagtggcctctcccctacttgaaatgccattttaaatctatattaaatattcaaatatattagcctttgcttttagattttttatcctgttccattgacctatctgtatgctcttttttctgggtcatttcgtttgtttgttttttttttttttttgagatggagtctcgctctgtcacccaggctggagtgcagtggcgtgttcttggcttactgcaacctccgcctcccaggttcaagagattctcctgcctcagcctcccgagtagcatgtgccaccacgcctggctaatttttgtatttttagtagagaacggttttcatcatgttggccaggatagtctcgaactcctgacctcaagcagtctgcccgccttggcctcccaaagtgctggaattagaggcgtgagccaccacgcctggcctgggtcattttgtttgatgttagtttatattttgcctggcatcctttcctcttattttcttgatggttttgtagcccgttcattaatgcggatgaactccggaattattttatcactctccaccctttggaattctattaaattcacaaattcatgtaggggagaagtctttctaagatttaattttcatgtctaagatcatggtattatgtctctaattattcacatcttttgtgttcctcagtgaaggttggtgattttctttagatgattcctggagacttttttttaggtttatttctaggtatgttttgtcttttattgctcttgtgaaactctttgttatgtgttctaactagttattgctgatgtctagtgaagatatgttttgtatactgtttttgtaaatggcaacactgtaatggaatatgtatgtgtaaacatacatttcttaacatctttatagggatataattacatactatagagttcactcttctaaatatacattttagtgttagtgtattagtgtattacagagttgtgtaactatcactaccacaatctaggcattttcatcatctgaagcaacccaactcccatcaacaattccttcccattctctgcttccgcagtaaccactcatctggctctgggtttgtgtgtattcagcattttgtgtgatggaatcatgcagtaggaggtcttttggcactggcttttttcacttagcatcatgtctatgaggttcactgtgtgatgaaatgtttacttcaatagtttttcagtctttttttttttttggagacaaagtcttgctctgtcacccaggctggagtgtaatggcgtgatcttggctcactgcaacctccttctcctgggttcaagcgattctcctgcctcagcctcctgagtagctgggattacaggcgccacctgtaaaattagcctggccaatttttgtattctgagtagagacagggtttcaccatgatggccaggcttgtcttgaactcctgacctcaggtgatccacctgcctcggcctcccaaagtgctgggattacaggcgtgagccaccgtgcccggccagttgtttcttctgggttttcttagcaggtaaatattatatggtttgtaaataatgctactctttatccacgattataaatttttattcttagaacattttattgagttttaattttattgagtttaaaatttacctactataaaatgcacccattttagtaagatgtttgagtttcggtaaatgtatacaccccgcgctatcaagatatggaacatttctgtcatcccaaggagttacttgatgtccttttgctgtcagtcccctcaccccagccctagggaaccactgttggttaatggtactgttcattagttttgcctgttctagaatcattcagtatgtgctctttttgtcttccgttgttaaaataacatctccgggacttaccattgttggtgtgtgtatcagtagtttgtacgttttctctcgtgctgataaatcacaatttgtttcttcttcttttttttttttgagatggagtcttggtctgttgcccaggctggagtgcggtggagtgcagtggtgcgatctcggctcactgcaagctctgccacccgggttcacgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcttctttttctgttgatggacatttgagttgtttccggtttttggctgttattaataatgctactttttgggaggctgaggtgggcagatcatgaggtcaggagtattgagactatcctggctaacacggtgaaaccccatctctactaaaaatacaaaaaattagcccagtgtggcggtgtgcgcatgtagtcccagctacttgggaggctgaggcaggaaaattgcttgaacccgggaggtggaggttgcagtgagccgagatcttgccactgcactccagcctgggtgacagagcgagactccgtctcaaaaaaaaaaaaaaaaaaaagtaatgctactgtgaaaatgtttatgtacaagtttttaggtagacagaggttttattttctcttgggaaaatacgcatgtgtggaattgctgagtagcagaaagtgtcttacttgtagaaagtgtatgacttggccaggcgcggtggctcctacctgtaattctagcactttgggagactgaggcaggtggattgcctgagctcaggagctcaagaccagcctgggcaacatggtaaaaccccatctctactaaaatacaaaaaattagccgggtgtggtggcaggtgcctgtagtcccagctactcaggaggctgaggcacgagaattacttgaatgtgggaggcagaggttgcagtaagctgagatgacaccactgcactccagcctgggtcacagagtgagactctgtctccaaaaaaaaaaaaagtgtgtgactcatcacctgccatactgatgccatgaagattgtactgttgaccatttctaccaacaaggtatgaggattccagctgctctgggttctcttcagcactcagcgttgccagtctctctgatttcagggagtgtatctcgttgtgtccttctctgcgtttcccggatgccagttgcagttgttttccatgtatgaagacttgcagcccagcgtatggtctgttttgttgaacattccacgtgcacttgagaaaaatgtctgttctgttgttgggtagattgttctctaaatgtcacgtaagtaaggtgggtgatagtgctgtttaggtttcagcgattttctcttacttgttctgtcagttcctgaaacaggagtgtcgaagttttcaaccgtgtctcctttcatttctctcagcttcttctgtgcttattttgaagctctgtaggttggtgtgtatacttacagaattgttaagtcttcatgatgaattgatccttttattatcatgaaacattctgtttatctctgatggtaatgcttgttctgacatttactttgtctgatattaacagagccactccagctcttttatgatttgtgattggttggaatatctttttccttttgcttacgtttaacctagctatgtctttttgtttgtttttgttttttaagagacagggttttgggccaggtgcggtgggctcacacctgtaatcccatcactttgggaggccgaggtgggtggatcacctgaggtcaggagttcgagaccagcctggccaacatggtgaaaccccgtctctactaaaaatacaaaaattagccaggcgtggtgacgcgtgcctgtaattccagctacttgggaatctgagggaggagaatagcctgaacccgggaggtggaggttgcagtgagctgagatcacgccactgcactccagcctgggggacagagcaagactctgtctcaaaaaaaaagaaaaaaaagagacgggttttgctctgttgcccaggctggagtgcaatagtaggatcatagctcattgccgccttgaaattctggcttcaaatgatcctcccaccttggtctcccaaagtgctgggaaaacaggcatgagccaccacacctggccggcctcaatgtcatgttgatgttcacttttacagtaaatgtttcctatgtttttccctagaatggatgatgaacttgttgttggacatagtgcaagatcagacatctccagcttcccttgtacatctggcttttaaatttctttacatcatctccaaggtaacatttccatagcacttcagagttgacagatacttttgtaatatacttggtccagaggttaccctccaaaatgttatttctcaagaaagatagttcttagacacaagttgtgggtttaattctgtccctttttactgtatgttggggatcagaatttagtgatgtgggctctttggctgaaacagtgtcaggatattcagcatcttgcatttgaatagattgaagcactgtgtagctaggaagggaatggggtggagatgagactaaatcagaaaaacttcttacaaggagaaagcaggccgggtgcggtggctcatgcctgtaatcccagcactttgggaggctgaggcaggtggatcacctgtggtcaggagttcgagatgagcctggccaacatggtgaaaccccgtctctactaaaaatacaaaaattagctgggcttggtggcacatgactgtaatcccagctgcttgggaggctgaggcgggagaatggcttgaacctgagaggcagaggttgcagtgagccgagatcatgctgttgcactccagcctgagtgacagagcgagactctgtggaaatggaagtgcttctcacactttaatgtgcagatgaatttcctgggaattttgctgtgctatagattttgagcaagtaggtctaggcgggggtctcatagtctgcttttcttacaagcttgcgggtgtctgtgctcatagtctgcttttcttacaagcttgcgggtgtctgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgctcatagtctgcttttcttacaagcttgcgggtgtctgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgctcatagtctgcttttcttacaagcttgcgggtgtctgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctcatagtctgcttttcttacaagcttgcgggtgtctgctcatagtctgcttttcttacaagcttgcgggtgtctgtgtgctcatagtctgcttttcttacaagcttgcgggtgtctgtgtgctcatagtctgcttttcttacaagcttgcgggtgtctgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgctcatagtctgcttttcttacaagcttgcgggtgtctgtgctcatagtctgcttttcttacaagcttgcgggtgtctgtgtgctcatagtctgcttttcttacaagcttgcgggtgtctgtgtgctcatagtctgcttttcttacaagcttgcgggtgtctgtgtgctggcccagaggctcactgttggcagttttgactatggaagtactcacagccgtctcagggtggggcttggggttcgtagtggcgaggcgcatttctgttgtctggcgggaaagtccttggccggcgagaggacactgcgggtgggctgccaaggacacgcaggcctctgtagctccgctgtgtgaggttaggatttctccggaaggcgtggtatcactgagcttcagggaagtgttaatgaatttgggcccttgcggtttgtaggcacttattcctcataaatgtcagaggacagtcatataaatgaacatatttaatgactgattccgtaaatatggtaatgaataacactaccaatttaggaaggaaatctttttttttgagagatggggtcttgctctgtcactcaggctagagtgcagtgatgcagtcagctcactgcagcctcgaactcttggtctcaaatgattctccctcctgcctcatcctctcagactacaggcatgtgccaccatcctgtctaatttttaattttttatgttgcccaggctagtctccaactcttggtctcaagctattcttttgcctcggcctcccaaagtgctgggattacgggtgtgagccatcgctcttggccatgggtagctttcttggggtgactacggtcttactaaattgtgtcactgtaatgtcacagaattctctttgatcagtgggtcgcgtagctggtgatttttgatgaaagggtagaaaggcaattttgctgctctctgtatttttaaatgttataattcagcatctctttatttgataggttcgaggctataaaacatttcttcgtttatttcctcatgaagttgccgatgtagagcctgttttagatttggtcacaattcagaatcccaaggaccatgaagtgagtgtctctgcctcccccctcgtctccagccctccgtgcctgtccttcctccctgcttgccccaccctgctgcaccttccccttcctgtttctttcattttatctccctttgttttgtgtcactcctcttttctttcttttcttttcacttttcctttacttcttgtacaagttgctttaaattattttcgtttaaaatagcccctttataaaaaaaattatgcctaggtgtagtttaacaataaatccgtcattgtttctatgtttttttaactgtgtaagtataactgtgttgggttcccaagaccacccccaggtttgatacttcctgagcgggactcacagcactcagcatagagtcctccttttggctgtcacttgttatggcaaaataatacacagcaaaatcagcaaagggaaaaggcacatgggtggggtctggggagaaccaggcgggagctcccggggtcctccagttgggtcccacagggcctgtgtcattcccccagcagtgagatgtgaccacacctgtgaggtgtctatcagagaagcacgtttgagacttggtgcccagagctttcactggggtctggccacatggacacctctgcctggcacgaaacgaaattccagacccccagcaggaaagcaggtgccagcgtaaagcacacggtttgtgcagattgagccagcgagggacctcatcaggcagggcttggtgggaaccctgctggtgtccaggtccctggataccagcccagggccggcctcgtcaggggccttgcctcagacggcagcggggcctgctatgctcgctgtcttctgcgtggtatgtatttggaggagcacacggtttataaccgtgcagtgcggtggcttgtctcggcgtggatgtgactgatgagcgctgtggggcatttccctgctgccctgcactccgtgcccttctttccctagtacttctagcgccccccagtggaatgattgcagggacaaattgggatgttttttactaattactgaaaataagggtactccttttttattagaagttgataattgttttctttattcttttttttttaaaaagacagagtttcactcttcttgcccaggttggagagcaatggcacaatcttggctcactgcaacctctgtctcccaggttcaagcgattctcctgtgtcagcctcctgagtagctgggattacaggcatgtgtcatcacgccagggtaattttgtatttttagtagaaacagggtttctccatgttggtcaggctggtttaggactcttgacctcggccaggcacggtggctcgtgcctgtaatcccagcagtttgggaggccaaggtgggcggatcacgaggtcaggagatcgagaccatcctggctaacacggtgcaaccctgtgtctacaaaaaatacaaaaattagcctagcatggtggcaaacgcctgtagtcccagctactcagaaggctgaggcaggagaatggcgtgaacccggaaggtggagcttgcagtgagcgaggttgcgccactgcactccagcctgggcaacagagcgagactccatctcaaaaaaaaaaaaaggaactcctgacctcaggtgatccgctcgtctcggcctcccaaagtgttgggattacaggtgtgaaccaccacacctggccttttttctttattcttaggtgtttttactttttatctgtttttcactttttcaaaaggccagtttgtatgtggagaggtgccagcgaagagaagctgctatactgatgtattatgatttttctttgttcattttgatgtctctcttgtctgctgagctaagttacggcggtaggtgtgtgtggtggggattccgggggggatgtggcgaggagttggtgaacggcttgcatttctggccctgagggtgatggcatttgaatggctttcataggcattgggtgggcatggagggcagtgactttgagtagattgtggccagtggcctgtgattttcaagcaagactcattcttcccgtggtttaattttttaggcttgggaaacccgctacatgcttttgctctggctctccgtgacctgcctgatcccttttgatttttctcgccttgacgggaacctcctcacccagcctgggcaagcacgaatgtccataatggaccgtattctccaaatagcagaggtaaatatcatgcagataattagctgctaattagtactcactttcatgttcatgctgtcttgatgttagtggtttactcggtaagcttctgatatgtattcaactgctgtttttttcagtggggtaaaatcccataggataacttattttgaaattgtgataattcatgtaggggtcaggttgagttagcaaatctcatttctttgtagatgatgcaaatactctgttgagggtaatcatggcagataaggaagggtttagtggcatggtgagagagaataaggacccattttacatttagttcttaacgttatataaataatagatgctcatttgtaggagaactagaaaataaagataagcaagaaaaatactaaatttaaatttatgaaattctagtgccaagagataagttgtttattttctccgaacttttcctgatgtaaatattatgcatataaacacagcttattgtattagttatctattggatcataactaattaccccaaacttgagtgtttgacacacatttatcctcttgtagtttctgtgggtcgggagtctggcatggctgagctgggtcctttgtgtcaagcttgcccacagctgcagttaaaactcgacatgggcaggctttgccccaaggccgttggattgaggccaccctcagttctttgccacctgggcccctccaacttagtgacttattccatcaaagcctgcaagggagaaactctgctaatgagatggaagtcatgataatatgttacctgatcatggaagtgacgtcccattcctctgccagatcctgtggttagcagcaagtcaccgagtccagcctacgcaagcgagcactaggaggctgtcaggctctgagccatctcagttgtctcggtcttcctgccacgctgactgcgacagccctggtcagcattcactgagtgcctgctgtgtgcctggcaccgttcaaacactcatagattaatctttaatcacttatggattaataatttaacctatacattgggctgggcatggtgggtcactcctgtaatcccagcactttgggaggccggggcgggcagatcacgtgaggttaggacttcgagaccagcctggccaacatggtgaaaccctgtgtctactaaaaatacaaaaattagctgggcctggtgacacatacctgtaatcccagctactcaagaggctgaggcagaagaatcccttgaacctgggaggtggagattgtagtgaactgagattacgccactgcactccagcctgggtgacagagcgagagtccatctcaaaaaaaaaaaaaaaaaatttaacctatacgttgatgattgatagatcatcagtgattaattaactgtgattaataatcattgaattctccttcatgaggctgttgacaattcttaccctcgtttaaccgagaaggcaacaggcataaaaattaataacttagtttactttgctcataaatggtggatccatgtttgaatccaggcggtttatctggagtctgtgctcttcatcagggctcagcattgccccatgacctgctgttctgagtcctttttaccctcagcaacacgttcttagtgtcttacgatgtcagaaggtgtccccctcataatcgttaagggaaaaggtactccattgtaatctaatttaaaattctctctgatagatggatgttttgtttgttcttgttttgttacgttagaggtagtgtggtgatgggctgggtgcggtggctcacgcctgtaatcccagcactctgggaggccaaggtgggcatatcacctgaggtcaggaattcgagaccagcctgaccaacatggagaaaccttgtctctactaaaaatacaacattagctgggcgtggtggcacgtgcctgtagtcccagctactcaggaggctgaggcagaagaatcgcttgaacctgggaggcggaggttgtggtgagccgatatcacgccattgcactccaccctgggcaacaagagtgaaactccgtctcaaaaaaaaaaaaaaaaagtagtatggtttacccacccttgtttacttgtctgtggagagggactgccaggtcaagggagcatggtttgtcaagacttggcactctgtgattgccgttagaaagcctgccccggaggccgggcacggtggctcacacctgtaatcccagcactttgggaggccgaggcaggtggatcacgaggtcaggagtttaagaccagcctggacaagatggtgaaaccccatctctactaaaaatacaaaaattagccgggaatggtggctagtgcctgtgatcctttcatatttattcaactgttctcttacaaatgaacagctacttgggaggctgaggcagagaattgcttgaacccgggaagcagaggttgcagtgagccaagattgcaccactgcactctagcctgggcagcagagcaagactccgtctcaaaaaaaaaaaaaaaaaaaaagcctgccccagaaaaaaagatcttctaagtgtatcgttatgggaaaaaacaaacaaacaaacaaaaaaaaccgagacaagcattggaaacattttaaggcagccctccgaaaaataaatctagctgggcgtggaggtttcatgcctgtaattccagcactttgggaggccagggtgggaggatagcttgagcccaggagtttgagagcagcctagacaatataatgtgactcagtctctaccaaaaaataaaagaaaattagccaggtgtggtggtacacacctttggtcccagctattctggaggctgaggtgggagggtcatctgagactggggaggttggtgctgcagtgagtttttttttttttgannnnnnnnnnnnnnnnnnnntagtggtctaatctcaactcactgcagcctctgcctttgaggctcaagcaatcctcccacctcagcctcctgagtagctgggattacaggcatgtgccatcatgcctggccaatttttgtgtcattagtagagatggggttttaccatattgaccaggctggtctcaaactcctgacctcaggtgatccgcctgccccagcctctcaaagtgctgggattacaggcgtgagccgcagtgcccagcctacagtgagctttgctcacaccactgtactccagcctgggtgacagagcgagacccggtctcaaaacaacagcaaaaaaaccctaagaccagctactggggaggctgaggcaggagaatggcgtgaacctgggaggcggagcttgcagtgagccgagatcgcgccacggccctccagcctgggcgacagagcaagactccgtctcaaaaaaaaaaacaaaaacaaaaacaaaaaatatatacacctactatgtaccccaaaaattaaacactaaaaattaaaaataactaggtatttgtagtaaatctaggtgctcttcagtttgaacagggcctcttatctagtctgaatactccaatactgatggttcccttgtgctggaaggcatattaggtgctcaatgaatactcttgattctttgttacaattgggtaactcctttgtttacattctcctgctctgttcttgcaaatgtgtgtttcaagggggtgtgaccaaatgctctgtgtagctcaggcacttcctgggtgagtgtagcagttggcagctgtagcccttggctcagattgaagagaggtttttttttgcagctttggacttaggcctgtgctggtaaggtttgtgaacctgggccctcggggagctggtgagggtgggactggtgactgtgtggtgtccccaaggctggcgtgtgcaggagtgaccgtgtctgtgcttcaccctttcttgcagtcctacttgattgtcagtgacaaggcccgagatgcagctgctgtccttgtgtccaggtaagtttccatggcacatttcttggtgtgtggctggtgggttctgagaggggtttgtttgggtacgtgtttcatgtgcgtcttcagtcctcagacgaaggaccccgggaagtctttggactctgtggctttctctgagggagcgtgcagcagtgtttgggcacagaagacctctgaccctgaaatgaccaccctcagtggtggtttggggtgctggtgggggtcacctgacaggcccatcgacaggagtgcaggtctggaagaggcgtggctgtcatccctggggtgcagcccctgcacagggatggggtggcagttatgagaaacatctcgggccgtctcccatggagatgatgggtggtgttgggcctctgtgactggggatgaaaatcccccaacgtcctgtattaactgcaccccccgtgtgccccagacaggggaaggtggttttctctgctgagcgcagcaggcctgcggtgttggaaagataccaaggatgtgtgtatagactgagcgaacctgtttcatgagatgcaagaaggaagaaagcaatatttctaatcagtattttacatgacatgtgattttaagtatgtatgtagtttactaagtcagaacagttgacattttccccctctgcaatagtgaaagtcgaaagctggtcctaaaacctttcggtggttgtggttgggaatacggtcagtgcctcatgcagcgtcaccttcactcgggtgtgtagctgcaacttgcacagcttctttcccagagaagtgggaggagagaagcttcctttgtggggcagttggaggcattggatgaggggtttgtgacagcctggagctgaggaaggaacgcctgagtcccctggagcaggtgaggcccctcccgagagggcagaggctgcttcctgtcttgtcaaggacataaaaagatgatcgtctaattattaaagtaatctgtatatatttagataatagagcatgaagtacaaaataaaacctttgaatgctttcatcccatgggggtgtgatggcccctgtctccctaccgggtggcgccaactctgtccatggtctccccgcggggcggcaccaactctgtccatggctcagttgctgcactcaattctttgcaccacggaccaggagatgggcctggtgcgccattgtcttcttccaaaacgagatgacctggtgcgagagtgtcttttctttttctttcttttttttttttaattgagatggagtctcactttgtctcccaggctggagtgcagtggcacgatctcggctcactgcaagctctgcctcccggtttcacaccattctcctgcctcagcctcccgagtagctgggactacaggtgcccgccaccatgctcagctaatttttttttgtattttcagtagagatggggtttcactgtgttagccaggatggtctccatctcctgacctcatgatccgcccacctcggcctcccaaagtgctgagattacaggtgtgagccaccgcgcctggcccgagtgtgtctttttttttttttttttaatttttttagtatttattgatcattcttgggtgtttctcagagagggggatttggcagggtcataggacaatagtggagggaaggtcgcagataaacatgtgaacaaaggtctctggttttcctaggcagaggaccctgcggccttccgcagtgtttttgtccctgggtacttgagatcagggagtggtgatgactcttaaggagcatgctgccttcaagcatctgtttaacaaagcacatcttgcaccgcccttaatccatttacccctgagtggacacagcacatgtttcagagagcacggagttgggggtaaggttatagattaacagcatcccaaggcagaagaatttttcttagtacagaacaaaatcgagtctcctatgtctacttctttctacacagacacagtaacaaactgatgtctctttcttttccccacatttcccccttttctattcgacaaaaccgccatcgtcatcatggcccgttctcaatgagctgttgggtacacctcccagacggggtggcagccgggcagaggggctcctcacttcccagacttggcggccgggcagaggcgccccccacctcccagacggagcggcggccgggcgggggctgccccccacccgagtgtgtctacctgtcgtttgtggtgggacatttagactgctgccctcccaatttggtattaaaactcaatattgcaaacagtccacgtaaaattgtgtaccgttctgactgatttctagggatgagtttctacaagtggaacgcacgttttcagggtctgaatgcaattactggagaggctgaacaagttggaagttctttccccgtcttttccagttgggtcaaaccttaagaatgtttgccaacttcgttcaatgggaaatagtatctgcttttattcttacttttcttagcagcagtactgagggttgcgtagatttttgccgagcttggctctgtggagtgcggtgcctgtgggccaggaggcaccatctgagtacttctccctccgtggggtcctccgggaaaagagcgcgctggctcgggatcccgggcggactcccggcgagacaccgcagcgccacctagtgccgggatgagcaggtgcttttcggccgagccagtttccgtgcagaacacctgagcctgggatccaggagaggtggtgcctgggggcgtcggtgccgtggagcctttctcccccttggtctcgcacactctcgcacactgattctcaagagtgtttgagaatggcggatgccgtcagtggaagagctcttacaggtgcttggccggttccctcgacacctcccagactcaccgcaggttctgagtttcctgtacttctcagacccctttttggtgaggattgttcaggtaaggccagggctgcgaggggtcctgtgccagcatttgtctgcagtacaggttcgttttctgctctccagggaggagcagcctgctctagcccactttgctctcaggattgaatgcttctccctgtatcactggcggctctacagctgcacccgtctcccttgattaactgagcttgccaacatccacagcgctgtaggtggtgcttggtgttacagtgttgctaaaacatgcagattgagtgctgccttagaaacccacaggaaggggaacatcacactctggggactgttgtggggtggggggaggggggagggatagcattgggagatatacctaatgctagatgacgagttagtgggtgcagcacaccagcatggcacatgtatacgtatgtaactaacttgcacaatgtgcacatgtaccctaaaacttaaagtataataataaaaaaattaaaaaaaaacccctttaatagatatgcctttcgccaggcacggtggctcatgcctgtaatcccagcactttgggaggctgaggcgggtggatcacctgaggtcaggagttcaagaccagcctggccaacatggtgaaaccctgtctccactaaaaatacaaaaaaattagctgggcatggtggtgcgtgcctctaattccagatacttgggaagctgaggcaggacaatcgcttgagcccaggaggcagaggttgcagtgagcagagatcgcaccattgcactccagcctgggcaacagagcaagactccatctcaaaaaaaaaagaggtacgctgtatgcagaaaagttggaaatcttggcgtggcgtggtggcacgcacctgtggtcccagctattccgaaggctgggtgggaggattgcttgagcccagaaggttgaggtttcagtgagctgtgattgcgccactgcattccagcctgcacaacagagcaagaccctgtctcaaaaaaaagttgaaaatcttgaaacatagaagttggaaaaagatatataggtaattcttatacacagtgcgtgtaccgtgtttatcttctttgcaccgttatgacttttaatgtgcacagcatgatcttaacaagtcagagtcagcactgtgctttttcacctgatttcatgtaactgctgatgaatggctccgtcgtgttctgctgtgtttcgatactgcactcagctctgtcacttcctgcctcttgtgagcagtcacggacgcctgggtttggttacagacccgttctcgtgtcaggattgtttcgtgaggatgggcccttagagatggacttctgggttccaggacacgagagtggtgttggggtctgcacacctggtggctctcagctgctctctgagcagtgctttggtggccgaggcagccccaggaacaccccacccccaaattggattaaacatggtgtcgctgattgcaggtatttaattggcatcacgctgattgccctcaccttaggtgttacatactccgcttcgtgacctgactctgcgtgtctgtgggctccttggggccttttcttccccacgagtgtgagtttcctccggtgaagggcgatggggattgccccaggtggttgttggccttttcctttttttttggaccaaagttttaattttaatgtcaaaccgtttttttctcctttatttagttatttttacttttaagcctgcagtcttattaagagatttaacaagtagtcatttatatttttctctaccgtttattaagacagaattattgattcatttggggtttcttttggtctacagtagaaccccgcccttcccagtaggtaaccagttgctttagtgccattttgtgtctgtagggaccagcaccacaaggtcggtgggtttctccctgtgtgtggagatgagagagtgtagaaataaagacacaagacaaagagataaaagacagctgggcccgggggacaactaccaccaagttgcagagaccggtagcggccccgaatgccaggctgcactgatattattggatacaagacaaaggggcagtgtaaggaatgtgagccatctccaacggtaggtaaggtcacgtgggtcacgtgtccactggacggggggcccttccctgcctggcagccgaggcagagagagagagaggagaaggagataaacagcttacattattatttctgcttatcagagacttttcactaatttgctactgctaactaaacggcagagccaggtgtacaggatggaacgtgaaggcagactaggagcgtgaccactgaagcacagcatcacagggagacggttaggcctccggataactgcgggcgagcctgactgatgtcaggccctccacaggaggtggaggagtagagtcttctctaaactcccccggggaaagggagactctttcccggtccgctaagtagcgggtgtttttccttgacactaacgctaccgctagaccacggtccgcttgtcaacaggcgtcttcccagacgctggcgttaccgctagaccaaggagccctctggtggccctgtctgggcataacagaaggctcgcactcttgtcttctggtcacacctcactatgtcccctcagctcctatctctgtatggcctggcttttcctaggttatgattatagagcgaggattattataatattggaataaagaataattgctaccaactaatgattaatgatatatataatcatatctaagatctgtatctggtataactattcttgttttatattttattatattggaacagctcgtgtccttggtctcttgcctcggcacctgggtggcttgccgcccacagtattccgcttttccattcatttctaatgctctgtgggaactctgtgcgttttaaagggaacacggtttgtcaccaccttaatgctgcttccttctgcgatgaagttaactgccctgggccccttttgcagatccgctaaagttaactctcctggggaggacacatgagtttcttttttctttccttttcttttcgagacagggtctcactctgttgcccaggcgcgagtgcagtggcgtgatcacagtttactgcaacctccatctcctaggctcaagcaatcctcccaccttagcctccccagtagctgggactgcaggcgcatgccacgacacccagccaatttctttttcttttttttttttttgagacggagctttgctcttgttgcccaggctggagtgcagtggcgtgattttggctctactggagtgcaatggcgtgatctcagctccactgcaacctctgcctccctggttcaagtgattatcctgcctcagcctcctgagtagctaggattacaggtgtgcgccaccacccctggctaatttttgtatttttagtagagacggggtttcaccatagtggccagggtggtctcaaactcctgacctcaggtgatccacccgtcttgacctcccaaagtgttgggattacaggcatgagccactgcgcccggccatgcctggctaatttttgtattattttctagagatggggtttatttatttatttatttatttatttttacggggtcttgctctgttgctaggctggagtgcaatggtgagatctcggctcactgcaacctccgcctcctgagttcaagtgattctcatgcctcagcctcccgagtagctgggattacaggaatgcgccaccatgcccagctaattttttaatatttttagtagagatggggtgcaagacaggctgttctcgaacttctgacgtcgtgattcacctgccttggcctcccaaagtgctgggattacgggcttgagccactgcgcctggccaagatgggggtcttaccatgtttaccaggctggtcttgaactcctgaactcaagctattcacccacctccgcctcccaaattgctgggattacaggggtgagccactgtgcccagccaaatgattctttactttctggaaatagggacttctttccccattgttcatgctgagcccctccctaagcatgctccacagggacagtggcggaggggagaggtccttgctgttacgagcagttggcaggtgccagccgtcctgtcagctgggcagcgcttctgttttgtgagggccatgaccgagtaggatggcacgtgcgtggctgtctcctgtgtgttaagtgccctgagagggcttgtccccacggaagcatggagccggctctcgcgcaggccaactagatggatgtgctggaacaagggccgggaaggtgggatggccggagttgaagttgcagtggagatgacgtgggggccggagggagggtgggcgtcatagcctggcagctccagcttccacgtctcaccttgcctggggtctccacgtagctgtctcgtgggcgtcgcgtggggcactcccccacgtggactcttccgcctcctggccctcccaagtgtcccttccgggaggtggccttgtggctgttgagggagcgcctggtgcctccctcctggcatcactgccgtctccttccccccaccccataaaggtgtggctaggatgccagtcagacctgccggcatggcctaaagaggaggtgggcaggcttggccagtactggtcctgtccccagcacctctcccactcggctgctctgcttcgaccatgttgcctttgcagttcgcgagttcccttggctcccttctgccctgggccctggctctcctgcttccctgggcagcagcactttcctcccaggttttgcagcccccctcgttgagctccgtggcttccgtcctctctctaacgaggccatgccctcccgtttccttcgtaacttttctttgcactgtggaagtccccagctgtttgtcgtttctctccagagtgtcagctgtgggagggaagggccttgtctgttctccgtgtggcagtgccagtctcgatcatggaggcaagctgggggcctggcctatgaactcctggtggagaaatcaggaggatctgggctaattagctgggcatggtggcgtgcgcttgtagtcccagctactcgagaggctgaggcaggagaattgcttgaacctgggaggcagaggttgcagtgagtcaagatcacaccactgcattccagcctcccgggttcacgcgattctctggccttagcctcctgagtagctgggattacaggcgcacagcaccacacccggctaattttttgtgtatttttaatagcgacagggtttcactatgttggccagactggtctcgaactcctgacctcgtgatccgccctcctcgtcctccaaagtgctgggattacaggcatgagccactgcgcccggccagatttgggcttttggtttgggagctctgtgtgctcaaggtgtcctgcgctgaggccgggctgcaagaggggtggggagtgtgagcactgcctggaacacgaggccgagtccaacagggaagactttcatggggctacacgagcagctggctgtggaaacaggcctgtgcacaagacgcatggcaggtgtgggggagggaggtcccaggggctggggcccagctgccggggccaggccttgcacgtgggcacggtgtcctgaggtcaagggatgcagagttgggtccagggaggagggaggggctgagaagtgggcaggggctccctggcggtgatggggacaggtaaaactgggggggtggagggggcaggcggggggggatgggcagtaggcctgcgacctgagaggttgtggtggggaaccggctgctgagggccctggtcagggcagcgacttggtttctagggttggagagaggaggaactagctggaggaggacaggactcagtacagagctggcatcttggtgtaagggtgcgtgaggtgggagggcctggggaggtgggtgtgtgtggggtgggctggtgaggcgtgggcgaggtctcagtgctgaggccttggttgagctgtatccttttggcagatttatcacacgtcctgatgtcaagcaaagcaagatggctgagttcctggactggagcctgtgcaatctggcccgttcctccttccagaccatgcagggggtcatcaccatggatgggacgctgcaggccctggtaagtgctgcccgcaggggctgtggagatcgcagggaaatggcgccttacatggggaccacggaatgatgttacctgtgattccatcttgacgtaattggaaccccgtgggattgatttaaccgggccagggtcttgggcagtttccttttccctctgctttgggtcctgcctcaggcagggctggtttctgcgctggtgctggtggatgggcttggagccccacctgttgccagcagagggcagtggtgccacgcagcccgggctccccagggtaggtttctctgcatctgggctgcttagttcctgtttaagtgcagagactgaacgagctctaataaaacaaggtgggtgagttgaaatttgattctgttcctttgcactgggctcgggttggatgttcctgactgcttcgttgggacacagaccctggcctctgcctgcaggtgcctggttagtgccctggctgcagccctttgccagccctttccctgccctttcgctctgattgtctcttgtgttaccttttcttgtgctaacgaggaggaaaggtcaagtctcagaagagggcaaagcctcttttgggtcagcgtcctggaggctgcagctccctggtcagccttctggagggggagccggcagccggctgtggcctttggcgtggtgggttcagcgccttcttctctctttaattacagcgggtgaggctttgagagcacttctcatccttgtctcacgctgtggagcctgtggtccctctgaggagcggggcactttgttcttgtttaaaaaatatattttatagagacagggtcttgctatgtaggtcagggtggtcttaaactcctggcctcaagtgatcctcctgcctttgtgatgatcccaaagtgctgggattacaggcttgagccgccgcgcctggaaggacactttggagcgcgttttaggggagatgatgagtgccacctcgccacggcgtcctcctgtccgtggcgtcgtcctcctgtccgcagcatcgtcttcctatccgcggcattgtcttcctatccgcggcgttgtcttcctgtctgtggcgtcgtcctgtctgcggtggcgtcgtcctgtctgcggtggcgtcctcctgtccgcagaggcgtcctcatgtcctcagtgttgtcttcctgtccatggcgttgtcttcctgtctgcggtgtcgtcttcctgtccatggcggcctcctgtccgcggtgccctcctgtccatggtggcctcctgtccgctgtgccctcctgtccgcggcgtcgtcttcctgtctgtggtatcatcttcctgcccgcggttttgtcctggccgtggcaggttctgccagggagcgggaggctgtcagctgggtggaggggggctgtgggagtgatagcctggggtgggggcatacgtttcttgagggggaattgggaagtgtcctcctcaatgtctgctgcttcccggtcatgctgccgtggtcttcaggagggcagcctttgaaatgaggaaaaggtttcagacgtgtgagagaaaactgcagacgtgtttcctggagcctgtgctctgcccaggtgatgtctgttttcttcaggcgtcccctcaacctccacataaatgtgacagattcagcagttttcaaaaatcaagatataattcacataccacaagtaatttatccttctaaggtaaacaattctgtagttttctgtgcggtcatcaccattatctaacttcaggacactgtcatcatcgtgagagaaaccttgattgcaccgagcagtccgtccctcaccttccccagcccctgcagccgtggatccatgtgctgtccctgtggacttgctggttgcggacatctcacctcaccagagtcgtacacgacacagccttttgcgtctggccttcactgagcccgatgtgtccaaggttcatctgcgctgtggtgttgtcagtgcctcgttccctttatggccgaatcataagccaacgtgtgggtattttccatatgccagcgtgtgggtattttccatatgccagtgtgtgggtattttctgctcttacaaattacgctgtgaagaactttcatgtgcaagtttttgtttaaacttaatgctttcaggccgggcgcggtggctcatgcctataatcccagcactttgggaggccgaggcaggcagattacttgaggtcgggagttcgagaccagcctggtcaacgtggtgaaaccccatctctactaaaaatgcaaaaaatagccaggcatagtggcgtgggcctgtaatcccagctactccggaggctgaggcaggagaattgcttgaacctgggaggcggaggttgagtgagccgagatcatgccactgcaccccagcctaggtgacagagcaagactctgccagaaaaaaaaaacagaaaaaacaaacccaacttaatactttcagtacccttgggtacacaacactagtttttaataaaattttaaacaaaatttggaatgttttcatctttctggagtctttctaaaaagatttttctggtggcatacctgtcgtactgatgaaatagaggacctcctcatgccaggcatttttgggcattgcaggtacagatgtgctgtctgtgtccccaggtgcccctcgttccggccgtgctggggcagcatcctcaatgcctaaagaggattcattgctatcgtggaggtcagggcaggctgaggctggccttgaagggtacgggggtggaggggtagggcagggaggactcaggtctcggacgtacccactgtgccattggtccatggatcctcagggaatgtgcgttttatgttttaggcaattctggtaaaggtggtggatttagttgcaattggattcttcattttttgccttgggtctcactgaggaaacatgaagaaggggtagatggcagtggccagggtgggggtcctgggaattctggtagcttcaccttaatgtttgtgatgctgggtgtacagacagcctcccacatgaccaaggacacgctcttaggtccctaagaccccagaagaatgggccgctactgccaagaagtatgacatgcgtgtggaagaccatgagccttacccggctggtggcatggggtgtggcaactgccgcagctccccgaaccattgcagtgggaaaggggtacgtgctgtgactaagaccactggacccgacccatcgcagcgacagggggtccatgctgtgtgactgagaccactggaccccacccatcgcagcgggaggggggtccatgctgtgtgactgggaccactggatcccacccatcgcagcgacagggggtccatgctgtgtgactgagaccactggatcccacccatcgcagcgggaggggggtccatgctgtgtgactgggaccactggaccccacccatcgcagcgggaggggggtccatgctgtgtgactgggaccactggatcccacccatcgcagcgacagggggtccatgctgtgtgactgagaccactggatcccacccatcgcagcgggaggggggtccatgctgtgtgactgggaccactggacccgacccatcgcagcgggaggggggtccatgctgtgtgactgggaccactggatcccgcccatcgcagcgggaggggggtccatgctgtgtgactgggaccactggacccgacccatcgcagcgggaggggggtccatgctgtgtgactgggaccactggacccgacccatcgcagtgggagggggtccatgctgtgactgggaccacctggcctgaggttggactggtgaaatgacaatgttggcacctacatgtgtgtcaggatccatgtggatatgtcccgcacacctgcttcttggaatattgtgtaagcagctcttcagcttcacggccttcatgatcgtgttctgggtggggaagaattaaccagcctaccagcccgtggggccaaagcagtgtccttataatcatctgcacctggaaccaggtggcgatcccaccgtagaacctgtggctcacaggatctgaggtggcttcgagggcttctctgccctctaggattccctcatccttagaaatttaaccttaatgaaatccctaataaaactcagtgctgtgggggaaaaacatctcaggtcaggggagcaaatgggaggtctaacaggatgtgaccagagctggttgtctccaatggctctgccccgagtgtggtgcctctgcaggggaggccgttagccctgccccgagtgtgggtgctgctttgggaggggaggcaaatttgatctctgtccggtctcttaacgggcttctaggggtctcctgcagctctcgtcagcctggcctgggagcctcccctcctctgccgtccccaccccatgctgttgggtcagcaggatatcccagccttggggctggagccagctgtggctgcccagggacttgcaggcaggtgaggcgtgccaccttctggccaggctggctgtgggagaggcagcctcctggtgaggggctgtgggccactgcgttcaggctgccttggagggctccacggtgtcccctgggtgcagggctccgagtccttctcggcttgggagggtcttgtggccacatgtgtctagttctgcagtttctttgttgtgggttcggttctttacttttttttttttttttttgatgatcttgttggttttctctagattgttcccaagttttctgttcttccatcccaagtgggagacacgtgttgcacagcctgcatttggaatacccagagggtgggtgggcgggacggctcgctgccccattcccctcctagctgctgggacaggtgggaattcctgtagcaaagtcaaaccagccaggagtggggaagtgctttttattttgacatctccaagttccacgttgaggtggagagacattcgtttttccccttcctcccgaggtgtaaaacggtcttctcaaaggcttaggagagccgagccctgtgccaccccccggcatatgctggcaaagagtgaggcgtgctgtcctgccgtttagggcagagcacccaggcggtttggcagcagcacctcagaactattcagagatttgccctcagcaagagtgagcaattgtctgacgcagccggctgaaatccctgggaagggaatgaatgaaactgccgtgaagcaacgcctggcggggccgggcttctggcagctcctggggccagcacgtcccttccagagcgtctgaagccctgggcggctgctggagcatctcgagtctttccagagtcatgtgtgttgtttccttctgtctcttggaagggtccgtttggtctgatccaggttgcctcagcaggaggaagtcgtgctgggtgctgagcgggtgggaggtttcaccttgggcttggcagagctgcaggcagaggccgggcgcctgctgtacatgatgaaacttgcaggtggattctgcttagggtttcatctgtttcctttgatgcacttggcttcattgtcatccacctgttcattactgtgggcgaaacaggtgaactctcaacaagtaccatcgaaaccaggatttgatcttcatttccctcgaagcgtagttcccttgcagtgagggtttttaactcctgtgggagggaagcaagtgtttggcaatgtaatttccctggaaggcccctgtacttcagctttaaaaacacgctttggtttagtcccaatttaagcattaagattaatgcaaattgaggaaattcaaggaaggagaaaaacacattaaaaatggaaaatgggctgggcacagtggctcatgccggtaatcccagcgctttgggaggccgaggcaggtggatcacttgaggccaggagtttgataccagcctggccaacatggtgaaaccctgtctctactaaaaatacaaaaaattagttgggcatggtggtgcgcgcctgtaatcccagctacttgggaggctgaggcaggaaaatcgcttgaacccgggaggtggaggttgcagtgagccgacatggcgccactgcattccagcctgggcaacagagcaagactccatctaaaaaaaaatttacaaaaaggaaaatggctgtcatttcatgtgtgactctgcttgctgattgatagttgtgctctcttggtttctagtgctctgattggaagattgtcgactgtgtggagtgggtttctccctgtgtgttctcacaatggctgggaggcggcggcggggctgggggactcggactgcgagacggggctgttgactatgaaagtggtaataggatgctcttccccttatcggctgttaggctcgagtctcccctttgcagtgcggtttctttttatttttatcattgacaaaagcacaactcttgttaaaggataaaatagtcacacacaacagcattaaaaaccaagaaagccaaagaacgctggcactgtcagcctcactcccagctcccgctcggcccttgtgaagagaggtgctgaagccactctgcttttttatagttaataaaagcagccaggtccccaagtaggagtggttgtggccaagagtgtgtgggccgggaaccagggcttgagctgctgtgagctgtgcccaggccctttgctgactccgtctctcctgtgacctgaggccagggtgagcaccagcgcccgccccacctgggagggaagcagcagacctctcaccgcagaggctggtgtgaggctaattagcacagtcagtctttgaagatgaaagaagacagctgattatctaaaacatttcacatttaggctttgatttctcttcagatttggggaacagcaccctactgtttcatttagggttcagtgtggccagaggaagatgacccacgtggtcctttttagttgtagtgctctcttggggcaaggttttggatggagaaaataggacaagagcagtttgaatgtgggtactttccagagatcatgctcctgtagcatttgggtgaaacgaggtaccccaggccacgctggttcggtctcctcgtggcgttaaggaaagacctggagcagccagctcctaacactcatttcccatcactcagcattttatgtggggcgggcacagtgccgtgagtcttacagaaacctgcatggtgagccgcacgcctttgagtccccatcagccctggcccatccctgctgaggtggcgcgacctgctcacagacgtgtgctcacaggcagcccgtcgcggggtcatgtgctagacggggagggggcttggcgggtcaccagcctcaccccgctcagttcttagatgaggaagagacaggcagagagctgggctgggctgctgctgagtgggctagagctgggtctcagtggcccctgccccagtcgtcctgacctgtggcccctgtgcaggttggggtgcccctgccctctcccctgccccgccctcacctggctcacagacccgtgatgcctcactgcccacgcagtcaccttagaggcaccttccctctaaggcagatgtccctcaggctttggtcctggctgttgatatctcagctctgattcacccttgacctttattacctgatttctgtccttggttctcgagccctccttctgtggacccgttgggtacacgtgtgacacttcagaacccgcaagtcccaggtcacacctgttgtaccatcactttcccctcctggcctgtttacccgggagcccagcaacaaatgggagcttctgtgctgctgtccgtgcatacggcccaggagccgggctcatccccgagacgccgtgttccctcccgctgtccgctcacacctgcctgtgtggacgtggctctgacatgtctccttcctggttcattgctcatctgttctcatgtggctgcgccgccaccctgtcctgggggtccttgtcccagcacgtggctctgtgcttcacgtcatcctgagtctgtcccgctctgccgcctggtccaggtgggagccatttccttctgtgaagtgttccctctggaggccctgggctccccgactaccctcccgcctctcctgtggctgtcggctgcagtaaaggtgctggtggagggtgtgagccatccattcatagagtgccagactctgtcccatgctgcctctgtgcccttgatcctggcagcacacctgctgtcctgtggcctgcgtaaagggtggcctcggaagcctgtggcctgggtaaagcgtggcctcggaagcttgtggcctgggtagtgggtggcctcatcttggcctcggaagcaggagggctcaggctgtggcccacgcctggggttccccatccccccgtgtgtcctggtgtctttgcttggctcgccggcctccatgggctccccaggtggcaggtggctctcagccatgctctccgtcctcatgcttgtttctgccctggcagagctgctcagtggccagcccgtgggacccctgtgcaccctgccgcccccagcatatgtcagcagcgccgtccgggggagatgtggcatcagcacagccttgtccttgtctctgcccgttcttccttccttgcctctatgtgtctgcttttttctcttccacatggtgtccacagtggataaccacatccactggcctcctggttggtggatcctcctcctgctgggctcagagctgtgccacccccacctgcactgcagagaagctcagacccctctctgacctcagacgctggagcctgagccccctgcttcccaggccaatgccccttcaggtccctgcaaagccactgctctttgtggtctccctgccgccgttgccctccctttgccgctgagcccgtgggctgcttggtggcttgggagctgcatacaattctattttgtctggtttgttttcaggctttctgtggcaggaattgtgtctcttgcatctttttttttttttttttttagacggagtctcgctctgttgccctggctggagtgcagtggcgcgatctcggctcactgcaagctccgcctcccgggttcacgccattctcctggctcagcctcctgagtagctgggactacaggcaccctccaccacgcctggctaatttttttgtattttagtagagatggggtttcaccgtgttagccaggatggtctcgatctcctgacctcgtgatctgcctgcctcggcctcccaaagtgctgggattacaggcgtgaaccactgtgcccggccatggatcattaacctcttttctagcatcttacctctgtggtggttcacttttgcgagcttttgctgggccttggaaggtgcgtgggctcgctgctcctctcttctgtgggaactgttgcctttgggcagggggcacaccccagaggtggtcacacacacctgaacgggagcacagtcataagtccctgtcatgcaaagatgggctgtgcagaatgagctcggaatagcagccagaaggctcagtgatgggggagttgtttaagctggaatactgtaatgctgctggctgtttatggctgtgaggtcactacgtgggctgctgagaacattttaaaatgctgagtgagtcatgaaacagtcatgcgtcccctaacaatgagggtagtcctgagaactgcgtcgttgggcagtgtcgtcgtgtgaacaccgtagcgtgcacttaaacatagatggtgtggcctgctgctcccaggccaggtggtgcggcctgctgcactcccaggccaggtggtgtggcccgctgctcccaggctgcaaacctgtacagcacctgactgtgctgaatactgcagggaactgtaacacagtggtgtttgcacatctaagcatagaaaaggtacagtaaaaatatatcatcagctgggcacggtggatcacgcctgtaatcccagcactttgggaggccgaggcgggtggatcacgaggtcaagagatcgagaccatcctggctaaaatggtgaaaccccatctctactaaaaatacaaaaattagccgggcgtggtggcgggcgcctgtagtcccagcgactcgggaagccgaggcaggagaatcgctcgaacccaggaggcagaggttgcagtgagccgagattgtgtcactgcattccagcctgggtgacagagcgagactccgtctccaaaaaaaaaaaaaaaattatatgtatatacacacgtgtatacatgtgtgcacacacacacacacacatatatgtgtatatatatgtatatataaaatccttttatgggctcactatcaatatgtggttcctcattgaccagaatgttctatgatgtaggactctagtgcgatacactgtcatgaacagattgataaattaggtgaaggatgatgcctgtgaatgacagacgtaggaagccacaatcattttgtgttttccacactctctttgagagctgtgttgccttggtttatggatgaggacatggacccaggtcaggggctgccaggtcggtgctggggtgtggagctgggccttgcatggcccccacctgtgaaggtaattagtgtttaccttacagtccaaagtttggtgaaaaataacacttcgttctggaaagataaaagctagatgtgattatttcgatcattgaagcatttttgtgtgaaattacctttttttttggtgtcagtggcatgatctcagctcactgcaacctccacctcccgggctgaagtcatcctcccccctcagcctcctgagtagctgggattacaggtggacgccaccacacctggctaatttttgtacttttagtagagatgaggtcttgccatgttgtccgggctggtctgggactcttaggctcaagtaaccctcctgccttggcctcccaaagcgctcggattctaggtgtgagccactacacccagcctgaaattagttttcattttgatatttgttttcttaaaattctttataatttgtcagaaatttattttgtcagaaacagtatattttttcactctggggctctgattctaatcagtcatttaccaatccagcaatgaaagttttcacttccgtcaatggcttttttcctctgaatgtgtggtggtcctgaggggagtgcattttgctcgctcctgggggaggcagtggtctggcctgtccccaccagtgccccctaggccccgccttgaggacaagctctcttctgtttctgagcgctctcccgtcctgtctagggcaactgctgctctttctaggggtggtagtggggctcttgaagatgtccctcgctttggtttttgcaggccagcaaatgcactggacgttgtggtttttctggcctccagtagtggtgtggtgggaaggttcttttcctgccctgctgctgaggggagcctcgagcgtaccagagttcctcagtgaagcctttgcacgtcctgcagggtgcagcccagcatgggtttcactgccctccaggaaaggcctggccctggtgggctcgctgcagcacaggcacggacctggggctgtgctctcaaggcattccagcctggaaagggttgttttggtgttaaagatcctcttccgtgcctgtcctgtggcccctctgtgtggcatgcccaagagtggctttgaacatggctgccctccgtgtgctgagcctgcgggggcacggctaccctccgtgtgctgagcctgcgggggcacggatgcgattggttgcttcccaagataccatttcttggtgtcggagcaggactcgggatggcagaaaggggaacagactcgctctcctcatctgcagagtcggcatggttatgtggggccacagggtgacccgctggcctggagctagcgtggtctcagccatctgcctcagtgccggccggcactcacagcttctcagaagcctgtgttaccagccagagccaagcctgaactggtgtggtgtgggggcccttctcccagggcctcgggtggagttgcttttcttggcctagatttggcagtgcctgaagggagcctcaaaccagcatctcctgcttggcagcgggtgagcttgctcccgagtagctcgacagcctgtgatttactgggcttggagaacatgccccaggggggggaagctggctcgcacgttgcagagaagccagcttgggtgggtagccatcgaaaggtggggcgggttaggatgattgctgagaaactccttttgtttgcagcttgtgctgtgctggtttctagaacaacaaaaacagacctgcagtcattcctcatttaccatgcagggctgttttcctctaatccctggtgtcatcacctctgtctagtgtatgcttttcagcaggtggttttaatttggttcccattatgcttccatgaaagtgggctgtgccccccattttatggcctagcttatgagcactcaagaccattgatgactagagtgcgctctctctggccgcgtcctcctgctgacaggtaccccatcccaccgccacgctgagcactggccactgcacactgcacactttctcaggtgaagatggccttacttttcagtgaaataaatggaaacaaagccctgtcttcattgactcgttccttccctgtcgtctcttttgccctcctgcacccatgcctgggaaagtggataacttttggggcttttctctgtgtgtgctgaatgcccaggaggctgcctgtgtaattcagctggaaactgtccccagggtagagagaagtgtgaggagaaaaagacccttcgcccggtaaatgtgtggggttctggtttctcccttactgcagatggtggcgggccctggccttggtgctgtctcctgtgtgtagctggggacggtggaagctgggctgggcctttccaggtgtggggcatccaggccagttacaagagatgatgcttgctttcccgagaactcatcaccacttgtatcttagtctgctgtagagaatgttgtactacacttcataggaattgagtaactaaacaacgttcatgtgtgagggcactctaggaatttcacagtgtcttggattctttttatttagtgagagaaaccagacgacgtgttagcccgttgccaagtaagactgggggacacgtcagcctgttgccgagagagaccaggggacatgttagcccgttgctgagagagaccgggggacacgatagcctgttgctgagagagaccggggaacacggtagcctgttgctgagagaggtcatttcccggatctttgtcctgcgtccgcccacagctgcacagctgctcttctggtttaggttctggcctttcccactggggttttccagcagcctctgtagcggtcttcgttgttgagcacttcactgttcatccccaggttctccatccagctgctgttggaatctggtcatgtggccatggctgcaggtgatacggtggtgctctttgcctgtaggatgagatttcagccgctcgcaggttcatttgttgtggaacaacgtactccacagctggtggcatcagtgacagccgcactcttgcgtggatcgattctgtggcctcgcagggtggggtgcagggggccgtttgttactgccctttgatgcctgggcctctgccgagaagaccacgtggcaggtgccttgaagggctgggtgcggcaggggcccttgactgaagctggctcttcctgcatggcagccggcttcccggagggagtgtctcaaggggaggtgtctggagaggccctgaaagaggccgccaggcttctgacctgggattgggggtcactggcatcactcctgcctgcctctgttggttgtggcagttggaagcctaccaaggtggtgggtgagggacccttgattgtccgtctggcaaactctgttccccactgagctggccagccggctgcagtgacagcttctctgtgaagtgtcttgtcttcttatcccccaggcgcggtccggcttctcgttgcacactggtgggcttcaggccgtcagcccacctcccagggaatttgagtgtgtgcttggccctgcgactgcccccgaaccccgcgtcccgttgcggggagctcgcctgtgccccacggtttctgctcagcaagtgttggctctgtaaaccgatgacttagggttaaaacacatattaaattagatacatctggactggtgtgaaataatttaactttcgattttatatttcacacaaactaaagatggggaagagttcttaaagttaaatgagaacttgttttgggcaaacaaggatcatctccattcacttggtagggaacgtgttactatccatttcgctaaagagaaaggggctaagtctctgatcaccttggtgaatgtgttattctgagtggctcagggaggtgggtgctgccactgccccattttacagacagaggaacaggagcgcagagaccctgctctgctccacaggcgtgactggtggtctgtctggctgtctccttcccgttttgatcgtaggtgtgggatctgcaccacaggtgtgactggtggtctgtgtgccttcgctgcttctccactcagcgcttaggagagccccccagcgggctccatggagagagtctaagttccctctccttttaagaagatgtttctattctacacttaagtaagagatcaggcagtttacagggttcataatgcaaataaaagacaccagtatttagtgaaagcctcttcaccttgtctgagcatctcctgatgggcggcacctgcttcttcatttttccgtgtggtgggcgacagcaggacaggggtggcgtggtgtgcggtgcagatagtctgagacagatgcagttctcaccttgactgtgaaattctgttttctgaaggaaaggaaattcattcgcgttttcttagaagggctcagttctaggattcttcgattatgaggcttggatatttatgtgaatcatcgcatttgtcctccagactttaaagcagaaggtaaaacctcaggttgagaattcaggagggctagaaccagtgtttgagagaaaatctgatattcctgtttggtctgatggactccaggtgatgacgtccgtgtgtgcgcatcgtggggaccgggctgccaggtgtgtgtgtgagacacgggctgagctggtcacccttcgcatttgttggtgaagcatgaatgcagatggaggcctttgtgtgaggtggtttggcctgtaacttttatcctttgtaactttatttatacgcagataatttttaaaaacctactgagatatcttctttttccaggctagtagtgccctgaacttaaacctgggcacgttttgtgatgccattgatgagggaggggtggagaggctgcagtctccatgaggggactggacttatcattgcatccctattttcagatgaatttttgggagatgatttcactagtctcttataattactttatcatgtacagaaactgttttctttattattaggtggtgagtgtttagaataaaaattctgaaagatgtgatgaattgttttcacaatttgtgtgtatgttttaaacttctatttgtatttgtaacattaaaaatctttttttttttttttaggcacaaatatttaaacatggaaaacgtgaagactgtttgccctatggtaaggtttatttttaagagacgatatctttgtgatgtgagtttgctcatatacaatcaagtgtctttccttaacattttattcatagatataggaactgtacattggtatgtttggacactatcgttcttttttttgttgtgggttttagtaactgaacttttttttttttttttttttttgagactgagtctccctctgttgcccaggctggattgcagtggcacaatcttggctcactgcagcctccgcgtcctgggttcaagcaattcttctgcctcagcctcccgagtagctgggactacaggtgcctgccaccatgcccagctaatttttgtatttttttttttttgagatggattttctctctgtcgcccaggctggagtgcagtggcactatctcagctcactgcaaactccgcctcctggattcacgccattctcctgcatcaacctcccgagtagctgggactacaggtgcctgccacaatgcccagctaattttttgtatttttagtagagatggggtttcaccgtgttagccaggatggtctcgatctcctgaccttgagatccacctgcctcggcttcccaaagtgctgggattacaggtgtgagccaccgtgcccggcctaatttttgtatttttaatagagatggggtttcaccatgttggccaggctagtcttgaactgctgacctagtgatctgcctgcctcggcctcccaaagtgctgggattacaggcgtaataactggactttttgtcactttcctagtcctttgataaagagggattgctgccaggggtctcgtgagggaggtctgggcaaagcccgtgtcatgatctgaggttggacctggcttcttggggcccaggagcagccatgttcctctgatagccacagccaccacctcttttgccttcttcctaattctcttaatttattctttttgagactgcatcttactgtgtcgcccaggctggaatacatgacacagctcactgcagcttcgacctcctgggctcaagccatcctcccacctcagccccctgagtggctgggactacaggcgagctctaccacgcccggctaatttttttagcagtggggtcttgctgtgctgtccaggctggtcttgaactcctgggctcaagtgatctgccctgccttggcctcccaaagtgctgggcttaaaggtatgagccaccacgcctggctcaattctcttaattttagattgagcctcaatttctgaaaataagggcagtgtttttctccacgcagaggtttaccatctggaaaaagagaaacttcttagagcctttgtgtgttttagaagctatccggactgggcgttgtggctcacgcctgtaatcccagcgctttgggaggctgaggcgggtggatcacgaggtcaggagatcgagaccagcctggccaacatagtgaaaccccatctctactaaaaatacaaaaattagctgggcatggtggcacatgcctgtaatcccagctactcgggaggcggaggcaggagaatcccttgagccagggagttggaggttgcagtgagctgagatcgcgccacagcactctagcctggcgacagagcaagactctgtctcaaaaaaaaaaaaaaaaaaaaaagaaactatccgaatatcaaatttgaataactttctttttttgaaagtttttcattatggaaaatttgaaacatgtataaagaagagagaatggcgtgcacgccccgtgtctctctcaggagtgtgcgagttttcgtgtgcagcctgtttcatccctgcaccgcacaggagggacacacagtgccatctcacctgtgtgcacttccatacatgtctctggaaggtggggctctttatgtcctcaccacacccgagaacgcgagcagccgttgccaggccctgtcggcgggaggagcgtccttggtgacgtgaacacagacctccctcttgggctgtcgtgcttgtcacccacgctcattgtgcccactgtcagagccttctgagaagttactcagatgctctttcagctgacctggttttataggcaagcattatgagttaaacggcacctctgcccgaggtcacggcacccacataaaactggtgaacgttcactttctgtcatttcccagcctcaaggcagagcttcctgcagggcactgcagctccagcccccatccccctgctctgtccccgccccactgccccttcctccatctccttgtcttccatcacctcacctaactctcagctctgtcttcagcttctcttcttttctcctgtcccctgtcagttggttgcagtcttgtccatttcacttccagcccatctctgaagccgccatgcacttccaccccagcccttgtctgtcccgggaatgctgtcctcctggcctcagcttgccctcgtcgcagcacccgggcgtctcctgctcgcaggctctccctgtcgtgctgtgcccagtgctaccttgagcctccccttggctcagcctcctgtcctgctattgtcatcactgcatgacaccgagtgattccccctgaaaaacagagcaagccacaggaaccccgtggcctgtgtgttctccccagccgcagtgtgctccatggcttctggggttgctgcagtgtgccctgtggcctgtgtgttctccccggccacagcatgcccgtggcctgcgtggtctctgtggccgcaggatgcccgtggcctgtggggtctccgtggctgcagtgtgcctgtggtcggttgggcctttgtgtgtgctgccccccttcagattggctccctgccctctgagtacttgctctcctgacctccactgatgttgcttcacagcaaggaagtcgagtaggttcaactccagcagctcttggttcatgatttgggatgatgggggtcttggtgatgtctcctgcctcaaggcccctgtggagccggctgttggtttcggggacacaggtggtgcagtcagaagatgcctgcagcccttcctgcgctgagtccagttcttgtttgcagctgccactgtcctcaggtgcctcgatggctgcagactccctgagagcaaccagaccctgctgcggaagctgggggtgaagcttgtgcagcgactggggctgacattcctgaagccgaaggtggcagcatggaggtaggcaccatgagggcggtgcctggggagggccacggggtggggaggggttgctgtggggggcaggcgccattgatgagggcggggcaggtgctgttggggcaggtgctgtggggaggcagtcgccctgttgcggggtgggggaggcaggcgccatggggtggggaggcaggcgccttggttctggacacagttgggggcactctctggagggcaggccgagccgtaggtgagcgtctggtgtggctggtgctgtggcttttgtgtccagtggtgatggcagagaagatgtgttagtaacaagtgttttctgctttcattcatttctttaatcctagaagtgtttctgattttgagaggaatggttttcttttggttattttctgactgcatctcccagttggaagaactgcagctggcgttggcaggaaggtggcgtgtgcgtcgtgtggcttggagtcagcgtggcaggatggcggcgtgtgtgtcgtgtggctcggagtcagcgtggcaggatggcggcatgtgtgtcgtcgtgtggctcagggtcagcgtggcaggaggctggcgtgtgcgtcgtgtggctcggtcagcgtggcaggagggtggcgtgtgcgtcgtgtggctcagagtcagcgtggcaggagggcggcgtgtgcgttgtgtggctcggagtcagcgtggcaggagggtggcgtgtgcgtgatcgtgtggctcagggtcagcgtggcaggagggcggcgtgtgcatcgtcgtgtggctcggagtcagcgtggcaggagggcggcgtgtgcgtcgtgtggttcggagtcagcgtggcaggagggcgtcgtgtgcgtcgtgtggttcggagtcagcgtggcaggagggcggcgtgtgtgtcgttgtgtggctcggagtcagcgtggcagcagggtggcgtgtgtgtcgtgtggctcggggtcagctcagcctccctggcgtggcagcgtgtgtgcgtcgtgttgctcagaggcggtgtggcctccctggtgtggatgcgctgtgggggaaagctgcatcggatcagtgatgagtctgaatgacaggctccctttctttttttttttttttttcccaaggcagaagaatttttcttagtacagaacaaaatgaaaagtctcccatgtatacttctatccacacagacccggcaaccatccgatttctcaattttttccccacccttcccgcctttctattccacaaaaccgccattgtcatcatggcccatccccaatgagcccgctgggcacacctcccagacggggtcgtggccgggcagaggggctcctcacttcccagtaggggcggcggggcagaagcgcccctcacctcccggatggggcggctggccgggcggggggctgatccccccaccaccctcccggacggggcggctggccgggcagaggggctcctcacttcccagtaggggcggctgggcagaggcgccgctcacctgctggatagggcggctggctgggcggggggctgtcccccccacctccctcccggacggggcggctggccgggcagaggggtcctcacttcccagtaggggcggccgggcagaggcgcccctcacctcccggacggggcggccggccgggcggggggctgacccccccacctccctcccggacagggcggctggccgaccccccccgcctccctcccggacggggcggctggccgggcagaggggctcctcacttcccagtaggggcggccgggcagaggcgcccctcacctcccggacggggcggccggccaggcggggggctgatccccccacctccctcccggacggggcggctggccgggcggggggctgaccccccacctccctcccggactgggcggctggccgggcgggggctgagacaggctccctttcaaagactgttggagaaagtgaaaccgcctttcttgctggcagaaatgatgtcttagcagtctgtagcggccggtgtgaacgggttggttctcaaggagacagacttttctagtgttcttagggtgctgtgtgttagcgaccttcagtttgtttcaagtgctataatacgtgtggtttgggaaggaattacttggttaaggtcagctcacactccgtcctggatgatggcacattccagagacgcgtgttgtgttgcagtgttgggtgtgcagctcactctgtaggaagttgctcattaggcacagtgttcgtggctagtttctcaaagctgctgtggggaatgttcagtgctgtaccaggcagggttctccagagaagcagagcccataggatgtgtgtgtgtcggcgaggctgtgagctggagaccaggagagctcatggtggttcttggccaaaggcctcagggtggagacccaggaagagctgattggttttagtctgaagacagaacaagtccagttgagagattgccaggcaggagggcttcccccctcctcagggagggccggcgttttgttctgctggggccttccgctggctgaacgaggccccctgcatttggcagggtcctctgcctgactttgtctacagattcacatgctttgctggtccagagcccctgacacaagcactggaagcaggtgtgatgaaatagcggggcgccccacggcgcagtcaggttgccatgtaaagttaagcatcacaagcactgaaatgttggtacagaaaataatccagtatcctagttctctcgataatgatgtgcgtgttgccacatacacttcacgtaattctaacgtggttgggttttagtccccgtcttgtgtttttctcttccgtctttctctacgtttcctgtatttctaacttttttccatttttatctcctcggttggattttcgttgtctctgttagtaccgttctcttcttggttgtcttctgttgatgaggacggacttacgctctgacgggctgttagatttctggttcatcccactcctcctgccagccttggctcgaggctttgttagggtgggtctttctcagctcttttcctccagggattggtctttcctccacagcatggtccttgctttaagtatgtagcctttcagggacttaggtgaaagtcacggctttctctcccgtcctgctgggcccgggtctccggggccctctgagggttgcacagtctccaagttctctgcggcacttggcctcccagccattctctgacaggtgcgtctgagtctcgccttgtgcttccttatcttggagtgcccagggatccaagggaatttttgggcagagttttgggcctctgtctcagcagctctcttctccccaacatcctctcccccacatatgagccctccactcattgagattgctgcttcctgggctgtttccttggtacggtgtagaaagtacccctgcggggaggaggtggaggtggcccacctgcagcttcccctcgctggggattgttgccctgccttggttgccatcacctgctggccaacagtggctttaagtcttccgtccgagtctcaccattgttgaggtcgggagggcatgtgtagaagcagcctgaggtcattgtctttgtggtgccgtctggtctttgtgaggtggctgagctgcgcgcttgcgtgaggagaatggcggctggggtgcaccggtctgtggggcgttaggggagactgggggctggggtgtgccagccatgggccattaggggagactgggggctgaggtgcacctgcccgtgggacgttaggggagactgggggctggggtgtgcctgcctgtggggcgttaggggagagtgggggccggggtgcacctgcctgtggggcgttagcggggagtgggggccgggctgcacctgcctgtagagtttaggggagagtgggggctggggtgcacctgcctgtagagtttaggggagagtgggggctggggtgtgcctgcctgtggggtgttggggaagagtgggggctggggtgtgcctgctcgtggggcattaggcatcttgctgggtgtctgatggtctccgccacggtcctaagatggctgatgatactctcttcataccagttaccctacattacagtgtaccccgaaatttagcagcttaaacagtgcactttttcctcacagttttggtgggtctggaatcttgacgtggctcagctgggtccccggtcagggtctctcctgaggcttcttaaacagtgcactttttcctcacagttttggtgggtctggaatcttgacgtggctcagctgggtccctggttagggtctctcctgaggcttcttgaaggcgccggcctggccactgccgtctcaaggcctgcattgctggggggtgtgcttccatgctcctcatgggttgctgtcgggacccggtgccttgtgggctgttggtggggacctgtttgaagtccttaccatgtgggcccctccgcagggcagtgcacagcatggtagctggcttcattggaggctgagaggcgggtggaaaccacggctgtttggaaggtggcagctctcaccagactctgcgtattctgttccttgggagggaatcattgggcccaggccacaccccgtgtgagaggaacgctaggcggtgggggtcgtgggctgtcttggaaactgcccccctccttgtttcctagacttggaaactgagtcccagagggctagagctaggatgagtcattcgaagcaggttgatggcatcagcaccagtgtgtgagttctggttctgccgccaaagcccaagctgtttgtcctctgggaggctgtctcaggctacagccgcagcagctgccctgaactctcactggacaccttttctgcatgaggccggggaagcagggcccacagccaggcggcccgccctgcactcacccttggcaggagcagctgtgtacgcgggggccttgctcagcgcagggctgggctgcacgccgagcgcagactctgacggctcctcacacagctctctgcgtaggactgcgttcccattttatagagggggaagtgggggcatggagcggctcaggagctgttcagaatcacacagcaagtaggcgtagagcaggcctgaccaggagccaggtcccagggtctgtgccatgggccccttcatggcgtgtccaggggatgacaatgcaggttccccatgtgggtgtgaagagggctacacgttgctgccttttgaggggcattcgggaggcaggatctgtaggaactggtgaccggtgagacgcagcacctggtgatgaaggggcggtgtgtggcctgggcggtggcagtggtggccgttcaggaaggggctgccaggaggcagagggtcccgaaggccgggtgcttccccagggaaggcgctggtcctgtcgtctgtgtacccatcatctgccttctctcctgactttccctaatcaaagctggacactagctgaggatgttctggactcggggcgtgttttgtggcccacaccaggatcttcctggcagtttgtgctgatggcactgcctccaggttctcccttcttatccggtctctgcaaagtgcatggaattttcacaggcacgctttaagattcaaagtgacactgaatgactggttccagtcatcaggatgctgtgagctacaaagctgatctgaggatgctttgctttgcacaggtaccagcgtggctgccgatctttggctgcaaatctgcagctcctcactcagggtcagagtgagcagaagccactcatcctgaccgaagatgacgacgaagatgacgacgtcccagagggggtggagcgtgtgataggtgcgtggggtctaagcggcggcctctgctcttgggcaccgtcgggccaattcccctctactccaggaccacacttccttcttccttgctggtgctggcactgtctggccacccgtccccttcgctgagtgcacggtcactgcccgtcctctggctcctgaacccaggcctgtccctgaccatggacagtctcttcctgtgtgccgtagaagccctttttcccaccgcctcgcctccttcctgacctgggctgcctgttctgggcagctgggtgtgtcctcaggaaacagttctcccaggaaattgagttggggtccctggggctcaggtctctggctccttggcccctaaaccctgctcagttccttacctcaggagccatttcaaactcccttaaaccacattacaccttgcaggggtctccatccactgccctgttctcctcctgtggggtctcctgctgcacagagacagagccatcagcggagcccctcatggcggccatcctgggctcctgtccacacactgtcctgccctcctgccgtggttggatgaggtcttccctggacccaggcagggcctcttcatgtcccctccctgtgaggcccccatcctcccagtatctcccagcttcctgatgggcaggcggggccacgctgcctgtgctgtgctgcactctgctcacatccccgccgctccctccagggcaggtttctccccagtcatccgcaccccacctcgaccgtgaccatcagggcgcctgtggcaccgttgccagccccgagccagcatccactccggcccttcccttgacctttgcttctcagagccctccctggttgcgtggtaggcgcccgcatctgtgctgggcggctctgagtcccgggcggggccctgggtctgccccttccccgtgtccgcagcctgccccaggttcattcccgtctcccacccgctgcaggcagtcccccctgcccgcattccagctgctgtgctggctccagactgtctctccaccctcccctgtggtcactcagcgagcttgtccatcagggtcttcccagggctgcttggtgcccacaggcgaaggcttcacccttgctggggcttgcagggccctcaccgtgtgacctgacccctccctgcatcctctaggcttctgtgtggttcttaaaagttcagcctgccgccaaggcctggtccctgggagagacgtcttcgtgcagccgctggctgggggttttctctggaagcttcccagcccactttggtcacccgtgagctgcgggctcttcccctggcctgggtggggcccttgatgttggccttcccctgggggcaggcagctgctccctgtagccggctttaatggggtagatctctttcttaggaacagagaacttgggaacatggctgtatgtgatgatttgagaaaggagggaaggaaatgttcttttcctgtcattaaaattaatattgttaatgtaattcccttcggcgtgtgcactgagtagcgtacaggatgggtcaccttacagctgggaaactaggaactttgtgtggactctgtcacgcatcaccttcctcttcctacagagcagctgctggtcgggctgaaggacaaggacacggtcgtgcggtggtctgcagccaaggggtaggtgtctgtggccgcagaagcaccccggggggtgggccggcctctcctgtgcgattcagcagctacaaatacccaacagctttggagtggcagcgcggccccctcctcggccccctccaacttatgtgtgttgctttacgtgttggcgtgaagatggttcccgaggcggagcttcggtctcctccgtcctcctgcctctggctggccctgccgggtcacgagcaggccgggtttacctgtctatcttcaaaatgttcccttgcttttccacatcctcatcactgtgccccccacctatcgttccccacagatgggggtcacggctcctacaatgacggtgctcagggaagagccctcttttgtggggtgagcaggtgccagtccctcattcacccctcactagcacctgtcatacctgtgggagtcgacatgcaccctgcaccccaggcctcagtggaggtcgtggggcagatccagtggggcctggccttgaacacaacaggtggagccctggcctggaggagccggtggccctgtgggctcgggctgtgcagggacagcgatacacgtgaagaagatgctgaagtgtcggggaggcccctgctgtggaggagaggaggcaggtgcaggggccagcaggtgctgaggtgtcagggaggtaccttctgtggaggggatgaggcaggtgcaggggccagcagatgctggggttgggggaggcccctgctgtggagaggatgaggcaggtgcgggggcagtaggtgttgaggtggggggaggcccctgctgtggaggggacgaggcaggtggaggggctgacaggtgctggggggcggggaggcccctgctgtggaggggatgaggcaggtggaggggtggcaggtcctggggggcgggttggcccctgctgtggaggggatgaggcaggtccaagggctggcaggtgctggggggcagagagaaccctgctgtggaggggacaaggcaggtggaggggctggcaggtgctggggggcagagaggcccctgctgtggaggggatgaggcaggtgcaggggccggcaggtgctgaggtgtcagggaggtccctgctgtggaggggacgaggcaggtggaggggctggcaggtgctgaggtgtcagggaggtccctgctgtggaagggatgaagcaggtggaggggctggcaggtgctgaggtatcagggtggtccctgctatggaggggacaaggcaggtggaggggataaggcaggtgcaggggctggcaggtgctgggggatgaggcaggtagaggggccagcaggtgctgggggacggggaggctggtttttgccattgctctcccatgcgtctgtgctgggtccgtccataccatgatctctgggaggagctccacagggctgtgcaggggctcacataggcctttgtgttgctgtacgcaggggatggcttttcagcccagagcctcgtctggttgggtgtgatgggcccacgcagtgagaggctgggcaggccttcccagtgtccttcctggaggcccctggccaggaccttccccacggggccatctccagggacttggaccctgtgagccagcctcaggcggcctccatgtggggccgtgagcccgtcacctggcctgatgggtgcctgcacagtcagcgtttggggtggcacagaggaagcccggctctagtagggagggtcagggtgaagccctcagcgttcgcctgctgcctcggtaccctcagccgtcactggtggcctgcagcgtccgcgttacagtggtacatggtgacctgccctgtgccgcgtgtgttcactcgtcccctttgaatctggctgcaggctcctttaccctgcagcgtgttttagcgcgggggctccaagcagggtgcgggcttgcctggagttggcctcttctctcctggtctctggaggaaaggatgggtgttcaggccattcacacgtgtcacgcatgcccttggcgacaggctggtggtgcccctgacggattgctgcgtttctctttcagcatcggtaggatggctggcaggcttcccagagccctggcggatgatgtggtcgggtctgtgctggactgcttcaggtatgtgagaagagcaggggaggcgtgtgggcctgaccctgagttgagaagccctggctttccttatatcctttcacgcttgcttttcattgagctgtttgtcagaactccagaagctcttttttcccccttttgaagttaaacttgagaactcttgttatttctggtatgttgcttttatcaattccattctatttaaaaaccttaaggaaaaagagagtcagtttagacatatacccatgtagatgtttattctgaaaggaaaagctctactgagtgagttggggctgctccgagagctttctgtgggaggttcgggtctacccctcgcctacccattagccacgtgtatcactcagaccttgaagtgaggctggtgtgaccaaggcctgagtttgaattggatttcattttaacgaaatgtgaggctttgggaggccaaagtgggaggacggcttgagcctgtgaattcgagaccagcctgggcaacgaagcgaaaccccatctctacagagagttaaaaaattagccagacgtggtcccagctactcgggaggctgaggtgggaggatcacttgaggccaggagtttgaggcttcatgagccatgatggtgccactgctgcactccagactgggcaacagagtgagacccggtctcagaacaaaactgagtgtagacagccacgtgtgctgtgccgcatttctcttgtcagccttcagggagttctgggtcttgggaccgtgtggcttgtgggtggtagagttgtgggctgggatgtgcgggtggcagggcctgggatttcagcctggggcctgcagacctgccctggtgtgctcacacgtgtgaggcatcgatctgtgacctccccagggaattctcccttttgcttgtgtaaatgtctctcccagtttcagaagcggagggtcgagagcaggcgtccagcttgctcaggaccccgggcgtgctgttgctcttcattagcctggacaccgtggcgaaagctgtgctgtcagcactttggaggctccagttcgcgttgcctgtcagtcaccagggacagctccggagccgttcacaaagccttgttttccttctggagcagatttcttgtgcacttagcctccagcctgctcagtgacaatttcaggagcacaggaaacaatgtgtcagatacgggtcatgtttttcagagcagtgtgcatgcatgtgtgagaaatattcttccagtggaaacattgctagcagaaaacatgctctttaccacaactgcttgatgggaggcaggggttggagggtgctacgtgcttggcttctctgtaggcgacctccagccttgtttcaggcgtgtccctggagctcctttctggtggtcatggtgggcatatgtcctcctgtcgcctggtgccacctgcggccttcacaacagtgtggtgggctccaggccgggcctgcctgtgcctgtctggactttgcctctctcctccagccgctgggcggcctgctcatcaggcctagtgcgtctcctaaactcactgtgtgtctttccctccacaacgtgcagcctctctggactgtgtgttccttactctagctcaccttcttggtctagtttcatttttcctggctggtttaatcttcaggtgctttttaacctttatttttgttattttaatgtgctcattccatttttgtagctaggttctgggacggggtggcctttttactcttgatttcgcagggccttcatcccaaagtagctgcagggccatcatcccgagtcctcgcaggatgcagctctggtcagtgcctgccttcccttttcctgggtgctcagtgtgtgattgtcaaccgtggcataaaaaggcggctctggacagcgcctgctttccctttcgctgggtgctcagcatgtgattgtcaaccatggcataaaaaggtgcagcctcagagcaggatgtctgaagacaccaggaagccaggagttgctggggtgtggggcggcccacagccctgcatggtggctgctccaatcttgtccttccctgggacgtgtggtaagctgccagcctcttctgaaacgggtccgagaaagggcattaattatattaactgtaagaacacccagcacccaggagggttaacttactcccctctcctttcctgggctgggttatgcagtgagtggaactgcacccatccccagggggttcaggatctgtgtggctgatgtggctgtcccccaagcgtgcacgactccctcaggacctggggccccctcctgactcccatcaccagccctgcagcattaccctggacctaggaagtagcgccagaccccaggctgtggcagaagcagggtgccttggagaggagtgtgtctgtgtctgtgccaaccccattggtttctcctgtgagcaaaccaactgaacctgtgcccgggcccagctgtgggtcctgctgacttgcccgagggcatcttctgagacactcggtgtggagcgtctggaagccacggcactacgctgtgcctccccctcgcccgccgccccgtgtcagcaggagcctcaccacgtgggttcctttctgttgagctttacggtttcatcgaggttttggactgggtgatgtgttcattcaaaagtcaaaccaaagggaagaagacagcctccccagaccccagagcccccccgcaggtgacctggggcacccgtttcgcatccctccggggactgatgcaggtgtgagcagatggatacagaggttttcttgttttgtttttgagatggagtctcgctctgtcgccaggctggagtgcagtggcgcggtcttggctcactgcgatctccgcctcctgggttcaagccattcccctgccgcagcccccaagtagctgggactacaggcgtgcaccaccacgcttggctaattttttgtatttagtagagacggggtttcaccatgttggccagtcgggtctctgtctcctgaccttgtgatcagcccgcctcggcctcccggagtgctgggatgacaggctgagccaccgcgcccggctgttttgtttttagagatggggtcttgctctgttgctcaggcaccatgatagctcactgcggcctctacttcctaagttcaagtgatcctcctgcctcagcctccgagtagctaggactataggtgtgcagcaccacacctggctaattattttatttcatttttgtagagatggggacttgctatgttgcccaggctagtcttgaactcctggcctcaagcagtcctcttgcctcggtttcccaaagtgctgggactatagacctgagccctgtacctggctaaaattgtctctttcattttacacagataatggcttacttgtcacactttaacaccaaacgcatctttgaggtcattttacattagtgctgttccccttgctcttgatgatctgagacccgtgtacctgcgacactctttacccgcctcctctctctctctctctcttcctctcccgctcatccgcccactcatagcttccactattttctgttgtcttccctcctctgagaccccccctgtgcttccaggagtgccttaagcttggatctgagggcaggaactcgccccggctgcttggcttctccctgtgcccctggtgtccatggacagggtcccctgtccggttccactgtgccgtggtggtgctgggcctctgaggcgagccggatggacggacggcatcccctggaccctgccacccttgccaccgtgccacagtgaacacgtgtctgatttagaagtagacattggtctgacaggcatttgttttggtatttttaagtcacggtaaccttggtgttttgtcaagttcattcagatgttaactaaatctttgtgaaaggtgtgaagcatctttctccaatgaaaaccctaaaggacgcaagtgctgatgtgaaaatacgcaaggggctcacggagcctctgggcagacagtacacgtctggaacttgtttaattgtgattgagtctgtcggtgacagtgagctctgaggagcccgctggtggacgctggtgtctgtctcagcccctcctctctgggctgggcacgcaggaggtgaggcagccactgggcggacaggcactctccgattttcctaagtattcttgtccatactgattgccagctagtcatacaatttagtgggttttcctaaacatttatttgctgtcaagtcaatttaattagaatcaggagagcttctgaaccaccccggggaaattagtacgtataaaatattatgacttgatcgatggccattgcaattgttcattaaaagttcatatttcaaatactgtgaaaaatcttgaaatgccaattcattattgtagcatttaattctgagtttgactaaacagtggggtgtcatttaaagaaggtcttcctgctcccttttccactgacgtcttcctgtgctgggattcctgttttaagttcctacttttctgaagtgtcttatttctttctatgggagcgtgggtgttgcccgtacttggagcgacaccactgtggtgggaaaaccccacctgggacggcacggacgggacggtctctttgtttggggactgaccaagacttgtcctcactctcgggagatctgaagaggccctggggtaggcacggctgttgtcttcatactcagttgcagtgtgttatttcttcagccaactgattatttgtttttttattttgagacggagtcttgctctgtcacccaggctagagtgcagtggcgcgatctcagctcactgcaacctccgcctccctggttcaagcgattctcctgcctcagcctcttgagtagctgggattataggcgtgagccgctgtgcccagccttgatactttaaaaacttaggaatgggttttagtgagccttacgtgagccttacaggcagaggatatggacctgccaggctgtgctccttgccatgctgtgggctttgaaccaaaagctgacacgtgggctgtggtctcaggatctttgttgctctcagtttccaggagactgacaaggcgtggcatgggggatgtctggcgctggcagagctgggcaggagaggcctgttgctgccgtctcgactcgtggatggtgagtagctgaggcacggtcaggggggatgtctggcgctggcggagctgggcaggagaggcctgttgctgccatctcgactcgtggatggtgagtagctgaagcacggtcagctgcgtcaccaggctgtccgtggcaggctgcagcccttcgtctgaacccatctccgcggtgtggccctgccgcgggcacgcccagaagagcttgagaacaaggtctgtctacctttttctcgcattggcctttgtaatttcctaattgcctcttttgtctgctgtggaattttaatgccacagattaccctgtgtagctggttttggagggccacgaatccttgtaatgtctgattttcttactccccaaaaccggttttcattcttgagggacattgtcgccccttaaggacacatgcagtggcacctgcttcagttgtagaaccaggtacccctggcagcatcctgggtcacctggagtgacgtggtgctccctggagatgaggctcacgccagcgtgaaaccagggtgggaactggggtggagggccaggggagctctgcagtggccagcagtggggtggggacagagggcacagcatggcagatgcaggggcactgccccagaccagctcttgtgccgtggccacacgcagccctgtctgtgtttggtggggagagtccctgggtgtggctggcagtgccctctgagggcaggaaggaaaggatgtctgtacaggatagagtgggggcccatcctgagagggcctcaccacagagacttgattctgtccaaaataaagacacctgagatgtggtggcctcacgtcttcccagtgtggagctgtggtggcgtctgaagtgaccgctttgcacttggcattttgatgtatggggagagcttttagagcctgcagttcttttttttaatgtctctgcttatttttttccagacttctttaatgtttagacctctttattgcgatctaatttacatgccataaaatgcactcatttaagtgtacggttaagtggtttttatatatttacagagttgcgcaactattgccataatttaatttccgaacattttcattgcctccaaaggaaccctgtgtttaagaactcactctttactctccccagcacccccgccctggcagccatgtctccagtgtctctgtgaatttgtcttttatagacatttcctaacagtggaacctacgacatgtgatctttggcgtccgaattcttcggctgagtttctctgtgtcgtagcctgtggagtgcctccttccttcctgtggcagagccttgtcctgctgtgtaaatgcaccacacgccacgttttgtccatccttttcatcagctgatgtacatctgggttgtttccacctttcactgttaggttaatgctgccatgaacatcgtgtacacgtttttgagtggatgttgggtgtaggcctagtagaaatgctgggtcatacggtaactccacgtttaactttctaagaacctgccaaactttttccaaaatgattgcaccatttcaagttcctgcctgtagtgtgtgagggttctgcttctctgatcctcaccaacacttgcttttatctttttttttttggacgcggtttcactttgttgcccaggctggagtgtggtgatgcaatctctgctcactgtaatctctgcctcccaggaccaggcgatcctctcacctcagcctcctgagtagctgggaccacgggtgcccaccaccatgccagattaatttttttttttagttttgttagagacagggcttcaccacattgcccaggctggtcttgaagtcctcagctgaagcagtccacccgccttggcctcccagagtgtggggaatacaggcgtgagccaccacacttgccccctgcttctttaaaaaaaaaaaaaaaaaaaaaagccgtcctagtgagtgtgaagcgccaccttgttttgcttttcatctgcttttccccagtgactgatgacactgagcattttctgtgtttgcccgtttgtatgtcttctttggagaaatgtcttttcaagttctttactcatttaaaaaaatatttttttaattgttgttgtaagtaagagtttttttatgtattctggatataagtctcttattggatatatgatttgcaaatgttttattgcgttccatggttgccttttcactttccattgattgattgacagagtcttgctccgttgcccaggctagagtgcagtggccccatcacagcttgttgccaccttgatctcctgggctcaagccatattcccaccttagcttcccaagtagttgggactacaggggtgcaccaccatgcctggcaacttttttttctttttttgagacaggatctcattcccatcgcccaggccggagtgcagtggcgtgatctcagctcactgcagcctccacctctcaggctcaggcggtctgcctacctcagtcccctaagtagctggggctacaggtatgtgccaccatgcccagctaatttttgtattttttatagagatggggttttcccatgttgtccgggctggtctcgaactcctgagctcaagcgatccccccgcttcagcctcccaaagtgctaggattataggcgtgagctactgcacctggccttcatgcctggctaattaaaaaagttttttgtagagatgggggtctcactatgtggcccaggctcgtcttgaacttctggcctccagtgatcctcctgcctcagcctcccaaagtgctgggattgtaggctgtacctggtgtgttttcaatttctttgatggtgatatttgacccaggttttaaattttaattaagtccagctcatcagtctttttctttcttgtgtttctggtgtcatagctaagaaatcattgctgaccccagaaccatgaagttgtggtttcatttaacgttttgttccatccgaagtaagtgactcgtaatgtttatttgtgacactagatgtgtgtgagggtgtgtgtgtgaatgtgtagctgggatggaatgaagtccctgcctgtggggagccagctccaggttcactcaaaggagacaagagactctactggcttgtgtgtgtgctctgtcatgtcttatggcaacatgcactgaccccaggcagctggggcgagaggatatgggtgttggcatcataaacgaaaagggtaaagctatggttcagaaactgatacgtgatgtggaatacactggcccatgaccttcgcatggttggttggccccttctgcctggcggtgccctccatgtgagctgaaccctctttgcagcccccattctgttcctggtgggacatggagaagctgtgctgtctctgcacagggcaagggttctttcaggcaggggtgaaagagatcccatcttggggctgactcaggaggtgacagggctgacatttgatgagcatttgcagcatgctttttatgtttttgttttagacctcacaccattcctctgagagccgtcttgtttatataaagctatagttgggagccacgtgtggtggcggtgcctttaatcctagcctcttgggaggccaaggcaggaggatcacttgagcctaggaatttgataccagcctggacatcatagtgagacaccctctctgaacaaacaaacacacacacacaaacactgcagctgtgggagccaggaagtctttctggtgtcacagctcatgctcagcccttcggcctcctccatgtcacacggctgagctgtccctgcacctccttgtctccttggagagttactgtggttctctgtcagtttggtttgaaaagtgaaaacaggctgggcacggcggctcatgcctataatcccagcactttgggaggccaaggcggggggagcacctgaggccaggagttcgagaccagcctggccaacatggtgaaaccccgtctctgctaaaaatacaaggatgtggtggtgcatgtctgtaattccagctactcgggaggctgaggcagaagaatcgcgtgaacccaggaggcagaggttgcagtgaaccgagatcgcaccactgcactccagcctgggtgacagagcaagatcctgtctcaaaaaaaagaaaaaaaagcgcgaaaacaaatgcttggcaaataaatgtcgtagaaagacacaatatagatgagcatgtttgatgactaaagcttttgtttgtcttagaggaaatgtggagcttcattggtgcatgctaaaggaggaagaagtaaaactagggaagtcaggtgggcaggcagtgatgcgatgtttgcctggaaggcaccctgggtctttctgcccttagtcctctgaatagggggactctgcctgctggactcaggaaaaaagcatcgcattttctttgggttactttttagggaatcctgctgattcctctccacacatacagtgcacacacacacagaatctccatctgttgtgctgtaagcctatttcttggtctctgactctgtgcacaccaccacgcccagctaattttttaaagaaattcgaaagtagcctgcgcaacaaaatgagatcctgtttctacaaaaattgttttaaaaaggtagttgggtgcagtcccagctactcaggaggttgaggtgggagaattgcttgagtccaggaggttgaggctgcagtgagccatgatcgcagtgctgcactcacgcgatcctcctgcctcggcctgtggacagtgggccatgttctttttctctttgcatcatcacctctgtttgaggactactgttaaagggctacttggtctttattttaggtgattcaaattccaggacttttcttgagtggtcctggcgtaggtcctttcaccttttttgtggctcctctttgaacacctctgttgttgtggcaggaggaggtgggcactcctcaccatgagtaagctcctacaatgtttgtgaacccttacggtttcctttgttggatacaagaagcacaggtggggggatgtattggtttaagtttaccttttttttttttttctttttttgagacagagtcttgctctgttgcccaggctggagtgcagtggcgccctcttggctcactgccagctccatctcccaggttcaagtgattctcatgactcagcctcccgagtagctgggagtcaggcgcccgccaccatgcccagccaatttttttatttttagtagagaccagatttctccatgttggccaggctggtctcgaactcctgacctcaagtgatctgcctgccttggcttcccaaagtgctgggattacaggcgtgaggcactgcgcccagccaactgtactattttgataaaatgtatacatgtgctccttattatgcattttgtggttttcatcagtattttgctttttgaaaaatgtcaagtgttctgatctctttggacattttgtatgaaccctatttcccttgctatccttattgattgagaattgtgcatattgatttgggtaataataactagcacttggtgtttttctgagcttggatgtgtagattcatgtctttcatcaaactcgggtagttttcagtcattgtttcttcaggtatttttgctgcccctctcctctccttgtgggactcttgttatgttaatacacatgttggtactcttggtggtaccctatgagtctcttaggttttgcactcatttcagctcttgagtcttcttgttatgttaatacacatgttggtgcgcttgatggtgccctatgagtttcttaggttctgccctcatttcagctcttgagtcctcttgttatgttaatacacatgttggtaagcttgatggtgccctatgagtctcttaggttctgtgctcatttcagctgttgagtcctcttgttgtgttaatatacatgttggtaagcttgatggtgccctatgagtctcttaggttctgcgctcatttcagctgttgagtcctcagttccagaatttctctttagtttctcttttaataatttctttttgagacagggtcttgctctgtcgcccaggctggagtgcagtggtggtatcacggcttactgcagcctcaacctcccaggcccaagcagctctcccgcctcagcctcctgagtagctgagaccacaggcctgctgcactggaaaaaaaaaattgtagaaacaggatctcactttattgtccagactgctttcaaattcttggactcaagtgatcttcctgccttggcctgccttgggattataggagtgagctgctgtgcccagcctgtttttataatttctgtctctttatcaacattccatgttagtttaaatgttgttcttttggtctcctttagttctttgtccacagttttcttgagatctgtgagcatatttaaagctgttgatttaaagtctttgtctaagactgagcacagtggctcacacttgcttcccagcacttaacctttgctttaaagcctaaaaaggaagaaatctttgcatatgtgtttcccaaataacagatttgagggctgtgttggtgacataggtctgtttatacccactgtgtggctaaagcaggtctctgttaaattagcatctacaaagcttttctcctgccttccctcaaacttaggaagctccctatgcaatcttcaggctggggtccttcactgccccctctcaaggaggcctaccccttcccccagaaggtgcagtctgtcaccccatgtcttataaagtgtaatggtctggtgtcccaaagccacagagaagcccattctaaccttcctgcaactttctgaaggttggagagcatgtttgttttactgctaggaggctcaaggtccctgtgaacctgcatcaggtagtaagccctgcatgtcggaaatacagactgcctaactcttatctaaggtgatgttttgagaaaatttttaaatgtataatacattttataaatttcgaaaaaattttaataaacattaaatttttataagtttatataaatgttataaattttgaaaaatgtacagagttgcattggagcacacgctctcagtgttcatcgaagacgtacaagcagcgtcttacgacgatgttgctgcagctgccttggggtcttgttaaaagcaccattcagtagattaattcccacctgtggactgtgttttctggcttccaaaagaaactgtcatgtttttctctctggatgacgaaaactctgcacgtacttcctatgacaagtgcgattggcgcccactgctcttggcagttgaggtgaggacacagcgtttctgtgacggtgaaggggacagggtttggagggagattcagacattaaacaaggaaacgaagggagcaatttcagagaatggataaagtcgttaagaaaatacaaaagggcggtgagatcctcagtgatggggccaaccagtgacttgaataagacttggggaagacctcctggggcgacatttacgctgagagcttctaccgtgaaggagccgagcaggatggactcctgaccgcagcatctcaaagaggaacgaaggctcgcacgagctgggacagcagaaagagcagaagagtgggcacagaaaagcgcctgggggccagatcctagaggggcttcaggaacacagtgaggggtttggaaattattcaacataaagtcggatactggggaatacacgggagtgcagtggaaaggaagagcgagggagagtgaggccattcgggagccaccacagtgttcggagtgagaccagagctgtgaagaaagagaaaaggaaatacgctgcatgtaggattctgaactcaacgactttgctgttctattcagtgaaagagagtgagatagtaaggtcagtgagtgacatgttggagccttccacatagtaatggtctacaaagttatggattgatgagttcacacaggagggagtgagagatgaggaaggtgaatgggtggaaaagcttgaaccgggttcccaggctcactggcatggggaggtggagaaaaggggaggaagcagccgacatggaaacccgcagaggctccttcagaagggatattttataggagaggagtccgattctgagagggggaaggggtggaggaccagagtttcctcacaggctctggagcactgaggtggatggtaaattccaggagagcagctccagctgaggtctagggacagggcattccctccctggtagagccgttggggctcagtgccgaggctggctcaggctcttgtggggggccctgctgtctgtccagccctggctgtggcctggcctgaccctgctgccccctgcaggcctgtgtacctcagttcccaggtgatcaaggggccctgggagaggttgggtctgagcacgtcctgacatggccccagtgtccagttccccgcctgtttttgttggcttgtttaatcttggtaggcttttaagctttcaggttttcaggaaaatgcaaagcatgagacatctttgactttgtacgtggaccgattgttctttttttgtgttaatggtgtttttttccttgtgtgaacgtgtgtgtttcgtgttgcactccgccctgctctccctccctccctccctgtagaacgtggcattttggctgaacgttaacactggtgggggcagacggcagtgggcccccgttaagactgtttagaaagggcgttgtcggcatcttctcttacatgtgaattcaaggatcctttattttttttcagctttattgatatgtaattcgtctaccatataattcacccatttaaaatatatagttccatggtttttagaatattctattattacttagaaaattgtggcaaaatatgtataacaaatttgctctttttattattaagcatgttaatccagtggcattaattacactctcacttttgtacaaccatcaccattatctggttccaaaacttctcatcaccccagattaagaagtcactcgcccctgatgctccttcccttcaaccctttgtaactctagtctactttctgcttgaaaaaggactttgcctgttttagagatcttgtacaagtggaattggacaatatttggcctttcatgtctggcttattttatttagcatcatgttttcaaggttaatctgtgttgtagcatgtatcagaattttctttcttttaaaggctgaataatatttcattgtatggacataccatatatttatttattttatttttacttttatttttatttttttttgagacagagtcttgctctatcacccaggctggagtgcagtggtgcgatctcggctcactgcaagctccgcctcccaggttcacgccattctcctgcctcagcctcctgagtagctgggactacaggcgcccgccaccgtgcccggctaattcgttttgtatttttagtagagatggagttttatcatgttagccaggatggtctcgatctcctgacctcatgatccacccaccttggcctctcaaagtgctgggattacaggtgtgagccaccgcgcccgacccatatatttattttttaaagataggatctcactgtattgtccaggctggagtgcagtggctattcacaggcccaatcatagtacaccacagcttccaactcctgggcttgagcgactctcccacctcagcctcctgagtggctgtgattgcaggtgtgcaccaccgcccctggccatattttcttgatccattcatttgtcagtggacgcttgggttattcccaccttttgggtattgtgaataatgctgctgtggacatggatacaagaacctgtttgacacccctttttttagttcctttgggtatataccctgaagtggaattagtgggtcatgtggtaattctatgttcagctttttgagagcttatcactttttgtatgtaaaaattacgagtgtttagttcttaagtcggatcatgcataaatgcagaaacgtagttaaaaaataagtctcttttttttttctttttgctataaagctctaggaatcgattttgcttttagagatagacacaaagggcttatcctggttgcaatgggtgagctattgcagatgacctttggaggaattgtgtcggagtgtagaattttcacagtgtagctcgccatgcatcaggcacatgtagcctgtgccacaaccattgtgcttgggcggggttctccatgctgccctgttgcaggaggatgctctgcccctgcttctccctatttgtcatttaagatgattcctggtgctttttggtgagcgatcaaatggtgttctcagaatctttgggcccttgacaacggagggctgtattcttgggggtgtgatgtgagagctccttgtctgcagggtgtgaggctttgggtcctgagtgtggaccgtggcatgtgatgtcttgtcacggctccctgcacggctgtttagtttctgaaagctggaagtataatatttttgttctttgccaaaacatactggtgtatataaacagaagtgcccaggtgagcgactcagcactgcgcctgtgtttatggttctgcgtctgaccgtgtgccttttaggctggtgtagtggttgtctgaggtgggtgcctgacagggctgggggacctgctggtgtccttgctgctgctttagggacagcttgaagcagtgtcctcagataccccttggaattgtgacaaactctgtatccctcttacaagttttatagaactctaaccagttgcaaataactatttgccatcctgagtattgtcattttaaaataaaactattgcgtcactcatctgaataaatctgggaaattgaggtagaataatctaccattcttcgttaaaaaatttacagggctgggcgccatgtctcacatctgtactcccagcactttgggaggctgaggtgggaggatcacttgagccccgggaggttgaggctgcagtgagctgtgatcgcgccactgcactccggcctgggccagtgagcgagaccctgtctaaaaaacaatttcataggcaagtttttctctcacagaaattttattcttcctttttcttcttaagcccatatttccatttacttttttcccagagcattttaccctaatgtaatgtatttctgtgcctaagaatctttattgatctatcatttatctgcaacgaaagaaaataacataaacataaacttcaacttttgcattttgtatggccataagatgctagttatttatttattttttccacaggtgttcatgaccttttttttttattatttttttaactatacttttaagttttaaggtgctagttacttagaagtttttttagattgggttttaaaaaattatgagtacagagttgaccaaaacaacataaaatagcatattattgaaatttagctcttaataagatagctgtttagtttgagttatcttttgatgagtcaggctttttttgtttttattttttgaaatgattcttgctctgtcacccaggctggagtgaagtggtatgatcttggctcactgcagccttgacctcctgggctcaagcaatcctcctgcctcagcctctcaagttggtgggactacaggcaaacatcccattgctcagctaatttttgtattttttgtagggatggggtctccctgtgttgcccagactggtcttgaactccttggctcaagcagtcctctcacctcagcctcccaaagtgctgggattatgggtgtgtgccaccatgcctggccgtgagccatgcttttaaccagaataaggcaaggttctgcaacagtacaatttttgctttttatttatgtattttttttgagaaaaggtctcactctgtcacccaggctggagtgcagtagtgtgatcatggctcactacaacctctgcctcccaggctcaggccatcctcccgcctcagcctcccaagtagctgggaccgcaggtatgtgccaccacacctggctaactatttttattagagacggtgtttttccatgttgcccaggctggtctcaaactcctgacctcaagcaatccatccgctttggcctctcaatgtgctgggatgacaggtgtgagccactacgcccggcccctatttttactttcagttttaagtgctaagaagtcttattcattcaagtcttattcaagtagctaggaatggcagaaattttgctttagcaatgctggtgtttcaactttttccaagctcacgcctgacctctgtgctctgtcactgagcagcttcagtagggtggcctcagtcctgtgaagtgatgcgttgacagccacctgcatggggaagcatttcccagtctctggagcagttcccatcgtagtgtccactgcatggtttccagtgtgttgggtgagaggctgcctttcttgaaaagtgagagaaagggctgttgtgagaggggacatggggatggagaaaccctttctcaagcagagccttaggggctgaggctccggaagtctacgctcctaaagcactctgaagcctgaggaccccatggatggccattgagtagccccaggggtgcttcgcacatgccggtacttgaccactgctttaaacccatgtgcacacatgcacgctcacacacatgcacgatgcagaagtgcatacacacgtgtacatgtgcacactgacacatgcacgttgacacgtgtacacccaatcgaatgtgcacaactacccccacagatagcacacacccacacaatcgaatgtgcatacacccacagatacacacacgtgcacacccgtacaatcgaatgcacacatccgcagatatgtacacgtggacacccacacgattgaatgtgcccccccacagatatgcacctttgcacacccacacaattgaatgcacacacacccccccacaggcacacgtgcacacccacacaatctaatgcacacacacccccatagatatgagcacgtggacacccacacgattgaatgtgcatacactcacagatacgcacacatgcacacccaatcgaacgcacacacacctgcagatatgtacacgtggacacgcacgattcaatatgcatacacccacagatacgcacatgtgcacatccacacaatcgaatgcacacccccccgcagatatgcacacgtgcacacccacacaattgaatgtgcatacacccacagacacacatgcacacccgtacaatcgaatgcacacacccgcagatatgcacacgtggacacccacacgattgaatgcgccccccacagatatgcacatgtgcacacccacacaattgaatgcacacacacccccccacaggcacacgtgcacacccacacaatctaatgcacacacacacccatagatatgcgcacgtggacacccacacgattgaatgtgcactcacagatacatgcacacccaatcgaatgcacacacacccgcagatatgtacacgtggacacgcacacgattgaatatgcatacacccacagatacacacacgtgcacatccacacaatcgaatgcaccccccccgcagatatgcacacgtgcacaccggcacaatggaatgtgcccccccgattgcacacgtgcacacccacacaattgaatgcacacacacccgcaggtacgcacacatgcacacccacacaatcgaatgcgcacacacctgcagatatgtacacatgcacacccacagaatcgagtgtgcacacacccatacataatgcgcatgcactcacatgattgaatgtgcacacacccagagatgcacacacacacatctaatcagatgtgcacccccacacagatatgcacatgtgcacacccacaggatcgaatgtgcacgcctaatcagatgtgtacacccctcccacatatgtacacatgcacactaacacaaatgtgtacacacccgcaggtatgtacacatgcacacctacacagtcgagtgtgcatgccccccacggatatgcacacgtgcatacccacacaatcccatatacccacccccacaatcacgtgtacacacccccgcagatatgcacacacgcacacccacaggatcgaatgcgcacacacccacagatagcacacacgcacacccacacaattgaatgcgcaccccccacagatatgcacacgtgcacacccacacaatagaatgtgcacacacccgcagagatgcacaagcgcatacccacacccgcagacgtgcacatgcacacatccacacgatcaaatgtgcacgtgcatctgcagacatgcacaagcagacacctacacgcactcgcagacatgcacacccacatgggcgaatgtgcacaccccccccacacagatagcacacgtgtacacccacacaattgaatgtgcatacacgcacccgttcacaggttaatcgctgccacagctatcagctctttttcattgactgttacggcaaaatattctaaaggataacatagatttatgtttatttgcattttatgtttccttatggttcatatgagtttattggaaaattagcaacatacacatcattttggggaatggaaagtgaggcagagtaagccagaacattcactgtaacattataagcaagtagaataaattgataataccttcaccagtaatgcactttccctagtggaaataaattatttgtataaatagcctcttgatgtttgtgtgttatttagttatacaaatcacatttttcttttttacatatggcactttaatgttagtactgaaaatgttttttctgacattttttcagtaattgtcatttacatcaaatatgcagctagagctaatagaaaaacagttaaaacaatttgttgtaatggtgagatatttataaggaaacatttataaaagatcttctgtaagacagcttagacttgaaaatacatatcagtcttagagtcattcaggtgtttttacaaccaaaagtagaagcaccttttaatattcatgcttaatatttataaaaactgaattggagggttttttgtttgtttgtttgtttgtttttttgagaagcagcagctgcatttgtaaaaatgtgaaagtgccagttcagaggtgttgtagcttgccaccttggaaggcgtgtgtgtggccgtagctctgtgaacacacgtgtgaacccggcgttaggacacccgggccctccttcgtagtgtgaacactctggccgtgtcctgcagcttcgccttcttagctccttgctgggattttccagcatcccttagacttgtcctcttttgtcctttgggtctgaggtcacactgggcctcttggctctccatggagctcagtgtgggtgtgtcttgccggcaggcaggttccggggccgcagcatccccatcgcccacccggatgttcctggggctgtaggccgccagctggcacagggccacggctgccgtctgcttctgctcctcgctgctgtccaccgcgcatgcgtctggagcctcctcgccggggcctgtgggtggggccccgtcaccgtcgaggctgcctggcttggtctcagggtggctgggcccatcctcagaaccttctgtcccagtcttctgtggaacagcagcagcaggttccgcagctcgtggtcgaccggggaaggcgggcctcggagcctgggtgttacaggggtccttcaccgagagattgagtggaaggtcctgcagctctgagaagctggcggtttccgcctgggggctgccttggtacgtgggttcgtgggtggctgccaggtttatctctgatttcttggagaggttgagggggcccatcccggagctgtcgtccggactggaaggcgcggcctccgagacgagagaggcgcttccggtcggagcaggagggtctccgttcacaacattgaggctagaagaagccaagaaaaagcttagtaggagcttgcttagaaaagcaactgcgtgaagcagtgtgagcaagtataagcctggctcatggaacccaaccagaaacattcccttggaggttttgaaaatgacattttcttaccttactggagactctgctgtggtctcagcagcctgggcaggtaggcattctgtgcttttcttaacaggcctgaaggctgtgaggctttgctctggcgggtagagtcttcccagtgcgctggaggctgccttgttggagaggtcgtacaggccttcgcaggtctggctcgtctgcatgaagtcggtggggctcggcctccctggggagcccgtggctgcactccctgcgcgggggctcattttggacccttccgtgtctctctgcccagccttggaggagtctttagcctcaggaattggactttcgaactcgacgtgttttctgttggggtccgaagggtttaacctggaaggactcgaggctggatagaccagggtggcttcttcaagcaggtgagagctctgatctcgggtgaggccagtgacaggtgggagtctgagaccataggaggaaaatgcagactctggcctgtaaaatccgtaaggaatcggcaggttagagggatattgctggaaaaacctgtagtgatcgtatgtggctggagatggagccaggtgcttagggatcggccccgggtgaggcaggaagtgtctcgggtcttgggttccgtagactgacagcaggggtgcgtcacactcaggcgagctcccagccagcaggtaaggcgagtagatggtggccagcccgtgctctgtgtaaaagtgaggcgggtactctgggattgtggggtgcatgtaaggggaaatggccccaagcccctttgtagatgagattttatgtggaaactctggtggaaggaaaggtgagccggctttccaggggtagccaggagtgtggaaggccgacttggtgtggaaagacacggccttggcagtggggttgtgtaaagccagtgtctcgggcgcctcggcgttgtctggccccttgagtctgtgctcgccgactggaacaaatgcagaaggccgagctgcgccttccagagcaggctgggcaccgagggcggcttccggagctgggctcttgcagggtgatgccctgtggagggctggcttctgtcccaggcacctgtgggttccccgggcttgcagctccaggttttccttgatgtcttccctggcagagctgtgctgaagcttcgagtcgaaggcagagagtccatttgcgacagacttggaagaggctggcttcgccgtggcatcgggctggttggtttgcttggggtctagtgagttagatttagggcacttgggaactcgatcctgctctgatactaaagtaatcgagtttttacaaagaccatacttcatgtgattaaaaagatgtgacttctcattgcaagtaaagggacattggaaacatttatacttgaagggctttcctggaggcctggggatgtaatgtggcttttttggcttccgctctttgaggagactcattttcctccttatgccttggactctggctgtccaggtggcgtgatcactgtcgacgccgcgtgcacttcgtggtttctaaagaggcacctcccgctttgctttctttcccgagcacttctatcagaagccagctctgcgtgctgagggtctggcgagagcctccgtcatctggcggctgggagctgtaataaagagcagtcttggtgtcaggacagcgagtgaggggtcggcgagaagccggcctcggctcgccacagtgccacaggatccctgaagcagaacccctgaagggctgaaactgcctgctcctgaggggagcagctgccggtcacagaagcagccctgccctacccttggtaacctggctgctgactccccaccgtgttttctgttttctgagtctgatctgaaagagtcacctcggggcctagaggtggagtgtggtgtgtggtgcgttgagtgtctgttctgagaatgcctgtaagcctttgagttttgggaactttcatcctgtgacctggacctttcctcgaaagcgccctgccgggggctgaggacaccgagccccctcccagggtctggacagagtcctgtcccagggctgcccgactctgcttgggggttacacgcttgaagcagtgggtgtgtgatcggccacactctcacgtgaaatacgaaggggtttgtggctgtttccccttaacatgtacccacagtcacagagtgcccctcacttttacacagagcgtgggctggccaccgtctgcttgctcctacctgctggctgggagctctcccaagtgctgtgcgcccctgccgtcggcctgtagaacccaagaccatggatgctgctgcctcccctggggccgatccctaagcactcgtggcagtttctgcccactttagccacgtcgttggtgtattctagtgtgcttgtttaaaaatgaagaacattcgaacacaagactctaccctactgcttctaaagtcagctttatcattaagtagcatttatgttgtctcagatatgaatacaaatgctatatttatgttgacttaaatggttgaaatactgttggtgaatttgtacatcctgtgagtgacagcagcattgtgagacatgctttcacggtcacccggttcctgctggccaggaggcatggccagcagcgcctgcccgtccagatgcaccaccaaatggaagaaccaaagctttgccacactcctgcccgagaggagaccagagtgagtagtatccgctttagagatggttgggtcatgggaggaagctgtcctggcccttaacctttagggagtgggttcagccctctggccacacccactcaggtcctgggacccaccagaggctgtgtgtgtgatgtcagagctggcctgctcttttggattcttccagagggtctctgtgtcccccttaccagcctcaggtttccttcagaggctgtgccgcacgcccaaggctgagaacaaaggctgtttttttttttttgagacagagtttctcccttgttgcccagtctggagtgcagtggcgcaatctcagctcactgcaacctccgcctcctgggttcaagcgattctcctgcctcagcctcccgagtagctggaattacaggcgcccaccaccatgcccagctaattttttttgtatttttagtagagacggggttttgccatgttggccaggctggtctcgagctcctgacctcaggtgatccacctgccttagcctcccaaagtgctgggattagaggcgtgagccaccgcacccgtcccagaacaaaggctttgagagtctgggactgtccacctggcagctgggcctggagcgactcaagcagcaactgtgcctgggagacagggtgagtgggagatggggtggaggtgcaatggatcaaggctaagcactttaattcgtattaaaaatgtaaaaaagaaaaggtctttagggtctaaatattttcaaacagcttaaaaataaagttaaatgacccaaatgcctatcagtgatagactgaataaagaaaatgcggcacatatacaccatggaatactgtgcagccataaaaaggaacgcgatcatgtccttcgcagggagaaatggatggagctggaagccagcatcctcagcaaactaacgcaggaagagaaaaccaaacgtgcatggtctcacccataagtgggagctgaacagtgaaaacacatggacacagggaggggaacatcacacaccagggcctgtttaggggtgggggtcggggggagggagagcattaagacaaatagctaatgcatgcagggcttaaaacctagatgatcggttgatgggtacagtaaaccaccatggcacacatttacctgtgtaacctacacgttctgcacttgtgtcctggaacttaaagtataataaaaaaaaaatacattaaagtaaagttaaatggagggctgggggccgtggctcatgcctgtaatcccagcactttgggaggccgaggtgggaggatcccttgagcccaggagattgaggctgcagggagctgtcatcccaccaccgcactgcagcctggtgggcaacagaatgagaccctgcctcaaaaaaaagctaaatggaaatgacttaagaaaactgtttcaactgcagtattttttttaaggaatgggcagatgtgcccattcttgagtctgcgaggttttatgtgtagacatcagggtggctaaaagtcaagtgaaaagccgccccttgaaaatagagcaacgtgtgtgggagcctaggaggcagctgtccctgaagcaaggcgccacccctcctccctgcacccgtgtccttcctcccacacgccaggggccaggggtggtggctgggctttcatatggctgccccgaactctggggaagtgctctgattttgttctcagcaaactggtttctctactgatttattcatatttctttctttctttcttttttgagacggagttttggtcttgttgcccaggctggagggcagtggtgcgatctcggttcactgcaacctctgcctcctgggttcaagagattctcctgcctcagcctccctagtagctgggattacaggtgcctaccaccacgcccagctaatttttttgtaattttagtagagatggggtttcactatgttggcccggctggtcttgaactcctgacctcaggcgatctgcccgcctcagcctcccaaagtgctgggattacaggcatgagccaccgtgcctggctcatttatttataattcttaaaaacacaaccacccttccccctacaaactgcctctattaacatactttaagttctttaagacatttatttactaagaagtggtttgggtagaaaaggggctctgctgacctgccaccttcgctgtgatgagtttctgtgtagcagggacagcgaggcacggtttggatgaggacaagatgtttgttaccctacaaccagggagggtgtcgggtgacaccctgggctcagaccccgcgctcagcacccgtctcccaccgtgggctgccacagaagctacaaggcaccgggtcaaggccaagcaaatgaaacacgtaatgatagctctgtctttctaatttccccctattagaagaaagaacgtgaaataattctttatgggctcagtccctaccgtgtggggcagacctgctctgggtgatgaaagcagtttccctgcctcccttcaggaagtagagaagccgggtgcctggttccagccaaacgctgggccagccagctcagtcagtggggcctgtgccggcatgcctcgccgcgctccctggttctgaaggcgtgagaacctctgcaagtcaggttcccatgattgtataggatgtgttacggcagggatctgaaagctgatgatttcatcactagctggaagcatcaggatcgaaacgatgacagttgcaaaatgttcatcaagtgagagctgcgtcctcgcgagaccgaaacgccgcctctagcacctgaaacacaagccctcagaggagcagatgattccctcaggatttaagaaaattgaggacttcagttttcgaagccgcattatttcacattgctgatacctctagcgcctgaaacacaagcgctcagaggagcaaatgattccctcaggatttaagaaaatgaggacttcagttttctaagcagcattatttgacattgctgatacttttaggcaaaaaaaaaaacaaaccaaaacaaaaccaaaaaacaaaaaaacaaaaaaacccacaaaacccgtgttggttagattttctcaaaagctttacaacaggcaggttacgtgtaagctctgctgttgcccaaaatagtaattagggaaataattgcttttaaatgaatatgtctgttttctagtcagatttgcccttttgttctttgatcagttagttcacgtaagcgggtgtggcagggaggaagcccctggtggtgagagtgtttggagctcaattgctcgaagggaattggtgtcgatatggagtctcgggcagtggttttagtaaccttggataaaccgacctctcaggcttgcacaatttgctaattaaaacagggagcacagctgcttcagttgtaagccgggcgtaggtcacctgatctgtaaaactacaatagtgtcagagaagtaagtgggataacattgttgctttggtaagctttcaaatgatgatgatgtcagcctgtgagttctgtgtcctgcttaagtgaggtttataaggatgaagaaaccaaacccgacggccagtacctcaggctgtcacagctgtctgtgggcacagcgtttgaaatagtctctgtgtggtcagtttctaccagcccgactttgtactctggcagctgctggtgttaaatattcccaaaagagtatgttgttgcccaaacagtgtaacccagaaatctagctgtttacagtaatttggatttgtatttagaggtgcagtttttctctagaggggataaagaagtgcggagcgtctttctctcctgggggaggtgtgtttccattttagttaataacatgcccggagagctgtctgtctgtctgttaataaagcagagtctcattcattatctgctttcatttgagaactgcagtgctagcgtgttttacagtgaagacctcggtgtgatcctgaaggagggtttcatcctcctctcatttcccactggatcggcaggaagcgttagcagggtggacatgccacagagcttccagatctggatcaaaggtggctgttgctgaaatacttatgcagagtcttccctgactgctgctggctaatgtgtgccctcttctccaacacacctcctccgagcctggcctggcacaaagccttctttctccaagttatttcagatcaagcagccaatgtagacagtgtctacactaaagggcgtaagaacagtggggtgcagtggcttcaaacatgctcaggatccagctgagctttcaccaggcttttcttgccatatttacagatgccactctgtgcctttctaaatattttaaatgttgtgtgctcagccgatgcacttggcttctggaaagtgcgctgagctgagagctcgcttctcttcctgctcaacgtgcactgggccgggtgttggggcgtagctgcccacacagacagtgctttgaagagtgagtggtttcggttggccatggggttgtgtctaaattgccaatatactgtctttccaaaggttcctaagtgtggacagttaatgcagcagacagttgttagggtaatagtgagaagttgggatgcttaacaagcttctaaggagtttgaactttgaaaaatagacaagagaaagagttcttaaaaaaaaaaactttgataggacagagcggaagtaattacagtttaactttatgggacgtttctgtgacaggctgggtaactatgcttgtcatgcgtcctaacctgtgccctgagattgtgctgtaatgttccttttggtggtgtccagctgtctggcaaggagcctgctcggctggagcattgtgaagggcatgctgtaattacaatattgtgatgtggcgttgttgcataactcaaggacacaccattgtcgcctacccactgtgatgtcgcaagaacgagatttgtgagttttactccaattgagcttttccagtgattgactgccactccctcccagcctttcggttctttaaaatgaaagataaacctcaggacaaccaagacctggggaaaagacagtctttgggaatgtaatttggaagaatggatccagaaaaacaaccaggggctcttaactctagtttcggcaggagatcccgagttacagacctgagctcgtaaacaaacgctcaccactttacagtcgccgcctcatcctgaaactccggtcagaaatgctggaaggcctttgctaatgcgcagtgaaaattaggggcacagatgtggacggactgtgcttggtcagtaattgttctcctccaaatcaagtttatgagaaatttcatataaggaaaaaaacccttttgtatctgtgtctatatgtacagaagaccttaacaaccaaacagaaacttaacccctttggtttggttttgttttcgaaagcttatgcccaattttaaacttcatgtaagcttatgtacttattttaaactttaaaactattaaaagttaaactagatagtaaattcggcactgtctaatgtgcatacaccacaaacatataaccctaaattcagctgtgtctaatgtgtatacaccacacatatatataaccctaaattcagcctgatgtacttataccacacatatataaccctaaattcagcctaatgtacatataccacacacacatatatataaccctaaattcagcctaatgtacatacaccacacatatatataaccctaaattcagccctaatgtacatacaccacacatatataaccctaaattcagcctaatgtacatacaccacacatatatataaccctaaattcagccctaatgtacatacaccacacatataaccctaaattcaccctaatgtacatacaccacacatatatatatgacccttacctcttgttagcatttattgtagtttgtttttgaggttaggagcagttaagcaataatatgaatttgtgttggtttaacttttatgaattttagggcagaacaaggagttaatttccagataagcttgttcatgttcttagaataaagtgtcagcctcattagaagttttgtaatcgtggtctgcatcccagccatgcacctgctgggtcctgagtaatcctcggagcccagagcaaggcagagcagacacggagcaaacgctgcgttcagctgggtattttagatacgtctgagaagagttttaaaataaaacttgaatttgaaaagaaatagtgagtacttaccagaggtgggcagtgctgggatgtggccggtcttggtgccggtggctggcggtgctcaggaagcagtacctgttctcacgcttgctgggtgaaactggagcctgctgttccagtgggagggatttaagtgtaggagttgagccctcggggcgtagagatgcacctgatattcctcctgcccgcagctacgattcatgtgtttgcacccaccgagctgctgcgggcagcctccccagcactggacccagcaagcaagttatctcgccgactcccagcgctgtctccagactcaactgtctgtgagtgcggcgtcggtgctgcctggacggccatatgtcagagggctttcgatgtgtccgcagttagaatagagattactatattcatcagaatcacacccgatgaatatttggcgtcatgataaagacatgtgagactttcctttagaacttgagcatgtgtacgcaggaggcaaacacttggattgattctcaagcgcgcataccctgggaggcacagtattcatggcgtccttgccatgaggtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgggaaaggaggtgggatgagctggtgtcaggcccttggatgagcctgaggctgcagggcagaggctgcagggctgtggcatagggacgagctggccaggacagacatactggtttttttttttttttttttttttttttttgagacagagtttcactgttgctgcccaggctggagtgcaatggcatgatcttggctcactgcgtttctcctgcctcagcctcccgagtagctgggactacaggcgcctgccaccacgcccggctaattttttgtatttttagtagagatggggtttcaccgtgttagccaggatggtcttgatctcctgaccttgtgatccacccacgtcggcctcccaaagtgcttggattacaggtgtgagccactgcacccggtctgtttttttgtttttgttatttttttccttaagacttaagattttacatggctttgtgtttacttttatatttaattccttttttttttcttttgagacagggtcttgccctgtcacccaagctggagtgcagtggtgcgatcacggttcactgtagcctcaacctcctggactcgagtgatcctcccgcctcagtctccccagtagctgggactacaggcacggtcactatgcctggagaattttttgtagagacagggttttgccatgtttcctaggatggtttaataccttaaaattttttttggtggcttttgtccattgagacatccatatactttatgaagtcaaaaagagttatgtaagtcttatgacaaaaaacagcagttccctgtccctcttacctattcctggatagcaaactatcccaaacttagtggcttaaaacaagcaccgttttattacgtcttaggatatattgtgtcaggagtttgtggagggcctggccgagtgctgcttctgtttcatggacactgactgaggtggctccgtgggagaaagctggcaggtgactggtctggagggtccaggacagctttactcacctgccttctgtcctggaggggcagctggaatcctgagatcagctggaacctcatcctcacttagtagcacttcagaggcctccctagcagggtggtcagctgtatgatggctcaggacttcaagagagcaaggcggaaggttccagtcctccagaaggctgggccgcagattgtcagggtgtcccttctgtcacctttctctgctgaggcagcctcgtgctgcccagatgcaaggcgggagccgagggctccacctctcagcggcaggagtgccaggtgtctgcgctacgactccctctgcccggaagccccaccttggcctttcctaagctgagtgttctgacccttgccatggagggtccagtgaggcctttgagaatctgtgtaccttccaccctctaccctgctcctgagagtctctgtccctggtcctccttgggagctgagacggcagggagggagcttatcccagcgcctggctgggtgtttacctcctcgattccagccttactgatctgttggtggttctgtgccctctctccccctctctcccttctccactcctggtcgaggtgttgtttggtggcttcccttcatggaagatgggaatttgcctctctttgccccttctgcccccatgtctgccttccccgtcacccagggggttttgcctgcctctctcttgcactggaaggcctgctgctcggatcccatgtcgtctttctcttgagttaatcatttagtttgacatgaggcacacaccttttataggctcttgagaaagtgcaagagagatttttttggaggtcttgaattattgaaaatgtttttatctactcttcaacctcactgatagtttggctgagtctagaatttcaggccagaaatcatttaccttcagatttttgcaagtgttcttcattttctttctttcttttttttttttttttttgagatggaatctcgctctgtcacccaggctggagtgcagtggcgcgatctcggctcactgcaaactccacctcccatgttcacgccattctcttgcctcagcctcccaagtagctgggactacaggcgccctccaccacgtccggctgattttttgtatttttagtagagacggggtttcaccatgttagccaggatggtctcgatctcctgacctcgtgatccgcccgcctcggcctcccaaagtgctaggattacaggtgtgagccaccacacccggccgcaagtgttctctattttctctagcttctagtactgtggttgagaaccttgatgccattctgattcctgattctttctctcttaacattttagtgtgaaaattttcaaaatacagacaagttgtaaggatgctccagtgaactctcatatgcccaacggtggggttctccagttaacacagctgtctgtgttcccttcccttcccctccctgtccagcttacttacccttcccttcccctcccctcccctccccgtccagcttacatacccttcccttcccctcgccgtccagcttacttatcattcccttcccctccccgtccagcttatatacccttcctttcccctccccatccagcttacatacccttcccttcccctccccgtccagcttacttacccttcccttcccctcaccatccagcttacttacccttcccttcccctcaccatccagcttacttacccttcccttcccctccccgtccagcttacttacccttcccttcccctccccgtccagcttacttacccttcccttcccctccccatccagcttaatcgtcttgctgcatttcaggtcagttgcagacatcagtatgctttgccccaaacacttttcaggcatattcttattagtttatgattcttctttcaaaggtaaggtttacattcagtgaagggcacaggtcttaagaggatcatttaacgagttttgacaaatgtgttctcccattatggccccagagagttccgtcacagcagtgccacccttccccacccagaccgtggcaactgcaggctgatacttttccaccatggattagttttatgtgttgtagaattttatgtcagtagtgattcctgatttttatggacagctgtttctcacctgcaggttctttcctttatcctcagtagtcttagttttcttaactttatatttcgacacttctgttaagtacttggtttctgattttggtttccatgagctctgttttgttctgagtgttccttttgtagcatctcattctcatgcagtactttcagtagcttttcttatctaaggattttagtgatagctttcttttagtggggagtggaggagtgggggtggatgttctccgtgtgtgtgtgtgtgtgtgtgtgtgtgtgtttaaagacctggggtcttgctgtgttacccaggctggacttgaactccgggtctcaagtgcttctcctgcctcagcctcccgggtagctgggactgcaggagcgccatgccatgcctggtgccctccctgcatcgtcagtgtggctgcctgccttccagggcctctgctgagcacctcggagagtcagccctgtctcctgccccagtgctccttgggttaggcctaccctgcccctccccacagagttctctggtgccacagatctggagctttttagggacctgtcctgtggatcagggggagtctgagttgcctccctccaggggagggctgggcttcttggtctgaggcatttcctgctgtccctgcacttccaggctcctccgtggtcctggtgctgccttccctgcccttcctcttctaccctgtagcttatttcttgaaaaaagaaaatggtccgtttctgctgtttttagtgggattttacccgctattttttacatgttcaaccccctgtgttactcagaattcttgcgattaggtttttgaccaaatcttaggaaccgtcatgggggtggcagctgatgtttcttgcgtgttgatggtgtggggcaccgtgccaggtgcatcacctgcactggtccatttactcagaagcaccacgcacctggcctgtggagtccccccacccacaggtcgggaacgtggccgaggtacccagcccagagggcgatgagcagagttacaccagaggtggggggtgcttccctgggtggggaaggaggggtacctggggtggtggctgctcttgggggtaagcaccggtgccagtgtgtgttggggggtgccagggacccaggcaggtgctggcgccgcggcctctgtgtcagggcctctttccctaggggcacacaggctggaagtgcagtcctggttgagctttcctagtttccaggtcgggggtgaggcacaggacatggccggctcggccccttcctctccatcctgtccagctcagccccttcctgtccatcttgtgcggcccagccccttcctctccgtccatcctgtccggcctggccccttcctctctgtcctgtctggcctggccccttcctctctgtccatcctgtctggctcggccccttcctctccgtcctgtccagcttggccccttcctctccatcttgtccggcccggccccttcctctccatctcgtctggcccggccccttcctctccgtctgtcctgtccggcccggccccttcctctccgtcctgtccagctcagccccttcctgtccatcttgtgtggcccagccccttcctctccgtctgtcctgtctggcctggccccttgctctccctccgtcctgtccggctcagccctttcctctccgtcctgcccagcccaccccggtcccttccgcagcagcatcctctccagtgcactgtgtgctgggactcaagtcttggctcttccatcttcaccctttgtgacttggggcagcaattgctgacctccctgggcctcggtcttcctgtccgtgaaagggacttgtgagcatctctcacagaacacctgtgatgaaggaagggcgtcacatcttggatcttcttaaaatacaagattgtttctgttttaatcctttgtgttccttgtgaggtgctgcatccagaggaaaggagaaaggaaatgaaaactctgcggaaaatccacaggcctggcatcagcctcccagtctgattttgacgcggctgtaggggagacacagcaacattctgtcccccgagggcacagcttcaggaacggctccgggccggagggcacctctcgcctggctgtgttgtgtctcagggctctgcgcttctaaagggactcaggccagtgggcagaactgtgggatgggactgggaggcttagggggtgagggtgtaagccctgtgcctccctccacgtgctgcgtccggcatgccacgtcccctcgtccagccctctgctgccccctccacgcgctgcgtcccctgtgccgtgtcctctcgtccagccctctgctgccccctccacgcgctgcgtcctctgtgccgtgtcctcttgtccagccctctgctgccccctccacgtgctgcgtccagcgtgccgtgtcctctcgtccagccctctgctgccccctccatgcgctgtgtcccatgtgccgtgtcctctcgtccagccctctgctgcccactgctctctttgggacttccattgtttccccttccccttcctttcctggttttcttccctagtgaggtgcccttcctgctgctgcagggccctgctgtggcctctgccttccgtccctggcggtagtgagactggctgagacccaggggaagcttggagactgtcctagatttcggagatggtggtacacaggcttgctggcttgggttagggctctaggccctgccttcgggttgtctggaagccgccagccaggcctggacacctctctgcccccgtcacctcggagcagcagcccaggagcgggtcacagcccttcccctgtgttacatggtcacctgcctgagaacccctgcaggcccctgtgttttgggaagttgatttaactgaacagagcgcagctgagaaggggcgcctccctccccacccaccctcattgcctgggaccgcgtgtccaggagccgggcctcgggtgtctggtctctgggccacacaggctaacatggccaagcccagctgcacccccggggtcctcacccgccatgtgcctgtggtcgtggccaaggtctgggcccaacctgctctgggcgctgtgggcaccgctcagccattttctacaggtggccgaggagacatttggtttctcattaaaaagaaacaggccgggcgtggtggctcacgcctgtaatcccagcactttgggaggccaaggtgggcggatcatgaggtcaggagatcgagaccatcttgtctaacacagtgaaaccccgtctctactaaaaatacacaaaaaattagctgggcgtggtggtgggtgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttctggacatttgttgacgttgatgagtagtggagggctttatttgtaagttgaagtctgagatttgtcatgccaatacctaaattttaatttgtttgtacaaataacgccacaatttaattcttttttctttttgagacagagtcttgctctgtcacccaggctggagtgcagtagtgcgatctccgcctcccgagttcaagtcattctcctgcctcagcctcccgaatagctgggatcacagttgcgtggtaccacgcctggctagtattttgtatttttagtagagatggggtttcatcatgttagccaggatggtcttgatctcctgacctcgtgatccaccctcctcggcctcccaaagtgctgggattactgggattacaggcgtgagccaccgggccgggcccacgatttgaatttttatggaactggggctaacttaattttttcagacgagtgggagtagagcaaacggcccctgtctgttgcccctttttcctaccaaggcccctccaggctgtctcttgcctggtgagtgtgaggagatgggtgggcgcggccctgtgggatggtgctctgtggcagggctggcagtttctgggtgtgtggcctgtgggtagcctttgtactgggcgcacagtccccggctcctcccttccaacaccttcgccctgagcggcctcggaaatggggcttctggcggctctgcaggcaccgtcagagtcagagggagggcgagcggcttttggtttctgtttaaacagcgtcctgtcgctccctcctctcctgtgcggattggcgctgcggcttctgtgttgagagggaaacttgaaaccctgagctatggcttgttttgtctttgattgggaaacccaattcaggtttgtgaacttgggccaagtttaagaattcccacagttttcttcagctcctctcctccctgaaccccgacagcgaggtgtcttacgcttcggcattctcactcgcctgactcagacttgttagttttccagagcaactcatgtggccgccgtctagggagtttattcagagggtgcctctacatgcacagcagccaggtacagaagtcatgagttaaatcgcacaaggacaagtaaaatgaaaaaaattagcactcagatcttcttttttttcatgctacaaaataacagtgaaaaacctaacgatgaaaatagatgcgaacagacaaaaggtcaatgggcttgatcccttctcatcctctctcctgtgtctcctggaggcttctgcacctctgtgtcttcccccgctctgctgcgtcttctccacctcgatgtccccctctgcctgctgcgtcttctccacctcgatgttcccctctgcctgctgcgtcttctccacctcgatgtccccctctgcctgctgcgtcttctccacctcgatgtccccctctgcctgctgtgtcttctccacctcgatgtccccctctgcctgctgcgtcttctccacctcgatgtccccctctgcctgctgcgtcttctccacctcgatgtcccccgctctgctgcgtcttctccacctcgatgtccccctctgcctgctgcgtcttctccacctcgatgtccccctctgtctgctgcgtcggggctgcctaccgggcttggtcttcagggccactgtttctcctcagctaagtcctgagagtcacatttccatccattgcagtgaaatcttttccttcaggtatttccagaccttggttttggccccttttcatatcttccttgtttcctcgctgtggttttcatttcccctttcgtctccttaacctgttttttgatggtgtctttttaggttatctcaagttcatttcaagctctgaaagtaggaagtaaagtaagaaccgcgtggcactagcaatcactaggcattgttccaagcacacggataaactgagaatcctcgtggtcgccccgggggtgggactgccattgtccagagagacctgcttttgcctgtggtgccacacgggtccctctcacaggatgcgaccatggtggctttgcgtcatgtcacctcagccaggcaggaccttctgctggaacccccttccctggtagtcctcggagagggctgtgcacaatctggaggcagaagcgaagcagtagcccccgtgcgcggcagctcttgaggctgtgctgctgttggctgtgctgttgttggctgtgctgttgttggctgttttgctgttggctgtgctgttgttgcctgtgctgctgttggctgtgctgctgttggctgtgctgctgttggctgtgctgctgttggctgtgctgctgttggctgtgctgctgttggctgtgctgctgttggctgtgctgtgttgctgtgctgtgctgctgttggctgtgctgctgttggctgtgctgctgttggctgtgttgttgttggctgtgctgttgttggctgtgctgttgttgcctgtgctgctgttggctgtgctgctgttggctgtgctgttgttggctgtgctgctgttggctgtgctgctgttggctgtgctgttgttggctgtgttgttgttggctgtgctgctgttggctgtgctgttgttggctgtgctcttctgctgttggctgtgctgttgttggctgtgctgttgttggctgtgctgttgttggctgtgctgttgttggctgtgctgttgttggctgtgctgctgttggctgtcctgttgttggctgtgctgttgttggctgtgctgttttgctgttggctgtgctgttgttggctgtgctgttgttggttgtgtgtgctgaccccggaccccctacagtatggctgtgcatggactggtgatttggcccccatggcctcatcagccctgatccatccctgcattgaattcgtatggggcttgtggtgagtctggactgactcagctttctaaaagctgaaaagcaaaagttaataggtctgcagagataaatggacagacccggtatcctcctgagagctcaaaacacctcccaattattgataactaaatatgtagtggagatatagatatgtataaaacgcacattacatactgtgtgtgcacatacaatatttcaacagcagaggcgactggcatgattccataattgatacagaaccgtgtagctagccgttggagaatacacatttgtaggcacctgaggaacattcacagatattacacagccaggccataaaacaagtctcgagacatttcagagactcactggcggacagatggtattccatgctcacaaagtaatgaaattaaaaactggatacagaataataaaggaaaggtgataatttttagttagaagatatacaaatgggtaaatcacatgagtcaagtctcaggagaagttttaaaataaaaagttaaaaaagtttaaaaataaaaataaacagtcacaaaattattctatctaaaattttgggatgcagctaaggaaacttaaacctttaaacaggtgtgacgaaattgtggcctgcaggcccagtggggcctcagcctgtttctgtacagctttggagccaagaagggttttcacattttaaaaatgttatcaatgagaataaacacaaccaagcagagtctgcgatgtggactgcatgtggcccacagggcccgaggttctctctggccctggcaggaatcacttggtgactcggcctcagacacgtgtacagaaaaggagaaaggttcactctgcacagggcgggtgggaagagggcagtgagcagaaccctagaaatgaaggaggtggaagacaaagatgagagaggacacacagagccaaacgcagctcttcgagagggctgatgggaccaataaacgcgtggccgacgggcagaaagcaggagccttacacacggaagggagccctcgtgcagccaccgtggagatggaaaatggcatgttaagaatatcttttgccaggaaatttggtagcttaggcaaaatagacgttccgagagaaatgtaatttatcaaagttgacccaggtgggaatagaaaagtgactcctcactgcttcagcgcatctgcttgtaagcgggaacgattactgttgaccccataggatttttaatgattttgttgagacgcaattcacatgccattcagttctgtcattaagtgtacagttcagtggcttgtaacgcatttgcagagttttgcagccatcgccacagtcagttgtagaacattttaccccacgctccttcgctgtcatccccaacccccccgacagatggataaaccccccctcctagacaccacagatgggttctctgtgtctacccattctggacatttcctgtgaatggaaccgtgccccctgtggtcctctgtggtggctccttgccccgagcgtggcgttggcgtggtccgtgggcgatgcagcccccagcagtgctccttttcttttccttgttgaagcctgttccatcgtgtggcatcttagtcagctcaggctgtggaaacaagtcaccacagatgggggctcaagcagcacaaatgtatccctcacagttctggaggctgggtgtccaaggtcgaggtgccagcaggctcggcagcaggctcggtttcttccgggttttcctgggcctgcaggcgctgccttcctgctgcgtgctcgccgttcggtctgtgtcttggtgtccttgtttcctcttcttaggcggacactggtcatagcagatccgggccccacttgcgtggcctcattttaccttacgcatctctaagggccacatctccagatacaggcactcgggggcactggggttaagacttcagtatgtggatttcagggagacagaattcagcccacgacgtacatggaggccgcattttatttatccatctgtcagttggtagacgtttgggttgtttcccactgtaggctgctgtgaataaagcattcgtgtgtgagtttttgtgtggatgtggtttttgtcttgggtataggcctgggcttggagcataggactgttcggaaagttaagggaatgaacgtattcagagctcagaaccgtgtctggcttgcgatgcgttctgttttgaggttagtgatgatgatggagagcggctcccgaggacgagagctcgtgatggagagtgcctctttatgcccgatgtgaatgtggctactcagctttctctctctctttttttttaaattaatttattttgtcgagacaggttcttgctctgttgcccaggctggagtgcagtggtgtgatcatagctcactgcatccttgacctcttgggcgcaagtgatcctctgacctcagcctcctgagtagctggaaccacaggcatgtgccaccacgcccagctaattgtcgtattttttttctttttctttttttgtaagggtagggttttgccatgtagctggtctcaaagtcctgggcttaagcagtccacctgtctcagcttcctaaggtgctgggattacaggcttgagccactgcatccagcaacaccccccctccttttttttttctgtttttgagtcagggtcttgctctgttgcccaggctggagtgcagtggctcactcacggctcactgtagctttgaactcatgggctagatccatcccccgacctcagcctcacaagtagctgagactacaggtgtttgccagcacacccagctcattttttctttttttttttgtagagacggtctcaccatctagcccaggttggtcttgaactcctcgcctcaaatgatcctctcatcttggcctcccaaagtattgcgattacaggcatgagccactgttaatggccccagctttctttgggttcgtgttttctcagtgtattcttttctgtcttttaatttttttatattcttgcattttagatgtatgttgagtaaaaatctaccgtatgtgattttaagctggtgagtttagtccatttactttactgacatgtttgggtgtctttgtcttattatatgaattttgctttttcagatttttttttgtttttaaaagttgtggttcctattgggcccccaacccagtcccattccacatcttcttccttgttggtttggaatcatctattctgtttcctgtgtttcttcaggggtcgtattcagcttgtaccacgaatattcagagccaacagccagcttcttagcctaccctccaagtaacacacagcacaccctgacctcgatcactttccatctgacatatttgacattgttgagtttttagttcttcttgtttaacattagacattacaggttgagcaccctgaatccgaaaatccaaaaccgaaaactttttgaatgctgagttgacactctgcaggtgatgggctgcagtcaaaacacaggtaaacaacacacagttgattcagcaccccaaggggaaaaagatcctcccaacccccttcagctttgataaatcctttccacataagaccaggttccctcatgcaagcacgtccacaaagggcgatgaaatgtcgggtgcaggccggacgcaggcgctgcaggctccttatgaggctccacatgggcgagacctgtgcgcaccgctcgtgtgtttgcgtatcctctgctctgtggtgtacagatactgttgaaaacatcagaaaggcctgcaggttacttgtatgggggtgtacagatactgttgaaaatgtcagaaaggcctgcaggttacttgtatgggtaacagtggtcagaaaaggggcaagcattcacgtttgcatgtcgcacagaaagtcagactgctggggggagctgggcagcagtgtaagagcacggtgctggagtgagtgccagagatgacctaagaaacaggaggaatggttgacgttctgtgctggaaacgatgaccagaaaaaccctgcacaaagctacacgtgaaatttctatcacgtattgaaagagtggatctgtcagcatcgcagtggacacaagccacttaacagtgccaatcacaagacaagcaaagctctgtgtaaaggccctgatcgcattcatgaagctctgtccttgggactcatcatctacgaaaggccacacctcctaacaccgtgctcttgggagtgaggatttcagcaggaattctggggaacagaagcattggggcgtcgcatctccctgtggccttcctccctgtggccttcctccgcctgccagctgccccctcaccctgctgtccacctcacggacccctcttcgccccatatgggccactttggcccccaccaccccttcctggatgtgcagaccctatgcggtgccacctgatgcttcaagactgaattttccagaggggcagggaaaggtgtttgcctttttttttttttttttttttttttttttttttttaattttttagagccagggtcactctgttgctcacgctggagtgagtgccatggtgtagtcgcggctcactgcagtcttggcctcctggactaaagcgatccttccacctcagcctcccaagtcactgtggcactatgggtgcatgctaccgtgcccggctaattttttttatcttttgaagagatgggatctcactatgttgcccaggctggtcacgaactcctgggctcacgtgatctactcacctcggcctcctgaagggctgggattacaggtgtgagccactgtgcctggccaggtgtttgctcttaaaaagtcatttctctctttctgtgtgtatttgtgttttgaggtaaaatttcacataacataaaaataaccattaactttaaagtgaaaaactcagagcatttagtacatacccaatgttgcacagctattacttctgtctacttttaacacatttttgtcaccgaaaaaatactctggtgtccattcacatagtcatgacacatcacgacacatgactgtattcccaacccctggcacctgccaggctgttttctgcctctacgtttacttattctgagaattttatacacatggagtctgcaatgcgtgaccctttgtgcctggttcatctgtattgtagcatgtgtcaggccttcatttgtttttatggctgaataatattgctttgtatgggtagactccccccccactttttttttttttttttttttttttgtagagacagggtctcaccatctagcccaggttggtcttgaactcctggcctcaaatgatcctctcatcttggcctcccaaagtattgtgattacaggcatgagcctgaatctgaaaaagcaaaattcatatagtaagacaaagacacccaaacatgtcagtgaagtaaatggactaaactcaccagcttaaaatcatatggtagaattttactcaacatacatctaaaatgcaagaatataaaaagattaaaaggaaagacagaaaagaatatgctgagaaaacactaaccaaaagaaagctggggccagtaacagtggcttaatgcctgtaatcacaatactttgggaggccaagatgagaggatcatttgaggcgaggagttcaagaccaacctgggctagatggtgagaccctgtctctacaaagaaaaaaagaaaaaaaacagacgccccaatgcttgcgttccccaaaattcctgctgaaatcctgactcccaagggcacagtgttaggtgtggcctttcgtagatgatgagtcacagggacagagcttgatgaatgctatcagggcccttacacagttgacggacacttaagttttcccaccttttggcccttgtgaagaatgcttctgtgaacgtttgcgtacaagtgtctgtttgaatccctgtcttccccttttttgggtgcgcatccagggcgggatcgctggaccgcgtgcggaccctcgctgcgcatccagggcgggatcgctggaccgcgtgcggaccctcgctgcgcatccagggcgggatcgctggaccgcgtgcggaccctcggtgcgcatccagggcgggatcgctggaccgcgtgcggaccctcgctgcgcatccagggcgggatcgctggaccgcgtgcggaccctcggtgcgcatccagggcgggatcgctggaccgcgtgcggaccctcggtgcgcatccagggcgggatcgctggaccgcgtgcggaccctcggtgtgttactgaggcgtccccaagctgtttccacagacgctgtgctgccctgcattcccaccagcaaggcgcagagcttctggtttctccatgtcctcaccaacacctgtgttgttcttttttaaaaaattataatcagcctcgtaggtgtgagggggtatcttgtgattttgatttgaatttttcttaatgacgaatgacactgagcatcttttcatgtgctccttggttgtttgtgtatttctctggataaatgtctagtcaagtcctttgaccatttttaaattggattgtttgtccttttgttgttgagttgtaaagctgtttgtatcttctggatattaaactcttatcagatatatcatttgcaagtattttctcccattctgttggttgtctttttttttcttttgataatgtctttgtattgtgtcgtgtttaatgtaaacatttcaccattgttttaattccctcttttcagttcttttctgtgtgtgtgcagtttttgggtgtgtgtgatgtgtacatacacacatgcacatatacaggtgtctaaaaagtattttgtttttttgttttaaatatttgacacttttaaattggagttgagattctgtatggagtaacgtattgttgaatgacaggaaagtatgaagcttgtcggagtgttattacttggcatagccacaggagccatacaaatgatacaaccttgctgcttgtgtctcatggtttttttttttttttaatttaatttaatttttttttcattttttttttaaattatactttaagttttagggtacatgtgcacattgtgcaggttagttacatatgtatacatgtgccatgctgctgcactgcacccactaactcgtcatctagcattattttaatttgttttagtttttttttgaaaaagggtcttgctgtgtcactcaggcaggagtacagtggtatgatcacagctcaccgcagccttgacctcccaggctcaagcgatcctcctgcttcagcctcccaagtagctggtgctacaggggcacaccatcatacctggctaacttttgtatttttttgtagagatgggatctccctatgttgtccaggctggtctcgaactcctgggctcaagtgatcctcccgcctcagcctccctaaatgctgggattacgaacatgagccactgtgcccagccagcctttgttgtttttgaaagttgaaattcatgtttttggatcaaagctaagctgtgacatataaacatgaagtgatctagttaggtttggttatacaccatgtgcagaaagcaacctcttcatgaatcttttaatgaacatctttctacctggaagaaaccctttacctactaaacttactttcacaccttcctaattttgttgtcttccgtgtttttgctagctccaggcctattcggcatttaaaataaaatgcaggttggccagtctggctgggcagttctacaggtactacggctggaggatcccagttgacttgaaattcaggttttgcttgtgaaagtagctggctggggcttctgttgatgacagtgctgtgtggacggcctggttcgctgggtgtgcctcacagacacaggacactttttagggttgcttttgaatgtgcctgaggtgaggttcctgtgttttccttgtacttaccttcatattttctgaccctcctgtggatggaaaatcgactgagtgtgtgaagggcctgtcggtgtgaacgggccctgctcagccggtccatggctgtcttaggatcccgcttggtggcgaggagggtgcggctcgtgggtggctgcctggggctaccccgtgtagacttgctgggactttgtctagacaagagaactgctgtcagtggcgcttcctgcggggggatgagtgcggctctcagcgcctctgtggggctgggggtcttgggccgtgaggccggggccaggctgcgtggcaaccctgagtcccaccctcattgtctttgctcggggccccgagaggccatggggagcctgccggctctgtgtcctccccgcactggcttttagggaaagagagtctcgtgggtcatccggcctgccggctctgtgtcctccctacactgacacactggctttcagggaaagggagtcttgtgggtcgtctggcctgccggctctgtgtcctccccgcactggctttcagggaaagagagtctcgtgggtcgtctggcctgccagctctgtgtcctccctacactcacacactggctttcagggagattgggccttgtgtgtcctgttgggtgagcagacacacaagctgtgacttcagggctacggaagttgctctgtggtttccggcactgcagactccaagtgtgagccctgtagtgaggacaaagagtggaggttggagttcagaattgtggacaggctcctgaggaccagcagaggctggaggccagggcttgcccgccgggagtgtggctgtggaaagattccagtccacagtgggggctgctgcccagactcaccctgaataaagtgtcttcagagccacctgtcctgcctgttcatggcagtgacccagaaagattcatcagtgggcggtgagttgggaacagaaagaaaacccttgagataactgggttggagacagggagcaggcttgtcattgtgcactggtgacatggcctttggcctccccagccgtctggcctgggcctcgtggtcctgctcttgggcttcatgtgtccttgggtgtcagctccagcatggcgtcctctgggccctgctgcttctgaagtgcctgtgccagggacactgtcttggggccagtggaggtctgagtatgggggctgggagtcctaggcagtgagtcatggcagaactggcccctgacttcctggttaagcctttaattctcccgaatgcctgtttttgcttctttcaagttgttgtgcttgagccactctgtcattagctgtgggcgttccgagtgccagcgcacagtgttgagcagagcgggtaggagcgccctggcttcagggagggcccccgccccctgcatggcggtcacgctgcgctgagcgtcccctcccctctggtggcctttcgcagtggtggaggggcaggaactgactggctcttttccctgtggtggctgctcgggtggcagtgagcggacagcgagggggacagacacaggtggaaggaaccacggtgggtttcattaacaatgacagtggctcaggagatcctgaggctgattaatttgcaaacagcaattacttgggattgcttgaaaagaaagttctagcttagaacaggaacctgaggagggctggccacactggaatccagtgcccactgtgacagtggagagccagcagacgccactggctttgatggatgatggagagggtcctggtgtcttctgccatttgtggggggtccttgtgtgctgtgtttgcaggcaccatgggtctccctggacggggttcggttccaccccagcgcccttgtcttgtttcatcgcccgtgtccgggctgtgtaagaagcatgtccatttgtcccgagcggagggtctctgccccgcccctgagggaggccaggaggcccttgttggatgctctggcgggcggcactgggacacggccattgcacccggccctggacacagggcggccaccgcatccggccctggacacagggtggccagggacttggcggggggagctcttcagaatctgtcacatgcacgtgaatgctttatggctttggtattcttctgtttaattttagtaaaaccgcggcccgttgcaagaagagtgtgggcgttggcagctttgtcccaggtgctgcagggttggggtggtccctgtcaccgcctgctgctggtgggggtcagctgcacggatgcacggcctcgcaccagcggcagccccagaggccatgcatagggcaggccccggtggtcagggacccacccagtcctgccaggcgttgggcttgggatgtgcggccggctgggggcacacattcatgccgcaggtccccgtgagtctgggccgtgtgcctggcgagccctgaattccacctcacgtcagccgctggttcacgtcagctgctggtgttgagtgttcgcatgatgcttttctttcttgggggatggatcagtggatggagaaataaagctgtgagggcataaaatcaatgtttgtttatattgataatcatcccttaaactcagatccaggggcgtcaagagacctgagcccggccccggtgtgccgcgcactggccatgtgtccggagagggctgtgattgcggctgtcagccctgtccattggagctgcagcttggtaaatgcacagatggattttgagaaggtttccctctaaagatgtgggagtctttgcacctcgccaagctgtgctggtgtggccgtggcacataccgggctttttacgtctcttctagggagtgagtcggtgggcataggatggctaaggtatgggaattttaatagggaattttctagtaaatggttctgttagtattacagcttattttagaaagtaaggtgctttcatagagaatgtttaaaattattaagaggtagacaattcttttaaaaacctgaaggtcttttttttttttcttttttttgagacagagtctcgctgtcgcccaggctggagtgctggagtgcagtggcgcgatctcggctcactgcaacctccgcctcccaggttcacgccattctcctgcctcagcctcctgagtagctgggactacaggcgcccgccaccttgcccggctaattttttgtatttttagtagagacggggtttcaccgtgttagccaggatggtcttgatctcctgacctcatgatctgcccgcctcagcctcccaaagtgctgggattacaggcgtgagccactgcgcccggccaaaacctgaaggtcttatattgtggtgtgagtttatatttatttccatcattttatatttgtcagatttttatgcaggggggctgcataatgtctccctggagagcctcagcctctgtggaagagttgggtcaggagaagcctctcggcggaggaagccggagggagaagcctctcggtggaggaaccttcacccagagaccagcctgggggtccttggcccagacgggggaggtgggaacatggccttgggttctttcctccttgcagtttgggtgaataatgtgtgatgaggcctaagaggagatttataaagagtataatctctcagtcttagagaaaagtgtttcaaagtatgggttctcagtgtctgtattgaaaaaataaaaaattcagtgaatgggtaggttatttttcgatctgagggttatttctaagcacatgatttatctttagcacgggagggtgatgccccgccatgtctttttagcttagggactgtcttctgccgtgagttggcctctctgcctgtgcacgtgtgttgccggccccggctcagctgtggcagaagtcagtcacctgtggagttatggaagtccaggcggccaccccaggccggggcctcattccgttaagtagggccaggtgtctgtcctctcacgcgtccgaggtggctgccggcgtgcgggtgtgactgtcgatgagagctctgagctgggatatctggtgacggctgcccctgcttggtcttgcggtgtggctggggagaggattactgggtggaatgtagccgtccgccttttgtgttgacctcttgacctcccttttgggaggcttattaatgtcaaaaagtgaagatatgaggatgggatcgtaatttctttgtgttgctttccagtagcccagggaccaagctgtgggaaccaggcctccatgtgctggccccaccgtcctcgtggtgcctgtgtctgtccaggcttagtcctcagatcagctgcttcaccacattggctgcaggctgggtggcagatgcccccaggaggaggagaagcatttcttcccagggctttggcctgtgctgtgtgcctggaacctttaggtgctgtggcttcgcagacccggacgcagcgtggaggccaagcggtgtctgtacaggacccttcagtgatgagggtggccaggctccagccaggtcctagggaaagctctccgagagcgacggcttaagcagttctgaaaaattgcaaatgatctgtgttcttggagaaagaatgggagagaagcactcactcacaataatgttgcacctactgtgtgcgggtagggtgcaggcagtgtggtccagtgtgagcggggagggtgctggttgaggggttagtgctcgggacgcagcctttggacccagtgccctcccaaaactctgctcatcagtgcccctgagctcagcattgacccctggaggaactgggcgccttccctggtctcagactgtaagcctcctcgggaagcagcagttggctcctgatgcagctggcctcagatcctgttgggagagcaggattggtgaggaacctggagaggagtaggaggtgctgcctgatagcagaggtgggtgatgggggcagagagggtagcaggggcccagttcagtcctgtctggttttcacgtggagctttttatagagttgtgcttctcaagcctttcaaatgcctcacagcggcagtccgacgtgcagtcagtgacagctgagtagattaccaccctcaggactaaatgcaaaatcatcttcactgggtgcagcatttacagttttggtgctggaacctcctaaccagtgttcttaggggctgtcttaccagtgaagggagctgcctgctgttgacgctccacaggaggtttgcggcatggctgccatctgtgttgtggcctgggactttcttagagagtgggtaaaagatgagtcatctcttgtgtgatttatcagcttcacttgtgcttccagggctctttgaagcgtctcactttttaatttcatgaagaaacaaatgtagtgcagagaacagaaagctgctgtgtgacctgcgggtgcccagcctgtggggcttcctcatcgcccccatccaggcagatcgagtgccggctctctgtgctctccaggaggtggcctttcacagcagggacgttctgtgctcttattttaacaactgtaagaatctgagcttggtgacagttgggtgacccgggctctgtgtcttcgtgttggccagggtgtgtcatacacctggcctggcctgcgtgcctcacgtgtggtggggatttgtgactgtccccagcaccttgacagagggtccttgactctgcgaccctgcacagtgggtggtggcaggtgggatcttggttcacaggcacaggtggggagagttgctgggccagcgtggctgggtgactttcctgtggaaagagcgggcttggggcttggtgcgtgatcccaccgaggccggggttgtgcttggggcactgggggagagcagagcaggtgatgcatatccgggcgcccaccctagcagcacaggaagggctgggatcaccactccccggggcaccgtggggacagcgggggcctgctcactccctggggcaccgtggggacagcgggggcctgcttgtgttgggggtggggctccttgccccccaagggcaggccgagcaccaagtctgtgcttgccccactgtgcagcgttgcaggtgcagcagacatgaggccagctgctgctccctgcaggcagctgagggcctctgggaaggcttctctacaacgtcctgtgggaactggaaacccagatgtcagtggaaccaggtgttctgtccatcactgcctcttacctcctagcaaattcaacactggcgtttttttttctgagcaagttgagctgcatttttgggacaggagccatggctgtgtgtgctggtgctgaagggagggtctgcagggacggccacacggatggctgtgtgtgctggtgctgaagggagggtctgcagggacggccacgcggctctcgggagccgtttcctgcgctcgggctctgcaccggcaggctccacgctgagggtccctccacatccaccccatcgtgggagggaggctcagtgctctgcaggggcctgagcagtcggggagacaccccctgcccacagccaccctctctgggctatgtgggaggtgcccacgtttccacgccttcctcgtggagggtgtggcgggctgtctgtgccgcgggggtactcggctgcactgtgcacagccctcaccgcccagtgccgaaatgggaaggcctgacagggcgatgcggtctgcaccagctacatctgcagaagtccagcacgatgcagtttatgcctggcagtgatgtttgtttttaaaattagtaaaacctcattagttatcagaaggcgtaactatatgatgattttttgtggagggattatttctaccttttgtgcagagaatgcctggatcccttctgccccttggggtcacatattgcagtggggactgtggtgctctgagggttaagttgtttctgtcacctggaggctgctttttcctcaggcaattggcgttcaacaaatgacaggctgtctagagagaagggtttttcaattacatggctggacctgggttgccaaaaggaagcctcctggggtgtgttctatacgcgacatgcatttgctgtgtgtaattggaaccatgagaaaggtttttgttcagagctattggatagtttccttattttaaacctgttgaatctggaaagagttgtttttgaaatttttttctgataataacgttatataaaagtttatggcagaggagtttctgttccacacgcccctccccgagctttgtggtcgcccaggtgcctggctgtcaaggctggcctgtcccttgtgttcagggtcccgagatgtcagagctggcagcccaagtcctcccctttatcccgagcaggagaagcagtcctcactccatttttcaccccagggtatagcagcacctaccaccctgggatgaatcagagccaagaggcttggtttttctgttcttgttaaggaaattgatcatctcacaccctctcaagctgttttactttgtgcaaatcagattcctttctagggacctgcgaggagaaacatcctcagcttctaggactcccggggatgccgtcagcagccaggccttggcagctgccgcttcacctgtgctggcgtgtggggccctgacgtctcttgcgggtgtcatggagcaggattggaggtttctgagcagcaggagggcaggagaaaggccccaggactttgcgctgtggcctggcctggaaggaggctggctgggcccttctggatgcctgtagcagcactgccacctgggcagaggccccagaggccccagaggccgaggcaggctttgttctctgctgctgggactcagccctgcgggagcacagggaggacagctggaagcccagcccctctgtggctctgtccacagctggggacagcagtccagtgtgcacgggccacccacagccctctcaggaactggcctcttctctttaagacagaggagtgcgccaggtgggcctctggctggacctcctaggccatcagttttcccagcaggaagtgctgatcagactgaaggaaggcctgcgtgtgtgtgttggcccagatgcctgttagtggacgctgtgtctgcacagctgtctctgggtggctgattcatcccagcagctgactacgatggtgctaaagagaaccatcttacacggacttggggacagaaacctgggctcccctaccgaggtcaggtcctgggggtgtggtgggatcagctcccccagcacctccgtggcctggggtggggggtctgtgtcctcccttgggggcttctcacagggctgccaagcagtgtccaggtgcatgcgttgggcgtgcaggaggcctgaggccagtgtccatgctggccactgccactcgcggttgtctgttgggagtcggtctgtccagtggatgaataaattgggactcagcggtttgcacccagatgcccgaggctgtggagttgccgggtggtcgtgcctggggctgcctggagtggtgttgcagtgactgtccctggggatctggcctggcagggatgccacatttgggcagcgctttcctcttgaaggtgccacagcctgttagttttgatgtgttggccacgaacaggctgccctgttagcacagaaagtgaacgtgagcagtacgagaaggctcagagtggactttccggggcaaacaactgagggccttttgggcgtcacagatttggtttagttcggatcgaggtaatcatcttgaacccgcttattagagtcagtggctttttctgtctcacagccgccttcttgtttggtttcgcgtctcacatgcattctgtgatcctcactgactttttagaaggaaaatgtttgacatttacaagaagtgagagatactcttgcaaatcatccagcagtttctggtttgcagattgatggcagccctggcctttaccctcagtgcctcctgccggtgatggtgctgccggctctgacctgtgtgaggagggccttggagagcacaggtcccccagggggaggactccgggaggtgctttgcgggagggagtcatggccgagagagggaacgcagagctgccgtgtgtggccgtgcagggccttccacagtgagttgtggggtcctgggggtgagagctggtggtggtctgaccatggtgggaggtggtccggtcctgtagaggcgtggctgccgcagttggggcgggctctgggaatggcgcggtgtctggatgtggaggagtgaggaggagccggccctgagctgcacccaaggagagggctggccatggcgggggcaccacaccggaggacagctcttctgtgggcactgggcttgaagaagctgcagcgcatccaggtggggtgtcctgaggaaaggtggcttggagaggggtgggcccctgcctggagccctggcaggctggggagaccttggtgtctggcagggaccccggaatgtcctgctgctcccccgggcctctgtgtgcagcgccctgcgtcgtggctgggctgagaggaggcagtttccctagcccctcactctggcgaatttcacattcttgataccacggtatctttgaactttctattttgaggaaagttcatttttatgtagttttagtaagtgtataaacgtaataatcttattaaaagtaatcaccatatgtatataaaatacactgtgcagaaacatccatttttattgctgtttatagagaataaaagatccttagatgcaaaaagtcagaggggaaatttgcatataatattcgtagtcctacagttgttgcttatggtgttttgcctaagaccatttctaggtgcatttttctgggagataatgtatctgatgacagttgcatgtgcagataaccggcctctcatgtatccatcccgggagtgccttttctcagactgtgtgtagtgttagtgaacttgattggtgggtgtgaagtgtacagacggcgtgtgcgtggagcgggtcgtgtgcagagccccgaacgagaccctggcgtgtgcgtggagcgggtcgtgtgcagagccccgaacgagaccctggcgtgtgcgtggagcgggtcgtgtgcagagccctgaatgaggccttggtgtgtgggtgcttcagcgtgagggccacctggggaggagtgcttatctggggaggctgagctgggttggaggcttgggtgctccccctggctccgtgggtctccattgctggcttcatagctgtgttccgttttctttgttcagcagttgatctcaagtatttattccaaagcacttgaaatacatgaacctaataaatcgaacaaatacagtaaaactttagcttcttggaacatccccatatacttacaccacgtcctaaaatcctctcatgtctatgtaaaaaatcgggtagcctgggtaacgtgggatgccatctctacaaaaaatttaaaaagtagctgggtgtgatggtggcatgcttgtagtctcagctacttaggaggctgaggagggaggatcgcttgagcctgggaggtggaaggtgcagtgagccaagattgtggcactgcactccagcctgggagacagagccagaccctgtctcaaaaaaataagaaataaatgaaatcacacttgtgtgatgtcagattacccattaacccacttttgaatggagctggaaggataatccacacctacctcggatttctctgcgtggctgttttgcataggagccctgcatgggttattcttgaagtcagcactgtaggagccgtggccggctttgcattttcatcctggttcaccccagacctgctctgggcagagccaggcatcccctgggacgctctgcctttgcgtgtccacgacagtacaattccaggcactgcctggcatctgcgtctctccctcccctgaaccaggggcgcctctccctcccctgaaccaggggctcctcttcctccctgcctggcaggagctgcgtttccttgagtctcctcagactcggcagacccctgggtggtatcatgtgctattctgaaggagcttttgcttcatggcacttgaaaaaaatcctttcactggatctgagttggtgagcatgcatcttcctttcgtaggtttgttttctgaccaggccgtgggtctaacaggagccccgagcctctgggtgggctccgtgtcgcttgcgtgcctcactcatctggcaccgtgaccgcgctccggccctgagccccacttctctgaagcctcacgtgttgcccgtgtggtctgctcctcaccgtcttttctcttgtccttgcccagttgtcgccgtgatcctgaaggcgctgacctacgacgagaagcggggtgcctgcagcgtgggcaccaacgtcagggacgccgcctgctacgtgtgctgggccttcgcgcgtgcctatgagcctcaggagctgaagccctttgtgactgcaatctcgaggtaggcccattcgtcgaggtacatcggatgcgccgtgccccctgacggcgccgtgtgtcgtttcctccatgagaggtgtgcacagcagatgctcgtgaaaaggtgaaattacttggccagaggatctgtgacaaagccaccgcttggaggtcaagctccttttctgtgggtgagcaaccagagcagaagtgtgtggaggaacattctggaggtcttggccaccctgcaggcagtggattcttgggcgcaggtgatcgacaaccagagcagaagtgtgtggaggaacattccggaggtcttggtcaccctgcaggcagcggattcttgggcgcaggtgatcggcacgctgggtggcgtgggaggaagcaagtggggcacgggaatcgcctgtgcgtgctccctgcggtcgtgggtcttggcgagaggcgaattctgtctctatctcctttcaagttcctctggaatacagcaggcatgttggacatggcagtcttcagatggtgtttgtttttgttgaggagctggattttgtgtttttgtggaccagcacttgagagaatgttcagtagcaatagccttcgctggcatgcctgatgtcagctcctctgagatgtaagtgaacacttcagaacctctgggaggtagggagacactttttccctctggcttcctgatgagaaaactgaagccagcaggtttcatgggatcaccagaaccccagaagctgtgcggcctgtggcgggcggggctcctgcctcggtgtccagtgcgcgcacccagctgagccccgtagtggtgtcctgtgccagggactttcaggatctgatactttttgcttaggaaacatgcaaaacagatgtgtccccagcgcaggaaacgattcaattcaattcaaccgtgtgcgctggttttgtacactgcttttggactgaaatgagttcttttgtgctgaagaaggcaggtgcttcctttcttgttgtgcatgaaggagctggaggcgggacaccgaggaaggcgactcagtgtcactgtccgtcatgggtgtgtgagcccacggctgaatcatcacaaggtttcacacccgcacttcacctgacaacttttactaggaaaatgaactagggaaactgacttcagaattatgcccaagtcttagaagctcctcctgcagctgttcaggagccgagcgtcccctgctcactacaagacgcctgaaggggtcatgggatgcagcgtctgaagcttccacctggaagtgcactgctccttttggtctgggcggggcggggcgccggtggcagatgcccctggtggcaggctcaggctactgtgctgggtcccctctgccccgcacgccccgcgagcaccagcagggcctccccggcatgtggcggggccagcgttggcctggggcccgcttggctttgatctcgtggggcttcgtcttttggacgtcctgggtgcgcctccactgtggctcctgggttccctcacgcacccgggtgtaagcgccactgcctgtgtccgacaagcagctcgttgtgaggcacacgctggtaagcagctcgttgtgaggcacacgctggtgtaggctccgaagggtctcggtgacaggcgcttttctcttgttcctgcccactgctgttccatcttaccaaatactcagtagcgtccggagagggacctcaacccggttacttccctgggtgtgcagcacgtggccagcgtctcatagtctagattcttgcatcagagcgaagcctgagaggagccgagggtcctcctcctatccagggagaccgtgtgtttcccgaggcagctgtgaacacgcacgtccctcttgtcctgctcctcttcggaggagaacagcgcggctggagggtgctggtgctggccaacgtgttatggagagtgtggcttacctgaggccagggaggtctggggtggctgagagcggctgtggcctctgtctgctgctctccccagtggccactctggcagcgctgctgggcaggggcttggctgctggtggtcttcagggagcagtgccttgcagagtggagcagagaagacggagaggtccggctttaggcccctgccgagctcctgaggccctgccgcgtgcctgtgccagcctgcagcgctgctgtctgtgtgcgggagctcttgtgtgtgatcagcctcaggaaaggctcttcctgttacttccttgtgctgctcctgcacttctaggaagttgatcctgtaactaggaagtgaaagcaaaaaaatgtatctttcttattgttgataggaatagtcacagaacgagaaaacttccttacgttgatatctcattcagtttccttagcaaccctgagaggtgggcaggggccaccgtcattctggtttcactgaggaagtcaggacagcactgaagacacctgtccagcaccttgtgctgacggcttcccagccaggcccatcacctggtggccgaaggcttctgagccaggcccatcacctggtggccgacggcttctgagccaggcccggcacctcgtggccgacggcttctgagccaggcccggcacctcgtggccgacggcttctgagccaggcccggcacctcgtggccgacggcttctgagcagctccccaggccctggcccggggctcagcgctgcctcgtggctgagaagctcctcaccacctgctgtgaggccgtggaaagaccctgaatgcagacgtgtgacggctgcagctgcatctggcccctcagatggtggttcccctttcatggtgaaaatcctcacggatttccttttcagcctcatattttgtctaagagctgtcaacatcactgaaacctgggcctgcccttcatcctggggaggactccctggtccagtgtcacaggaggagtcgggccagggttgagggctggcacaggacatgggggtgagacgaaacctccactcacctgggagggtgtctaggtgggcacggaacccagggtcgtgtatgggccatcactcatgggttctctgttttgggggaaagctgatcccactggaggttgactgtaatgagagtctccagatcaggtgccgactttggagaaatgcaggtgcaactgtccgaacaaatcaagtccccgctactggacggggctggcagctcagctggggccggagagaaaagtcacgagcaagaaagttcttacctaaggtcctggacaggcagatacataacttctgcctttggcaacgttagatgtcatcgttccagagtaaaatacctataaaaacctgccgatgcgcggggagcctggccttggtctgggtgtggagggctgggggccggccggtcggtaggtcctggtgcaggcgggccccgtgcttcatggaggttggcgccgctcggtggcctgctcgcttattcttaggcctgattcacagaggctggggccactcagtgatctgttcgcacgttctcaggcatgaaccttcagggctggactcctgttcttttgtgcagtttccacaggggaccctcttgctccagggtcatctttctcactttgaagccccttgagccgcccctgcacagcctcctgttggccccgtgagggtcctgactggggctcctcttttggagcagctgccacgtgtggaccggcacgggcatggtcgtggtctgcccagctgggtgtggggttgagcccatcatgctgtggggtgctccctgggggttgtgtgtgtgtgggtcccacggtgggaggtggggttggggtgagtgtgacttctgtctggggcatgttgggtgggcgtgcaagggggtcctgggactcctgagtttctcaggcctgaaggactgtaggacgcactgtgggctgcaggcttgaagaaggatgtgagtttctggagtagcctggactgcacagccagggcctccccggcatgtggcggggccagcgttggcctgggtcccacttggctttgatctcgtggggctttggtttttggaggtcctgggtgcgtctccaccatggctcccgggttcccttgcgcacaccgagccagcagctgctggggcctcagggctcgcagctcacaggcttctgacgcctcagcctggagctggcgttgtgcccctcgcccctttacctgtgccatcccggccgcagacccaagggtgcccttggagccgtgcccgccggcctgggtgtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaattaccagcttttatgcccgtcaatttgggaacgtgatacaatcttgatttctctaactttcacaagttcttcggtgggtcctgtaacagtgggtgcttgggatcagagcatcagagtggaattttcgcagggaaatggaaatgcctgatcgagctgggcggtggcagcagccgctcctcactcttcaggtgcctggctcttctgagagtcagttcgggggtttagtggctcactttttctaattggttcctagctttttgctaaagaaacttggattaactgttcttttgcctcatggtgtgaatttatactgttcctgttttataaataccagaaggagcttcgtaggtaacttttaccatgtgttgaaggtagcattggttttgaaaacctgatttcctcagtgtcgcacacgggtagcttaagaggtgggataattgttggagtagtgaatggatttccctgagaagccaagtgcaatttaggggcagtgacagtgcgaagttaaagtgggacagagtggttatgtgttatctgcaaaatccctcctaaccagtaatcacagtctaatttgcaagaaggaaaagaaagccgagccctacgctgctgctgctgccattgtgcgtccagtgatttcctcacctgaaactcttttgtaagcagctcgtgttgacatcagctccgcccaggcagccacggggccctcccctgccagggggcagcctctgactttcggcctccacctcgagcaaacctgctgagcggcgcggcccagggaggatccgccgaggcctgcagatccgagatctcttcctcgggggcaggattgtcctggaaaatcaggaaatggcaggcattgctcagagctacgtcttgttctccctcaccggtgttgctcagtggcacagcttccaggggaagacaacacgtgtttttcaagaaaagttaagtggccattaccgagcagagtcctaaccctgtgaaacccggcaaatcctgcctccacgtcagctcaggtgtgactcgaaagcacttaaaaaattctcgtgttttaccactgtgttgattagtgtgagctttggttcttgggggttaggaaaattcagccataggcaggtccgatatgatttgcaactttcaaaaaacaggatggctaaataacaaattactagtctgatattttttaaatgtctgactttcaaatgacacagaattattgtttcttaaggtaaaaacagtgtatttggctttttattgctataaaatattatataaataagaaaacttgagctggggtgaggtctgcactttgctgtacctgccgaaaatgaggtgcctggagcttgggacaagtcgaggcgtgcacttccccttgactcggacaggaaagagaatccctttctgtttgacacagaccatttctctgtgttgggaaatcctggtgaagtatcacataaacttctccagcgaaagcaaacgggcgaggacacctagggcacgtttcagcgcagacaggccggcccttctcgcggcctcgcagtgtctctctccaggttcccggggatggtagatgaacgtggtgactcactcagggtgttcctgcgaagggaaactgagaggcccacgtgggacgttgggtgtcctgttggagtagtcctttaggaaggagcttttatatttatatttaactagcatcattaaacctgtttgtatttatttctcgatgagccagttttgttctgagaatgagaaaatagagccgttttaataaatgtccaaatcaggacagtgttaaatttgttgtaagtccatatatagttgattggtcgaattaacttgggagtctgtgtttagttaaaaacagcgtttctcaggcgttgctgtattttctgtgaggttcagtaaaatatacacgcaacagcaaccattttgacttctcatggcaggagccagcttcgttgaagtgggccaggctgaagtgaggccagctttgcctgctgcagccctgtggtctgtgtccaaattgctgagtactgccgggagagggagccgggagtgcctgcgtctcctgctgtcagccggtctgactgcctgagcggagctgttgaagtggactgaacaacagtaaccttagagggttagacttggtgaggatggtagatgattttaagtttcttctcttttttccattctttcttcattaatcaatgttccacactttaaatatagtaatttaaacaaataacacatttcaagaattcagtgtaacatgtgacctttcagtagtattggctggagccggcggcaataaagatagaagcctgtgttcctcttgtggcaaatgttaaaggaaaccagaaattcttgattcatatttttccctagaacacgtggctttacaggtttcaaaaaatgaaactcttgttcatatggtaaatatgacacacatttctatgcattctgaaaagatttagaataaactgccatttgttgttaaaaatagcagttatataactttttttttttcttgagacggagtcttcctctgtcgcccaggctggagtgcagtggtgcgatcttggctcactgcaatctccgcctcctgggttcaagcaattcttctgcctgcctagtagctgggattacaggtgcgcatcaccacccccgattaagttttttgtatttttagtagagacagggtttcactgtgttggccaggctgttctcgaactcctgatctcgtgatccacccaccttggcctcccaaagtgctgggattacaggcgtgagccactgcgcccggctgtagttatataacttttagttattagaagatcacattcatatgtcttgatcagtttaatgatttctaagatatcattaacaaaagccattatgatgtattgaaataggattgatcttaaaacgttcgtgctaatgtaacgtgagttccctttaattttaaaccagtatttttctcttcttatttaggctatagtttgttataaagagtatagagaggaaaatggagtgcttttctgttcatagagtttttctgaaattaaagtcaaaattttcagtttcaagtagtgaaagcagtgttaacagaaagtttcccagatactaatcctgggtcttttaagatctttagataattagttgctttccaaaatagcttttaattctgaactcattttagacttaaagaagaattgcaaaaccagtggagttcttctagaccctccacagcattctccgatgtgaacatctcacatttggaagccaggaggtgcagtgtgggataaaggccactaacaggctggtctgcccgggaccccgcatggcatctggtggtcctgtgccctcagcctcctctgctctgtgagctcctcagtctttatctttcttgatcttggggcacttaaaaaataggttttattgagatgaattcacttgccataaaattcacccctttagggtccacagttcagtggtttttagtgtattctcagacttgaggagacctcaccccagacagaagccatgtgcaccaggtcccgtcacccgctccaagcctggcactgccagcctgctttccgcccctgtggatttgaccctgagacctccagagacgactggccagatgttctgtaggacgcccctctctctgatgctttctcgtgtgttactggaaagagtgatgtgaggtgacctgccctcctccgtgtgctgttgggcccatatagtgccccacaacgggtcctgcgtggtctggaccttgatccctggtcaagatggggcctgccaggtgcctccacttgaggagactgtgttttcctctgtaactagcagtgttcttgtggggtactcgaaggttatgcaacatcctgctgtttctcctttggttttcaccccatccgagctctgtccaaagaccttgttgtgtggtctggtggtggttcctgtgtccccaccccgacgttcagtgattgcagcttgttcttaaggaaggctcgttcctctcccagctttatttcatcattcgctcctgccagtgtggactcatgggtgctcatcctgtttgggggttatcatctaacactattgttactagttttgtttgagttataatctaacactaactattgttattaatgttgctcaaattgctccagctttggccacttcaggttggcttctgtgtcctttcagcaagatcctgttcttttttttttttttttttttcttttttcctgagccttttttctttccttctggcaccacaagatgcacctggcttatctttttgcccctgccccagccctagcatccaccacttcccaggagtctcacatcctctcggtggagaacagtatttggaatccaggacgccaggcttggcctcagctgcctctaggtcccctccctctgtagctgagtgtgtgcccctcttcacagtccatgtttgcacagacaccagctctagcccagcttcctcctggcctcccttcgtgtgccgcttctgggcctactgtgtagcacgctctgctgccgtgcgtctgccgtcatgcatctgacgtgattttggagctgccagcccacacctgtgtgagcaacagactcaccactcagggtgggacgctctgtgcatcctcctcaccctgggcatagcgttgccaggccatcgctcgggtgagcccttctggtgctgctggtctgggatgcagacaagtctgccggttccctctgtgctggtccgggatgcagacacgtctgccgcttccctctgtgctgggctccccaggtctgtgattgttgcttcttcaatctgcatgtggttgtgttctacaactcaagcaccaaacaggacagtccgtctcccccaaaaactccccagtctgctccccaaccctgggccaacattggtctgattttggtcctgatagtttaccatttctggagtgtcttataaacggaaataatcagtaggcttttcattctggcttcgttgacttggcacagtgcccttaagactcatcccagtgatctttcctttttttttttggagtggtgtattgttggacggacctggcggtcacaggcctacctgtctccttgggtgtctccagtcctttctggaggctcaggggggctcaagggaagactctgcttccctgcttgagttgcccgcattcctttgctcatgggctcttcatctaccttcacagccagccacgtccacgtctcgcttcatccttcacgtaccctatgcctgtggtcctttcttctgcctcctgtgtctgtccttccttcttccttcctgtatgtatttatctccttacctgtctacttatcagtctgtctagatggggtctcgctgtgttgcccagactgtactcaaattcctgggctcaagggatcctcctgcctctgcctcccacagacagatggagcacaggtgtagccagggccgctggtgtgtaccactgtgttcggcacccgctgggctgcaggagtaatccagggccctctccccatcttagggtcaactgattgccaaccttaattcccctttgtcaggtaaaggaacatgtttgaagtgggacacccttatctttgggagtgggtattattctgctgaagacaagggtggggacagatatgctgtgaccagggtagttgggcttatgactttgttgttgtttacgtggaggaactgaaagacctgggtgtgctgctggatgccccaaggatctggcaggaggaggcatccaggccctcagggcaggtagcgggtgggcctccgtggtgttgggaggtgctgggcccggaggtatcagcaggaactgcagggtccctaccgcaggctccccacacggtgacacctgtctgtccgtccgtctgtccacaggagcaggaggggctgggcggggaggacgcagggtctgtcggagcatagcagtggcccgtacgtgagggactttgttgttgccgtctccccagggtgcagagcgtggtggtttgtggccatccttgcagtgtgagtgagcaagtggccgaggggtagactttggatggctccaggcggaactcggggaaggaggccgtgtactcccatagctctgggctctgtttgtggctgtggccacacagggcagggcctcagggcagggaggccagtgcttttgggaagggcctcccccagccctcagaagcctcccaccctattccccttgggctccatccttctgttttttttctggctctggttcctggcgtctgtttgcaaggctggctggacactgcaaccacctgggcttgctgctgtggcctggacgctggggtctctctcggcccggtggtgagctgagaagcggccctgtggtagaagagggcctttccacgctgagaccacagattgtccctgcaataagcaaacatttctctaaaatgtgagataaacgctttatccactggtgatccgtggttgttagtaattaaaccgagtaaacggtagctcattcggtcaggccgcttgccgccgatgaggggtgcagagcttctgcagcatcctggggaggtcccggaacgtgggtctgggctgtgctgatgctggagcagccagcggggagagctgccaggccactcctgacagccccgcacccgctctggatggaagcttctcgctcccagccgatacgggcctgctgcctgctgctggggctggaggggcccctctgcttgagccttggggtaccccgtgcctacgtgccctcctggctttgcccatggttggtggccgtgttttgggctgcgttgatgtcgttgtggagcccgctctgggcctcggcacgtctgagcttgattggggtggaaaatgcacctggtggtttgtattatgttgtttctgttttatttaatttcatttgccattcttatttcaaaagatgcttcctatgtttatgctatattgttagtttaacttcctaccctttccatctatgaatttctgtttttattgtggttctcagtgaccacactctaggggtcctttctctctctctctgtctctcccccctctcccctcctcccttcctccctccctccctcctaggcagagcctgtgagacttgcaggcatttccccagaacccaggccctcttggccatctggctgctgccccacccaaccttgggcctctcctggggctcctggatggttgggcgtcccaaatccccatcagcagagcacttggtcacaaggcccgagtcacatgccccagcttctccgaggaagtgcagagtccagccgcagggaggactttctcaaccggccctggggccagctgtcctgctcctccttgtttgctgtgggctcacctctgtgggctgctcactcagacccactcgcacccatgggaccttcccacctgtttctcctgcctccttcagtctgtgcccagcaccctgctgtcaagcccattcccccccagcccctgacgttggacatgctggaggagactgtggccctgtggcgtgttctgggccatctccagggcctggagcgggcacctgtgcccagcactggaggctgggggacaagtgctctctctgataaatgcccccgagtttcagttctgtggctgtagtttgtaggtctcctagctcagcatccccgagcccatgccctggggactcatggggccgaggagagaggagcgcagagaacatgaggatacgtgagccccttgcctgagaggtgtgctgtgaacctggagagcaaggccagtgggtctggggtgacagacagtgcgagatgcaggaaaacaggctcgagatgctgtgaatctggagaacaagtgggcctgggtctggggcgacagacagcgtgagacacaggagaacaggcgggatgctgtgaaaccggagagcaaggccagtgggtctgggtctgggtctggggcgacagacagtgcgagacacaggagaacagacgggatgtcatgtgcattgtggctggcagggccggcgcctcacacacacgccccggaagtcaggatgtggtgctgacggtgtccgcgctgccaggctggagcgggtgacggtgcctgcgctgccaggctggagcgggtgacggtgcccgcgctaccgggctggagcggagcttgctctctctgcagtgggacctgctcacttttccttagctggatgtatctttcacatttagcttgtttaacagcagagctggtgagaggacgcacacctggcgtcaccattgtcccccgtgcatgtccccggcgtccttcatgttgacgcgggccccgccccacggctcaggtctgtcaacttccctggaacaaggcagagcacttggcccctggaagacctggaaaccaggaacctcggaggcgctggcggccttggaggccgcttatctccgcgtgtctgaaattctgttttccaccttttccctttaggctggtaggaggcgcaatctctcaagccttccttagaaaggatgattgtcctccaccctgccccaaaccccctgtgttctgtgcaacgcctgatgagagcgttctgggttattcacagtaactgagctgggtgatctcacaagaggacataatgaagcccaaggagcctggtgggggccgggagaggccttgctctgagtgtggctcgcatgggggcagcgccttggcgtctgtgtgtggtgcggtggttttcctgccactctgtggaaggggcctctgccagacgccttgtcttcagggcctcaggtccctctgggcacggtgggtgttcatgtgtttctgcagggttaggctctgtgcatggcgtggtctgcaggacctggacagcccctgccccggggcatttgtgtcggccaccttggtttgcccccctgtccaaacgctgccagttctcgtcctccagggcactccgtttctgtcttttcattcactggacctccccacctcctgcgccgccccaccacagcaggccaggtgcgttctgcccccaggccctgtcctcgtggctctttgatcctgtgccctcggtgtgcaccgtctcgtggctctcgttagaaccagggtcggccacccccagctcccacatggcgtctggtgtcttgggggtcacatgtgtctgtctgcagtccctgggtgcctcaagctgtgtgttgcctgtggggcatgtctgaacctcaagtgggcctgagtcgtgagagaaaggctttctcatcgatactgtgtggtctgtactgttttgcagaatttctttttaattaatcctttctctttttcacagtgcactggtgattgctgcggtgtttgaccgagacataaactgcagaagagcagcctctgtaagttttctcattttgatatttcctttcctgaaggtggggggtgggcctggtctccctgatgctcctctgtgcactgctgcctggccagctcacccatccacagcaggagccgcgagggagctgctgagagtgccagctgcgggcaggccactggttcttactgtctctgagcgtcttcagcgtgtgaagggcggtcagggttaagcatccccagagctgcagccatcactgctgggggttgatgggtgatggaggcgagtgggaggtgcccgatgacaggtcttggtgcaggcagctgcacgctgaagacgcagaagagagtgggttctgcgagggtggccagaatgtggcggcgggacgggtcactcaccgggtggctttgagcctcgggaggggctgttgcgagcagtggtcagctctgcttcacccgccacactcgcctgggccttgctggatgtgggagctgcctgcaggaccgggtgcgtcttgaacacagatggctggtttcctctagagagagccctgtgacgtttggggtgaattctgggtgtgaggagctgtagcaactgctgctgcgctgagcagactacttcatttggctcagagctgggctggagtgaggcctgtgtctcttgggaccacagagagcggacagttgagacggtggaccagtctcaagataagagtctttatttcagatacagataagacgctgaacacgttttaagagggtaagaacagagaggcagccctttgagaaagatggaggggtgaggttggcttttggtgatggggtgggccccacagttcctcatgggctcgagctgctggaactctgtgtgcaggctcagcatagctggcttagtgggaacctgttgagggagccgttcacactccctgatactgtcagacttgggggccagtggaccaggtggaaggggtgctgggactggtgagggtttcctgtcagccctgcagtgtgtggcccctggtgagtgggaccaggcggaaggggtgctgggaccggtgatggtttcctgtcagccctgcagtgtgtggcccctggtgagtggggccgtgcgggtgcagtgttggttctctctctctctcaaatgcaggagctcagatgataccctgaagtctttctagctcaaaatgtctgtcatcttctatagcttctggtggtctgcctgctctctgtatcctgaagtagttagaagtctttctctgcctcaggtcctttaaaactagagagaattcaccaggagagctcagaagctcttctctgtccctgaagctgctcttattttgtcttcagcatcagtaaaaacctcataattttttggggaaatcatcacatttttgccctgctatttacccaaaggcagtaaatgtaagactttgaaatataatacaattttatgttaaatctgtacttaaattaagcttttagattttctttactgcaacctaagacatttcatgggaagcagtaataaaattaaagtacttaggcttctatgaaccctgaatatgaggtgaaataatataaatcatttttcacattaaaatccctttaaattggcaataaatcttttctgataaataccaccgagtgcacctagcttaccctgtagcttgcaaaattaaaacagccaaaagtaaaagacacctttttgaagcttagttggaaatgtgaggattgagggcctcataattgggaatcattttttggagctgctgctttcagataacgatgtctcggtctttctggctcagcttggcttcctgtttgacgctgtgtcactgggtgaggtcacccctgtgaggccctgaggcctcttcagcaccggccaggaggcagcagcaaaaggcgttgaagtcctgtccctccttggggctggacacggtcccttgcccctgaactctagacgccctgcattgccctggtgctcccatgtcaagactggccgcggtcgtccatcccatggtttgtgaccctcccagcaacgctgtgaggaaggtgctgcagctggttctcagcattggcaggagcatggcgactcaggcagtcagtgtgtgagtgagtttgtgaaaacagttccagctgtgttcgttgctgaatgctggtttttctgcatattggaaggaatctagcagacccccaaacgtgctgacattgcaaagaagacatgtctcccggcggggaaggaatgggcagtagagatggggtgtggtcgtggcttcttgttcatcatgaggaagggagatggggccccgttcactcacagttaaagtaaaggcacttaaagcctacatttaactgagaagattttaaatcttttttttccagcacttcgtttgatacatagtgtgtgacctatatatgtgactttttattttgggataattgacattcatatgcagttttatcccatcccctcccctcccctcccctcccctcccctcccatcccatatcgtcccctcccctcccctcccctcccctcccactctgtcacccaggctggagtgcagtggtgcgatcttggcttattgcaacctcggcctcccgggttcaagcagttctcctgcctcagcctcccgagtagctgggattacaggcgtgcaccaccatgcccggctactttttgtatttttagtagagacggggtttcaccatgttggccaggatggtctcgaactcctgacctgaagtgatctgcctgcctcggctcccaaagtgctgggattacagacgtgagccactgtgcctggcggagatttacatggagttttaaagactaatgcagggagagcccatgcgtgtttcaccattgcctccatgatgaaatctggcaaaaccgcaatggaacatcacagcctagaacattgagccaacccaccagtcttattccttcttccttggttttacctgtactctgtgtgtgtgtgtgtgtgtgtgtgtgtgtgtgtgtgtgtgtgtgtgtgcacgtgcgttcacgcgtttagttctgtgtgattgtatcacatacaaattcacgtatccaccaccacaatcaggatacacagcagccctgtcttcccgagaggcctgtgctactgctttgcccacagtccctgctgtttccctctcctgacccttggcagccaccggtcggctctccgttgcctattctattctgtcatctcgagaatgctgtgtaaatggactctgtggcctctaatgctgtagctttcttctctcggcacagctctctggagacccaccccgagcgtggtgggtggtgctggtttgctgcttctgttgctgagtggtgccgtggtttgtgtgaccattcatgtattacgacatcaggatggtttctagtctttaagctgctgtaaacattcgtgctcaggttttcgtgtgagtgtaacttccatttctctgggttaaatgccaggagtagtttctgggtcgtggtagttggacatttaaactgctttctagagcagctgcaccattcacgttcgcaccaccacctgcccgcagccctgcctttctctgtcctcgcttgtgtctgacatggccactgttttctgtgtcggcctttttgacaggcatgtggtgatacgtcgttgtggtctttacctgcgtttctgtcatgcctgatggtgtggagcatctttcacgggcttacttgccgtctgtacctcctctttggtgaaatgtctgctcaggtcttttactcatttctaagtggattgttttttgtagttgttgagtttagggcactctttacatatgtaggattctggtcctctgttggatttgcgtttggctttctcccagtctgtagctcatctttccgtcctcttcatagggcaagagtttttaattttttaattttgctggggtctcgatcagttttttgtttttgtggctcatgtttttagtgctttttaagacgtgaagactttcttaaggtctgggaactccacctcgcccggtcccggggatgctgtcccgtgttttctgttctgctggttggtctgcgtgtctgttctgccagcgcacactgtgtgacgggctgtgctgcgatgctgctgtgcatagtcagccttcgcactgggcagggagatgcctcccagcgtcttctttctcaggactgttttccctgttttagggcttgtgcttttccacataaatcttgaatttttaaaacatcttttagataccactggaatggtacatgtcttcctaatagtgtatgttaaattgatgttacagtatatctttgttgcattgccttttggcgggttttgtttcttactttcctaatgaatttatcacaaaagttacaaatttgcaaagcagcagtcaggcctcctcccagcctgctgtgaagcgcctgtttcctccaatctccagcccagcccaggggtctgccttggagccacccgcacgtgtggtttctgtgtgattggccagaggtggtgggcgcgtctgctccttttccctggggggtgggggcacagaccctgggtggctgtgttcggctccttacttggtgcccgtctgtgtgtgctcctcccagcagccatcgctcaaccttgctctcaggaagcccccaggcgagtgttggcaggaatcctgccaggcgggaggtcgctcctccagagcgtggtccctgaagccgccagcctccctggcctcgccccttgctggtggtgtgtgtggtgtggccgtgggtgcactttgctgggtcttcctgggacactgaagtctcctgtgtctccagccctgagaactcggagcccgggtgcttttgggaaggacggggcaccagctggtgacacatgggaagggaggtgtggttgtcaccttgcccaggtaacctgctctgcctggtcggtgcgcctaaggggggcagggtgtttggggaggacatgagaggcctcctggaagcacttcatcctgttgaagttcacattttgaccttttcagcagcccttgctctgggcctgtgcccggccctgggactcggcctggagagcctattgacaccgtgccatgggtgcgggcagggcgccctccctggagggcggcacgtggtgccagttggtgaccatgagctgcctcactcctgaggaagagtgttcgggctctgggctttgatttaacctgcctgtctgtctctctgagttgacagccggggcctccgcgtgggtgctgctgggaggctcagtggtaaaggccacttttcaggatgtgtctgattttataaacttgaattcttaaattgtggttttaaagagcaccaggacgtaaaaacagagtgacgcaccttgaggctctgttcagccaacaatgagggcttttatttaaaaaataaagccgtgggtcattcacgttgtgctgtttgttctgaacttgcctctggtgttggcggaagctgacctcgctcacctgctgtgtttgttctttgctccgcaggccgccttccaggagaatgtggggagacaggtatggctgctttcaaacacctttattccaaaaacttcctgcgggtttataggtaggaatcttgagagctataaccctggtgtcttctcgcactgtgagatgtggtgtggctacatcaatgccagggtcatgagttcactataggacgcacatgttaaacagcgagtcctgtttcacagggaacctgcatgtacagtaatttacacacacaggccggaaagctgtgctttacacgttgccaagagccacataatgtggctctgcagggtggggcgggtccctgggaccagcctggccttgcggggacgcagacctgaccccgcctcatcccacacagagcaggagctggctctgttgacgtcagcttgtgcctcatccagaccatagacgggcccagaagtcagctcccagaagctacggaccccatgaccccacgaccccacatcatgctggggctgcttttgctgtgccctctgaccctgacatctggtcactggtcagcttcgcctgtgaatggggggccccaggttactcatgttgtgtgtgatgacgtcacatcttgggcgtgtggttgggtcttgcaggagagtgggacagaggccggagaggggaccggggtctgggctggacctgggcggggagcaaagttcccacgagaagtcagccgagaaggctctggagttcccggacagcaaagcaaatgcagccggggtctgggctgtggccaggtggtgtggggcggcatggggtggacgtgggcctgcggacccttctgacctgtggggagccctccaggcaaggtgtctgacctggagtggaagcattgaggccaaatgagtccacaggaaaagccggatgccagagtcagctggagaggcgggcggacgaggacttgcgcctgttattgaaatggttctggaggagcctggcgtgagtggtgtgggcggctttctgtagacggagcccaggaaggggcgtgactacttcttgctggcccgaggcagccgaggcccacccagcgtccttggggtgccgcggggcctgcatgtgttcagagccctgagccctggtcggagccagttcactaggaagagacaccagccttgcaaggggagcctgggtgtgcagacagcaagagccgcccaggccaaggagaatgtgaacgaggtttggtcttttgagtggagagtgtggctgctgtgaggaagaaggagcttgttggaaaccacttagctgagccgagggacttgccagcttcctggaaagtgagagcccaggagaagaagtctccctgtccctgggcttccagcccctccagagcccccactggagaggggcgtgctgaggccagagcccggggtgacgaccgtgctgggtgggccctggggcgcactccgccatcactctgtgttccgggttcccagatgctgcttcctgggaggagcagcccggtcgcatagggagccacggggccctgcagctgagctgaccagcctccctgtgtgtgtggctggatttgagccacgttacctttatcggggcagctcaggttggggattgattgacagggaaaggaaaggcctttacacttggtctaaatttaggcaagcagccagaaaatgggatattcccgtgggtgcgggagtcttgcacctcagtcctgagcctgagcagtgtgagtctcagagcatcctgcacagtgaccagcatgcggacggcagtgggagcctcgtggaagaagcggcacagattttgaagagacacagactttgaaagaaatgcaagacgcgcaggtgcggagcgtctcccagccccgcacggccatgtcctgctgaggttggatagaaacatttgagaagaaggtcgagaacttggcaaggcaaagcaaacgggagtggacgtgtcgcatagcacacagggaagcagcctaaaaaccctcggatttggaggaggctgtttctaatacacagatttggaatgaagttgtaagaaatgcgttacagtggaggccgctgggtaacagcagcagggatggggggtggttggggagcggcctgggggacacagagggggctgggggcagagacgagggaccagcttctctgtccaggttcgtcttggctggagttggagactctggtcctgagtggtctctgccttctccctactgagcccaggggctcttgagcaggttgtgactaacccatgggcagcttccacgttcagggcctgtccgacattccagccctatgaccctgctcctaggcgagtgctgtccaggcccccgacaccatcaggcccttgtggtggcctgtccacacccaggccccccacttcccccctgcacaggtgaggaagttgaggctcagggcagctgagcccgcttttgtctgctcggagcctgttgttccagccctagcctggccagacagagccttggcccctgtgttggtcttgctttgttctcaccgtggggggatgctggacacagagtccccttgttcttgttctcggtgagacctggtcctgggccaccccggatgtttccctgggctcctgcctgctgtgatgtggggcatggagttgtaccccagtgggcgacatcccaggttgtggcacctgctgtctttctgcagagtgagccgcaacagctccacctgggtgcaggtttctcccctgttcacggttcagtgaaggatgctcatgctgtcactgattgcagcagcctcaggcagaagtttatggtatctccatcagcccaagctcccagtgtaacccttgggagagatttgctggaagaaagccgcatggtacctgctcattccggcctctcctggtgggaaggagggatgtggccccgggtgttctcaggagtgctggctgttcagttacgttgacttgcgaagctattacatgaaggtgtgaggttttaatggtcaagtgcagggtggtgatgaatgggttaaagacgtcaaggaaggatctgaatcccggcctcggaggtgggcaggcttgggagacctttgaaaaaccctgctgtggtttatagctgtaaggctttctatgtggggtttaaagtttgtcatttgtattttcttaggaaattatttatgttgtttccagaatttcacatcctggaacctgagagtggtatcagtaacaccatgtaggctgcggggctggagctggggctccactgggaggctgtcgtggcggggtgggaggaggtgccgcctctcccatgtcagagcctcggcggctgctggtcctcgatgcttctggggtcagctgtcaccacccccaagaaccggctgggccagctgcccccagtcaacgtcttgcctgcccgggactgctgagtgaggcctgggctctggtccaggctttgtagaccgtgcaggcggctgcatccccgacctgacccaggcctgctcgctctggtgtgcaccgacctgccagctttgtggcactttgtggcatggggctcaggccgatggaggtcagtggctgtaacactgttgagacccgaagaccgtttacggtgtatgttttcgggaaaggtctcttaccacgtaccgaagtggaaatgtttgagttgtttgaaaaagatgaaatacttgtgagtggtttcaatgatttagcgtggtgttgcctgggtagaccgtcaggaagtcagtgtgacgtggaagtcctcggcgagccatgtctgtggtgtgtggcttgctcaccacctgcctcagggctcggggttcatgagtgtaaatgtctgtggatgtgattattgaacttggtgaaatgcctttgttcattcaaattcttctttttcccccatttccactttcttattagggcactttccctcatggtattgatattttgaccacagctgactattttgccgtcggtaacagatccaactgtttcctggttataaggtaagtctttaatgtatatcacaaaaatagaatactctaaaatcagattggatgtcagaaatcagctaccaccattttcttttttcatcctgtaatgtccactcaatggaatgtagtttttgtgtgaaaaattaaaaatggaattgggaacagtgactgaaacttgtgtttcatgttgattggacacacctcatgctttactacgctagataggggacatttactcacgtgttaaagaggggctcagcttcaggagtgcggccttgccgtgagtgctgtctctgcttatgatttttctcctggtcgccccgttttacccgtgctggttctgtgtggggcttggagtttgagaggaagcagctgcaagcacggccacacctcctcctgatgcttccctactggatgtcctaaatgctttcccaccgtgaaatcttggattagaagggactgtttctttctgtttcggtaataggaagtgttttgagggactgtttctttctgtttcggtaataggaagtgttttgaagttgaagttatctgtagattgtctatgaaatgagtaagaggtattttagaaatcaggttagaaacaaatgtttagcacctctaattgcagtttacagaattatatcaaactgttttagttgtgtaattaggtactggggaggttacttcagttatcttagttgatccattgcagcagaaatgtgaaaaagggtgtgactttatttatttatttttggagacagaatctagctctgttgcccaggctggagtgcagtggggtgtgactttatgaagtgatttatttgccttaaattaggaccagaagcatgcccgatgcatttttaacattaaccattaaataccctaaagatcgattccccaacagccctgctgtgtagaccgtgcagaaaggacgtttctccgtcaccagcctgggcagaattttgaaaatgtagcatttggcctctttcccaggaaggatctttgaacacacttatctgtatttttataccctttcaggtttcctcaacatttaatgtccttttttgccttatcagttctttcctattaatacttggccatatattttatgtggaaaatctactggcccgatgcagtggctcatgcctgtaatcccagcactctgggaggccaagacgggcagatcacctgaggtcaggagttggagaccagcctggtgaaaccccgtgaatactaaaaatacaaaaattagccaggcgtggtggcgggtgcctgtaatcccagctactcaggaggctgaggcaggagaatcacttgagcccgggaagcggaggctgcagtgagccgagatcgtgccactgcactccagcctgggtgacagagtgagactccatctaaagaaaaagacaatctaccaccttttcccgagtttcctgagtaacacacctgacagctatgggaagcttcagcatatttcccttgttgctgaggtttctaagccagcctaaaactcgcatgtaattagctgtgtgcgttttataaaaacatttgccaacccaagacctgggtccaggcatgtcttcccccagtgtgtttggcttcctcacgatgccaggccctgcgtgcagaccagatgccacttgtgaggacgcaccggcaggcaggcccctccaatcctgagggcggcatcacggggaccggcagtcatggctgcaccctagcaccgcggggcccccctgcacccgaggcagggtcctgctgtcagcctggaccttggggtgagggaggcagtggtcctgttcagcagagggcatgggactgagcacagcccatcagggaggagagttagcagggccctgggccctggcggggagctgctgggggcctttgagccatagtgaagagtgtggattgtcctgaggtcatggcactttgatggtcaggtctttgttttgaacatatccctgtggctgtatttggtgactggaaataaggagagggcttgagggctcttgggagacgggagagggctgggggcctggaggtgtgcccgctggaggaaggtgggagttgccagggcattacagagggtctcagaactgtgttggcatcactccgcaggtggagggcacagctgagggcgacagtgtcgttgagtgtgaggaggttggggcctcagcttgcacgtgctggcctgcgaggaagcatcagccgtgctgacacggagatgtttcctctgcaaattggagtttcggacacacagactggaattgaactaacgggcaccccaggaagactgtggggcgagacgaggaggatggggggaccagccgtcgccccactctcctgttcatcatcacagcctcgttggggtgtaaacgacccccagtaagctggtgcatgttcaataggtacatttttgtaaatgttaacatctgtaaattcgtacctatcaccacaatcaagacgagaaaaggcccaggtttcccctttcccattcggggtccctcccctcccacacccccttcttcaggcacccctggtctgttgctctcactgcagctgtgtctgcatttcccaaagctctgtgtgaatgggttcaggcagtgggcactctcctcactcacactggcttcctctgctccatgcttcctgcagactgtccgcctgtggggaccgtcccccgagcctccagggccaggggtgtggtacgtggcgtctgtctccactcacctggtgaggggcttctgggcagtgtcttgtctgggttgtcacaggtgcagctgcggtgaacatgtgtgtacacatctgtctttgggcctgcactcttgttctctggcatagatgcccagagctgggtggctgtgctgtcagttttttttttttttttttttttttccttttgagacagagccttgctctgtcacccaggctggagtgtggtggcgcaatcgcggctccctgcagcctcgacctcttgagttcaagcgatcctcccacctcagcctcccgagtagctgggactacaggcacacgccaccacgcccggctaatttttgtatttttctgtggagatgacaaatcatgttgcccagggtggtcttgaacccctggtctcaagtgatccacctgccttggcctcccaaaatgctggccttgcaggtgtgagccaccacaccctgcctgtagctttttctgaaatggccacatggctttcggcgtgatggtgccacgcgcccccggtgctggatgagctcggggtccgggatctggggtccttgccggcgctgggggtgttggtctttcaagctcggggtccgggatctggggtccgtgctggtgctggggtgttggtctttcaagcttggccattgtcatgggggtgtgggagcagctgactaactcgtgttctagtgactgatgatgcagtttcagtcatcatccatttcaggggcgtgtttaacacatctttcgcccatttacttattaggttagtcgttttcttcctgttgagaatttgagaattcttcatgaattctgcatacaattcctttttcagatgcttccttgctacatatttcctcctgctccgtggctttccctttcagtatcctgtatattcctaagtcaaagcctttttaaaaaaaaatcagctttgggccgggtgcggtggctcacacctgtaatgccagcactttgggagacccaggcaggcagatcacgaggtcaagagatcgagaccatcctggccaacatggtgaaaccccgtctctaccaaaaatgcaaaaattagtcgggcatggtggcgcacccctgtaatcccagctactcgggaggctgaggcaggagaatcacttgatcccgggaggcggaggttacagtgagccgaaatcgcgccactgcactccagcctgggcagcagaatgagactccgtctcaaaaaaaaaaaaaaaaatcagctttatctttgtacatctactttattacatatagtttacatatagtaaaattgccagttttcaatatgggtttaagtgtggcagcgggtttggcagatgtgagctgttgaatgaccaccactgtggtcagtgtggtgcacatgaccctccctccaggaggcgccatcctgactgacctcctgtcgctggggctcccctgttttagaatccgtgcaggtagcttccttcatctgctgcctgcctcatcagctgcctgtgtttcagggttcctcagtggttctcactgtgtggacgccccacatttgaggggctttgagcccccgtgggttttgatgtgagcacacggcacagctctgttctccccggctggttttctgttggagtgagcattgagcccccgtgggttttggtgtgagcacacgtcacggctctgttctccccgatggttttctgtttttcatgagcattgagcccctgtgggttttggtgtgagcacacggcatggctctgggttttggtgtgagcacatggcatggctctgggttttggtgtgagcacacggcatggctctgttctccccggctggttttctggttttcgtgagcattgagcccccgtgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggcacggctctgggttttggtgggagcacacggctgcttcccacagctctgctgcagaccctggggcttgggccgttggacagctgagcagaggcttcgttttcttttcctatgtgcaggaggctgaacaccgcttcaagtggttgaagtgtgtgtgtattttctgtaaactttttgatgatatttctgctacactattttttttttattgattcagaagaactggtttattttagggaagcctcctgttggtaagatcagttgcggttgttttttccagatttgttgtttgacttttgactttgtttttggtgttttcctggtagactttgttcggcatatgtgttggtagggatcgatttcttctgtggctctgggtttcgagtcataattagaaaggcatatcctacttagagattattgtttaaaagtcttccgtgttgttttcacaagatgtaacttttatttttgagacataatttacacgctttcagctgcccctgtatggagtggacggttgtggaggggctgacagtgtgtccacctgcgtcacctgcatcttccttgggagtggagctcccaccacttccacggccaacactccttccccccagcctgtgtgctgctgccctgccctcgacgcggagcagggctgcccctcggggaaggtcgtatccatggaaccagagggaacacactcctgtgtgtcaggttctttgctcagcgtagtgcgcctggggaccgtccgcagcgcgtgtgtcctcagtgcatgtgtcctccgctagtgtcctcagcgtgtccgcagtgcacgcgtcctcggctcgtgtcctcagcgcgtgtccgcagtgcgtcctcagcatgtgtcctcagcgcatgtcctcagcgcacgtgtcctcagcgtgcgtgtcctcagcgcgtgtgtcctcagtgcgtgtgtcctccgctcacgtgtcctcagcgcgcacgtcctcagctcgtgtcctcagtgcgtgtccgcagtgcgtcctcagtgcacgtgtcctcagcacgcgtgtcctcagctgcttttcgttggtgagtctttgctcagcatcgtgcgcctggggcccgtcctcagcgtgtgtgtccgcagcgcgtgtgtctgcacctccttttggttggtgagttgtgtgcactgttctgtggctatacagtttttctgtgagtttgcctgacatttaggttattttgaatttttggctctgatgaataaagcagttgtatatatttatttagaaatcatcttcatgtggatgtgtattttcatttctttcagataaagagttagaatttttatatatttaactttatgagaaactgccaaactgttttgcaaagtggctgtataatcttgtactttcaccagaacgtatgcagcctctggttttcccacatctgtgccaacgcttggtatttaccagtcttttaaaatttacccattcgagtgggggtaacgatttaacaattagcattcctggctgaatactgatgttggacatcttttcatgtgtttattggccttttatttattttcttttgtgatgtttatgtacaaattttgtatcaattttttgtttggggtttatctttatatattctgttacaagtcggtttgccttttgattttcttaaaagtttttaacagctttgccgaggtataatgggcatatgttagctgtatatggagtgcagggctttactgaagtgcagctggcacacactaaccagagcgcacagcttcctgtgtgtgacggaggcctgagcacagccatcaccctggagcccccccatgtctgctccttgtaattcccgcctcggtcctcccccaccctgaggcccctgatctgcctctgtgggtgtagatgagttttttgcacgtccttgaattttgtgtgaatgaaacaaagctgtgtgcactcattttgtcagtcttctttggcttagggtagttgagattcagattgtgtgtgttgttgctgagtattcgattgtgtggatcaaccacggtttgttttccccgtggatgatgtcagggtggtttccagatttcgccgttacacatgaagctgtgtgcacgtttgtgtaaagcccgtgtgtgcacagatgctcttttcttttgggtaactgctcaggagggaatggctggatcacgtggtagatttgaagaaatgggcaaactggttttgaaagtaactgtgctgaattcccacccacaggcagtgagttctcgttcttccgcgtctcaccacctctccatgctgtcttttccagtgtgtttattgccggctttcctgagtacacgcagccaatgatagaccacctggttaccatgaagatcagccactgggatgggtaggttttctgtttttgtttttctaagagctttttttccccccaaaggagagattcagttgagcttataagccttgagtgtattttctcactgtggatgtcgtattttaaaataacttctgagaagtaatatgaattccagtcttcatgccggatgtgttgagtcatggtctgtctccagttccacttctggagcgcctggtccagtgtgtccgacgtggcggtgtacccgtgcgaatgtccacgctggcgtgttgtggagtgccgctgccgtccgagggggcgcgggcgtagcttggaggcggactctgcgttgtctccctcagcagtgcttcccgctgactctgctccatgtggctccacaggtggtttctgcgctgtctcctgggagcccagcagttcttagtggccgttttcatcattacagtagcagcttcagggtttccttgcatttcataggcagttaaatgtgtctcagaaaggaaaagtgaagtgcggtctggagcataaacagcgcgttagtgctgtgaccgccgccctgaggaggtcagagggtcccctcctaggacagtgccgtgctgtggcactcctcacggagcctcgaggagcggcaggtgcctgtgggtggaggtggctttgtgagggtgcgagtccagaatctcagtttcagagttggtgtgatgtggagggggtcctttctgatccatgggggatgcgtttgctgctgcctggggagcggcccggctgcctgccgtggtcctgctgcctggggagcggcccggctgcctactgtggtcctgctgcctactattggtcctgcttcctggggagcggcccggctacctgcggtggtcctgctgcctggggagcggcccagctgcctactgtggtcctgcttcctggggagcggcccggctacctgccgtggtcctgctgcctggggagcggcccggctgcctactgtggtccaggcagggccctcaggactgggagcctctgggaaaggaactcctgggtagcactcgggctgccgggggaagaccctcccttcattcgcttacagagaggggtgtgaattcctgagactcggggtgtccctgcaaatgttacaccaaaactctctccattaggtacaaggtcccctaaaccgaacctggggaaaattaattaatttgtcagttgtatcagccgattagtcaataacgtctttaaaaccaaagttacagatatatgcccatagcgtcggagctgtgggactctccagttggtacatatgcccgtggtgtcggagctgtgggactctccagctgttgctgtctgtctctgcctcagttctgtcggcctttccttcacgtgttttgggcggggtcacttattggaggcagatacactttcgctttttgtctcttcctaatgtattgaccctttatctttgcggaacggccctcattgtctcgtgtgagatttcttgccttaaagtaactgatgactggtgtagtacctgagttggcaagccttttctttgaggggctggataaacgtggtagatctctgttccatacgctttgctttagtttattttatttagtttatgtaacccttgaaaaatgtgaaaaccattcttagctgagggccgtccttactcgaagaggcctcgggctgggcttgcggctgcagactgcattgcctccgcttctcaggtgctttgtcttttctgttccctcagagttgcaggcgatggtcttctagacagcatgcagttgggtgtcgctcagggtgtggagtcctggcacatgagacgccacctgcctcgaagagctctttgtttaccgttagaagtggaccctgagcagggccctcggccgacaccagaggggctgtggcaggtggtcctgccagcgcgggcgtctgccattgtgcctggtttcactgtggtgctgtgggtttggtgtttttaaataattagaggacagacacccgccttctgcatgttttcaccttcacattttgcttctttgttgttacatggtcgccctcatgatgattttaagtcaggaccacttgctgctccagctgggtctggaggggctggggcatgagctctgcgggtcgctcccagcttgaccatctgcctctgcatggagctctggaaggaggggtgggctcaggaggggctccagcctcttgagccggtcctgggtcagcctttcgcggtccgcatgttcaaccatgggtgctttcagtgtgtgtctgatgaggcagttattggatatgtgccccagatttggtgggtgagcctcaggaaattccttctgttcaccccttgtaatcgtggaggggtggtttcacgtggctctatctcacactcacaacctcagagtagcgtgggggtggggaggccggacacccaattgccacctggccctgagaaggaaaggcagctgtgtcccaagaagaaccgtggttagccgtgtgacctcgctgttgtagactgtccttgtcgtctgttggagtcggaggttcttgtactggttcgtgtgagtgagtgagtgagcctctgctaagtggccggttgaggactcgtgtgttgtctccctcactttctttttatgaattgaataaagctagaatcataaaatgaaggcacttacgacattctctcctcactctcagggtcatccgagagttggctgcgagggcgctgcacaacctggcccagcaggcacccgagttcagcgccacgcaaggtgggtgtgtgtcccggccggcctgcgggcaccatgcatgcactgcagaaaggcctgggttgctggtttcaaaggctgggggctgaaaataaggttgtgcttctgtcttggtgagaagcatctgaggaaagagctgtggacttgatcagtggataggctgtgaggacggatgcggtgagtgtgtccgcctgcagggcagggagccgctgaactgtgttacgtacaccggagcccgtgatggtcccgccggatgcctgacatgcagtgctgcttccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctaggtggctcgcacctgccacacgacactccctggtctctggttggcatgcacctgccacacaacactccttggtctctaggtggcttccatctgccacacgacactccctggtctctggttggcatgcacctgccacacgacactccttggtctctaggtggcttgcacctgccacacgacactccttggtctctaggtggcttccatctgccacacgacactccctggtctctaggtggcttgcacctgccacacgacactccttggtctctaggtggcttccatctgccacacgacgctccctggtctctaggtggcttgcacctgccacacgtgaatgcactttggaattgggcagcgtgtatagaaagaaaaggcctgaatgggagactcaaagtctgcccaggactaacatcaccttggaatggctcagctaagtctgcacttcttacacttcatcagtgaagagagaaatcctgtttgttctgtcttgtttttttctacttggaataaataatcatctgacttaaatgtggggaagaatacacacatttctcaatgtgtgtaccgtcactcccccgacatttattacaggggctacactggaggctggattgtggctcttcagtggagttactgatgtgacgcctgtgttgaacatcctgtgggggctcgttcattcctaagggatctttcagcttcgtgatctgttaatgaggcatccacgtcacgggtttagtgtggcgctcccctacttttcagtgataattaacccttgctgacactgagggggctcagctttgtcctccacccggttgaagagcacggacacccagaacaggactgtgaccttttgtagatttctctgattctcgaaaatccgatcacccccagccgccacatcttagcctctctgattctcaaaccatcgcaagcctggcagcacttggggaggcttaggctcggggagcttggtttccccacgcaggtgtggcagagccgcctccctctgcgtccgtgagggttctgaggagtctgtgctttctgagcaaactcagagtagaggcaccacccctgggggcagccctgcctctgtcctgctccgccccctccaccgcccaggcagccaggcagagctcctgccaggaccagaggccaccctacaccgacagggaaggcctggggagtgtgtcgtcctcctccatgctccctctcctgtctgagttacccaccccgtctggggcacttgggagcgggccatgtccagcacaccgcagcctccgtcctgttgcccttggtgtctcaggggccatctgcatcaccacgggtgccgtcctgggcactggggtgatgaccctgagggatgccagtgtgggcgggtgcgtgtgggcgtcccacaggtcgtccgtgtgtgcacgccgtcgcctgccctcccggccctgtgtgggtgcgtgtgggcttcccacaggtcgtccgtgtgtgcacgccgtcgcctgccctcccggccctgtgtgggtgcgtgtgggcttcccacaggtcgtccgtgtgtgcacgccgtcgcctgccctcccggccctgtgtgggtgcgtgtgggcttcccacaggtcgtccgtgtgtgcacgccgtcgcctgccctcccggccctgtgtgggtgcgtgtgggcttcccacaggtcgtccgtgtgtgcacgccgtcgcctgccctcccggccctgtgtgggtgcgtgtgggcttcacacaggccgtccgtgtgtgcacgccgtcgcctgccctcccggccctgtgtgggtgcgtgtgggcttcccacaggccgtccacatgtacacaccctcacctgccctctcggccctgtctcttgcagtcttcccgaggctgctgtccatgacactgagtccagatcttcacacgaggcatgggtcgattctcgcctgcgcagaagttgcttacgccttgtacaaacttgcagcccaagagaacaggtaggaagagtgggtctcgaggagacacagggctctgtccctgatcccctcaccatgtaatcacagtgctctccagttcgagactctctcatcccttctcatttttgtttatctgcaccagtgtcacagtcgataggccccaggttgtattgatggagtgtgtaagtggccctctctcctgacggtcatgccgtgggtggaccacccacctcttcagcggggcgggtgcagcacccggatgggccgggcatctccccacggctgtcctgcccctgctgcctccttgtgcacctcctggtctcagaggtgacaagcgaggtcataacagcaaaggtcctttttccaagacggcattgagcgacttgcatgttcagtatcctttcttcatcacgttccatagtttaaaatgccagagaatatacacgtttcttttgaatttttcagttggctatgtttgtacaaataataataaagcatgaaaaacatggggtcactgggaagttgtgtgcaggaggctgtaaggcatcgactgtcgtcttacgtttcttcccagtcgagtcttcctcaagagtaagaactcccggacttaccatagtgacggcaacctgcttctcggactccagtttaagaaacgtttttaagttcatgccctgtgctggagacagttccctgggaacgggttgagagcagggtatgggcccacctcccgcccaagcctgaggaagctctggtcggccccgagctcagatgcagagtgcagctccttcagggacgctcgctcgtgtgggtgcagctgatgcccgtgcaagacctggcctttatggcgctgctctgtggttgtggaagaaggcacatggggtggggtctggggagaaccaggcgggagctcccagggtcctccagtcgggtcccacagggcctgtgtcattcccccagcagtgagatgtgaccacacctgtgaggtgtctatcagggaagcacatttgagcctcagtgcccaggctagactggggtctggccacgtgggcacctccgcctggcacgaaacaaaattccagacccccagcaggaaagcaggtgccagcgtaaagcacacggtttgcgcagattgagccagtgagggggcctcatgaggcagggcttggtccaggcccccgcatgccagcccaggtctgatctcgccagggaccttcccttggatgtcagtggacatgagctgtcgtctcagcctcacctggacctgtctgttttccaaggtggtcacattggcaggggtcacagctttaaggggatgccctaacatcctcttcctttgaccaggcactgcttcatctaaaatcacaaatgggccaggcatagtggctcacgcctgtaatcccagctatttaggaggcggaggtggggggattgttagggcccaggagtttgagaccagcctgggcaacatagtgagaccccatctctaaaataacaaaacaatgcaatgtaaaacaatacagtagaatacaaaaataatcggaggtatgtcctgcagaggtctctgggacccactgggacctgaacaagaatgagaccttgctgagcctatgctcctccaagtgtacttggggttagggtcttggggagtgtggcctcagctcctccgagtgtactcggggttagggtcttggggagtgtgacttcagctctgtgtttgaacttctgcaggcccgtcacggaccatctggacgagcaggcagtgcagggcctgaagcagattcaccagcaggtttgtgtgcagcctctgggtgtaccctcaggaggcatcacaggacctgcccccttagggcctcccaccctccccaggcagggtctgcagtcctggtggccactgtgctccatcagtcctgggctcagtgggggacctgcggtgtgatcactctgggaacaggctctccgctggcgtcatgcttgtgaacagccaccttggagggttgccctgggaggggaagagactcctaggaaatgagtgcagactttctgtgcacgtagccagcatgtccttggtctctgaggaaggcttatgaagctagtgcagtcggtggaggtttcggctgcagctggagtgtggtttccctccggggcgcgcggctgcggtcccacgatggagcgtgcagccaactctgggtgggggcattgggccccgtgctctcctggtggagttgggggcacacagaacgagcacagaagcctctggtttccagccgtgcatctgcagctggggtctgatgtctcctgaaagtaaagcagaattttgtgtgtgcgtctgtcggatttctctggggagacagtgtgttcatctttctgggctttgagagattctcaaaggcttctgtgacccagaggtaaagtatgaactatggatcttggtgttacaggagaatataaaaattgttcacgagggattacgtggtttacttgtctgttgtccagatagctttatattctttaagattcagctcggattcttatcctatttttgccattaactttcattatgattttggcaaagccattttgtttgcttacatttttcacttttaatgtggtgtctggcctccccctctgaccgagacaagcatggctgcagagtgcagacggggaggtggccccgggcagcagccatgaacgtggcctccccactgacgctgagccatggctcccttttttcagtaaaatataagcagtaatagagccgatctccttgagtttttgtgagaattaaagaatacattttaaagaattgaggagaatttttggcacagtgtgagcattcagtaaattttagttgtagtggccatcacaacgtggcttttaagctctcttacaaaaaaagaaacatcagcatcctgtttggcacagttacttttctgcacaagaggctgcctgggtgggttctacgtcggtctctggggccagaatgcaggtggctccagctccctactctggccctctcctccctctctctgtgcctcagtttccccttcaagggagctctgggcctgtctggaggttaaacaaggccatctgcgtcagtaggtgggcctccgtcctcagccccctaggcggctctcctggctggcatggcatcttctgccattttctctttgttcttgtttttgacagttgttaacgtatacgtattattttaaaatttaaatcattaaataactttcagttttttattttcagctctatgatcgtcagttatacaggtgagctttacaaaaccaaagttcttatatctgtgtcctaatgaagaactgcgctgtcaggagcaggcggggcgggtgtgttcgcttccctctctgcatatgtgtgtttgggttgagcgggtgggtgtcacccggcccgctgtgggaggtgcatgagggtctgacctggttgtgtgattgggttgagtgggtgtcacctggccactgtgggaggtgcatgagggtctgacctggttgtgtgtttgggttgagcgggtgggtgtcacccggcccgctgtgggaggcgcatgagggtctgacctggttgtgtgattaggttgagtgggtgtcacccggcccgctgtgggaggcgcgtgagggtctgacctggttgtgtgattgggttgagcgggtgtcacccggcccgctgtgggaggcgcgtgaggttctgacctggttaggttttcagctctgcaggtgtcatcgcgtttcctcgttcccaggacttgctggtcataggcaggggtgtggcctccccaaccccgagatctggccgggtgcctccctgagggtttccctctgtgcctttgcagcccaggcagcctgtctgctctgacagattgctttgctttttctagaatttgctaccgagggtgtcacacagtaggaagcctttgggtgtggtttcttccccgacgtgtctttgagatacctgtgttgctgtgtgttccgtggtgtgcacgtacggcgccgtgttatccactcaccagcccaggctcatctgggtttccagcctttggctattgtagggaagctgctgtgcacatctagacgtacaagtcttggtacgtttcacgtttcctggctgactaccaggagcagcatcgcagggtgtggggcacatgtgtgacttctcagcagccgagccaacttcccagaccctgctgctgcacgtccccatccacaagtgaccccttggtgtggtcggctctgaacgtgggccctctgggtgagtagaggcctctcgctgctgctggagtctgcctctccccagggctcctggtgctgagcctctttccctgtgctgacgaagcattcctgggtctttcgtgaagttttttgctcattaaaaagttcagactttttgctcattaaaaattttatcgtctgtcttattgagctgttagaactcttcatatattccagatgccagctctttgtcacacacaggatctgccagtgctttctccagctctgtggttcacttttcttttctcttagtgactttttttttttggagaagcagtctcactctgtcgcccaggctggagtgcagtggcagcatgtcggctcactgcaagctcacctcccacgttcaagcgactctcctgtctcagcctcccgggtagctgggactacaggtgccccccatcatgcccacctaatttttgtatttttaggagggacggggtttcaccatgttggccaggctggtcttgcactcctgacctgaagcgatccgcccgcctcggccttccacagtgctgggattacaggctgagccaccgcgcccagcctcctagtggctttttactgggacttgtgtggggtagtgaacctcgtgctgttctcctttaccttcgaggggtgaagcctccctttctgcctcctagtccttccaggctgctcccaagaggtcccttggctgctcccaccagtttctggccacctcctcagtcagcagggcgggtggccctgtttgggctccaccccacacactgggcctggagggctccttcaggtgctccttggggtactggaggacccctgccttgggcctcagtcctgtactcttcacctcctggtgttggagccagcatttcatatgttgcattctgtccagttttctacttgcaggaggggacatccaaccctgccactctgtgtgggccagaaaccagggtctcaggagtgaatattttgccctccccagggcagcgcgcctgcccttgtgcaccagggtcccgctgtcagcgccagggctggggcaggtgtcccagatgggcagagcagcccggagctccgcctagcttcgctcatggtagaaccgcagtgcactgcttctctaggctggatagggggctctttctggcatctgagattagtttctataaagtaagagctgagcgctgcttggaattagttctgtgatgggataccagtcaggactagaatgtccagtaaaaattaaaaatcagcatcaccccagctaggatgggagacctctggaagatggctgtaccacgttttttcctttcttttcataaaaggttgctcatgctcagtaacacattcaactagttctcattttaatgctttttggagcctgaggttacattggcaagcatatttcatggtgttttatacgtcaagaggttcttctaattctgatgttttcattccttttcaggggtctgggaggacagctcatgagacaagcaggtaagtctgaaggcctttgcagccctctgcagccctttgccgcagccatcgttgagggaggtgtgctcgtggcgtgcagggcggcccattagcccccagggtgaagggctgggtgtgtttcttctgtggaggcggcatctgtgatgtgcttggtttgtccagtggttcctacgagggagagattgagagattgagattgagagagagaaagaggaagttgtgagctgggaggggttgcacccaggagccactggttctggaaatttctcaggaagcagaggcagctggggcagtggggccagtgcttgcctgtggacccagtggacattgcagatccctccgagcacggccccagcgtggacagagcagccctggtcgtgccctgtggactgagcagcgcagggaccaagagccgttttgggcgagcacaggaagctcaggcgggggcaagaggaaagctgagcagaggcgaagctccttacacacccgagtccaggcgaacctctgcgcctgattcccaagcctctgataccccccgggggttaggacagtcgggcattttttctttgctgattcttttttagcatgtgaggaggagggaagcgtagaacacattttagactgttccacagagtattaaaggaaaagcctgatttcatagacattcctgatggcagcagccgaccccaaggtccagggagctggattccccgacacagctcctggggccctgctgttgtggacagcccatcccacgccaccctcagcccctcgctgtgggactgtgagtgtgagtgtggaggcacagctggtgaggaagcttggaaaaatcgcggttgtgtgcagacttttgctgaggtctgcgtggtctgagcagaggagagcaggctgggattcggggaacccacggccggatgtcagggctgtaccagcctcttgtgctttctgtccacacctcccagccctgacctgatagggacctgcccgaggcctgcagccatctatctccagccaggctggccgggcttctgtactgagagcagccagcttgcatttctgctggtgttagctcagtgttctcatgagtctgatggacgtcacgggaaagtcaatcctagaaacgtgagccagtttctgtcagctgacgtcagaggcatgggactgccagttctgcaggtggtccctgttggctaagaccggtgtgtcatgttttggatgtagacttggtcattgtccctcagatgcctccagagcacacggtgcaggggtgtcacctttccgacgtacccatgggtgcccggagttgcctccttagtgggatcaagaccatcccccacatgtcatggacagctggtgacctgtaagccgtttctggatctaggagtttggcttgggatggagtggggtgtcgagtgctctcagaagggttcaatgtcccccacttcccacccacgacacgggtcgtgccctggagatggcagttggaggcagtcctacgaccttcacacgaccttcacgtgctccccgtgtgctgcggggtctgcttttagggtcgctcttggtgtttgagcagtaagtctgcacaggagccactgcccaccatgaaaggggggagttaaaggcgttccgaatccctttggccaacgacggagttgaaggtgttccgagtccccgtggccggcggcgacagagttgaaggcgtttggagtccccgtggctggcggtgatggagttgaaggcgttccgaatccccgtggccggtggtgacggagttgaaggcgttccgagtccctgtggctggcggcgatggagttgaatgcgttccgagtccccaggacgccattttggctgaatttcctttaccctcctgctccgtgaagcggggcccattggggaggtgctgctctgtaatctgctcttcttcttgaatgtgtggttagggcagccacattgatgtcccccaggctccagagtgaccgccccttaggggtcctgctgggcgttggccgctgttggccgcagggcaccgttggcctgtgcattgctgccacctacccatgatgggcagaattgtcacgagctcaggaggaaaccatggaaaaaccgcaggtcctggagcctccgtgtggttgtcgtgggcagctttccacgcgacgtgccctccctgggcgtgaggctgcatttgcacttagcggggagagggggaatgttgtgggttctagttgggctttttgatgatgatatttggaaagacttgagacaaagtagccaccctgtcctgtcccttcctcacccaccacacccactgctccccgctggcaggcactgcaggctgcacaagtaaccgtggaacctaaacactgatgtgcttcgtccgggttttaaaaaggcgcccttaccgcggtttcggtgtttggcgtcttcacgccatccgggttctcggtgctctgctctgaaggatggtggagggctgtggtctgttgttgggggtgctgggtgcagggtggtttctgtctgcctctctctacccccaactccagctttcccaccctgccctctgctctggggcacgtgtgctgttgggatgcatccctcagggttcacggcagggtgtggattgctggggggcatcgtggagaagggcatctttatgggaggcatccctgctctgggccccctgccggcctccagctgtgtctgcaccatgagtgtgtttgctggagtgcggtgtttgcactccctcacaccgctgagtgcaaacgcggcactcctgcacatgtcgcctggcaccgtggcgggcgtgtcccgtggaaagctgcccatgctgcccacgccctccctgggggccccttggctgcctgcactccccagccgtgacctcagctcccggcgccggccctccttgtgcagctccttcccctccatggcctttgctggccccaggagactctggcctgcaggctctgaagccggctgtgtccctggtgatcctgactgagccttggtgtcaactcaggtttttttctcctcctcgttcatttttacacttcgtaggaaattattttccctttcagctttcaagtaggaatagttcagaaggggaaatagttctgcatagcgtctgtggtcttggccccgcatctcccagtcccacatttttatttttccaaaggcaaccctttcagttttttagctgtctgttttccttgcttctgtatttctgagttctgtatgtacgcagctgtttcctgatatccttagttttagatgtgttctttcaagtgagacaagactccaagctcttgtcggggtgagaaatctgcgggttcacgggctacatgtgggagacggggaggggctgctggtcactttctcacccaggccagaggatggcgcccttacccccgaggacgccggcatgtcggtgacatgccgcccgcaggagcatcaggtgcgccctggccgcaggtgccccggaggtgtcgaaccgcagatttcttcagacgttttttgcacattttgtgggaaaagtggctcaacccttgggagtcgtctgcgtccccatatcaaagaaatgtcatacaggttggcctttgtcgtgaatattcacgagaggagatgaacatcctggatgtcctcagcgtggcctgaactgagctgcttcccccggtgccaggaagatgagcgtccccttgtctccgtcttagtctcagtggctcttgcatttcatgctttagaatcaaaggaaagaaacaggaactctgtttagtgaagcagcgatgaaggaggggtttgtcagtcagggtggactgcgttttgctcttgaaacaatccccaagtttcagtgtcttaaaaccacaggtgtttttttatcctgctcacatgtggatcaccgagggcaggggccgggaggaagggggtcatctggctcacagccttgcaccagaggcgtcacgagaatcaggaaaagttctcctctcatgccgaagacgggagggaaaccagaggcactggtgagccttgagtcggccacaggtgtgtggaggatcgtgacttagcaagccggggacacgctgttaatggacttcctgctgtgggggtgagggctccgtgctccatctctgatgccctgtacacacctgccacctcccctgtcccctcagcagagacatggccggtgctgtcgtgcctttcgcttttacctgtatcttaaatcacacaggagttcattcggatttacctgtacagataccctgttctctttcttgttccgtgggaattcactgggatttacccacacagccacctgctgcttctccttcttgttctgtcctgcatttctcaccttctaagaggaccattttctctttgcctggagaacactctagtgttttccatagtgtgtgtctgctggtggcaccctctcgtttgtttatcccaaaatggctttttccactttttttttttgagacggagtctcattcactcttgttgctcaggctggagtcacagtggcgcgatctcggctcactgcagcctccatctcccaggttcaagtgtttctcccgcctcagcctcccgagtagctgggattacaggcatgcgccaccgtggcaggctaattgttgtatttttagtggagatggggttccaccatgtgggccaggctggtcttgaactcctgacctcaggtgatccacccacctcggcctcccaaaggtgctgtttttttttttttccccactttgattcttaaaggttatttttgctaagaatgaaactttagtttgcatttattcattcgtttgtgttttggcactttaaagataatagtctcttgtcttctggagaggttagctgccagtctacttattactgtattggagacaatcttttaagtttcgctggcttcttttgagatttttatctttatttggttttcagcacttttaccgtgatattcctagaacaagttccctttgtgtttatctgacttggggctctagggttcatacttgttccataatctgtattttctgtcgatgttttgttcactttagaaaaattcctagccatgatctctttgaacattgctcactggcctctcctctccttttgggactcttattacccacgtcttgtctggatcaccgcacttaattctttacgcctccttacactccctcctctggttttgtcttattcagtttggacttttttttttccttttctttttttttttttttttttgagttggagtcttgctctgtcaccaggctggagtgcggtggcacaatctcagctcactgcaacctccgcctcccgggattaagcgattttcctgcttcagcctcctgagtagctgggactacaggcatgcgccaccacacccagctaatttttgtattttttgtagagatggggtttcaccacgttggccaggctggtctcgatctcttgaccttgtgatctgctcaccttggcctcccaaagtgctgggattacaggaacattttctttgatttaaatttcattgtcacaaattctttcaggtgtgccttatctgccgttaaacgcatccttgaatttttttatttttcagaacttattttttatagttttcatttttttcacatcctggaacatattaagcatggtttaaaatctttgtttaatgtcatcatctggagcctctgtggctgtttctgaaggacggtatatcatacatgaaaagcatctccaccaagctgcaggaacaagacatgacagaaatgctttgaggtctgcaatgttctcctctcccagagagacttgatgttggctcttgacgggaggcgggtgcttgctgtcggggtcacctccattgggttttgggacgtaggaggggtccgtgctgggctggcccacgttttacacctatttctaggtgtggtcctctgggttcagagcctgtggtgagggctctaccgcttctccctttggtcatcctggactcccgttctcctgctagctggagatgctcctggatgcactgttgggggtttctggttcttgtggcgccccctggagtcagccgtgagccggggagagttggcccccgccgctctgtccctctcaggtcttcgtgagctctctggtaactgcaggcacttcctgtgtgttttcattttgtctggcttttaaaaatgtcttagtggagggttggtctgcgttatctagtctgttagtttttaaaaaatattcttcatttcgaaataattatagacttacaggaagttatgagattagtaatagagcctggctgtgcttcccatgcttcctccgcggtgactccgggtatgacagtgttggagccgggactgcggtgtcgaggccctgcctctaactggactgcaggcctgtgcggtttcgtggcttcatgtgtgtgtggagtggccatgtgtgtctagtttcgtgcagattgatgccctgtgtagatttctgtaactaactccacactcaaatcagaaacctgcgtccttcccacagagacagcccctgccctttgcattctcaccctgcccccctgccaccagtctgtcccttctagaatatgccatgatcgactcgtatggttgtggcatttcgaggtgggcattttctgtgagcgtggtgccgagaccccatccagctgtccatgtgttcacagtttgtgccttcctagcccacggttgggttttaccagagtgtgttcgaccagcactcagtaaagtacactggggctatttctatctgttgctgttgtgaacaaggttgccaggaatattcctgtgcgagatgtgggtacaagccttttcatgtctaccactgagtcccgtgtgccgtttcgtgagaggctgaggcaccgcttcattccaccgctgagccccgcgtgccgtttcgtgagaggctgaggcaccgctgagccgcgcgtgccgtttttaacttgattataaaatacatttaaagttcacatgcaggtgcatctccaagaaaattattttaaaaactagttaagactttcatttcccagtcctcaacacacatcagagcagtactctgttcagagctgaaaggattcgcgctgggacaaaggcgtgtcacttgagtgagtgatggtgtcacaggtgcccacgtggaagaaggtaaagtcgtatctaaaactaaatgtgagagtaactaaaaacttacgcataaaaactaccatcataaaaatcctcgaagaaattttaggagacgttgtaggacagtgtcagtctctgaagaaaacttcttagtttagaaattttcaaatctgcgcagaagtaaagagaagtagtttacgggggggcccagagtctcgcccggcgcttcctttctcctcccctcctctgagtttaaagaagaccctgaatgtcaggtcccagcagcccctcgctgggtttttctgacttgtgttaagaactggttttctggggttttttgtttctttttgtttcccccctcttggcatgtaatccccagctaacagattttataataataattccacaaggtagaaacaaaaggagataattatgttgggccttatattgaagaatagaccatgtgtaggttggtagggaaaacggagattgagaataaacgtctgttctacagtcgaaaaggtaaaaagttaattagtgtacaaagactaaattgtaaaactgcctgtgacgaggtaaaggatccagtatgaaatggggcagagcagacgtgtgggcatttcaagcagaagaggagcagactcacgtggccgtggacggtgagggtgccggcctcacctcggaggcatggaagtaccaggttacttcacatcgagaggaccgttttcctctttccagtcggctgtggttggcactgaagaatcttggtgctgacagacacagagcagggtctctcgtggaacaggagttgtctggtctgttcagtttgatgagtggcagtatctgtgacgatgggaagtgtgtgtgtggtccctgtcctgtgtgcagggacgccaggtggaccgacggcctccgcatctgtagcacggtcaggcctccttgttcacggtgacaaaaaatggaaggagagtttagtccctcaggagaaatagcaaataccatgaacaagtgtgcagcaggcgtctgcgagtgggttccgttgttaggtagagacggtgggagctagagcagtgtgtggccgtgggagctgctgatgctgtccagtcgtctctgtctcgtgcgtcctggccccctcgtggctggtcagggccacgtttctggtcatggagagtgtgagtgacgagctatgtggggaagtgacaggcatgacctgtggtctggagcattgcaggtgatggctgtctgtcgcttgggtcctgagtgacaggtctaggagcagaagccgctatgcttcccgtacagcctgtcacagggacgtctgcagctccctgacaggccggcccggcttctctgaagtgcacgtgggctcacacatgggccttctgccacgtggctgggtctgcagcactttcttcaggctgctcagcggaggaggcgtcttgggcttctcatggtggttctgaaatggttctgggatgtttccagccctggcagcagggtaggttgggcgggtgaggggcaggagctggccgcacacaactcagaatgtggcaaaggcaagccgctgtggcaggcgcttttggaaaagtaacattgcgtctatccttttttttttttttttccagtgtgtgttttaatagaaaagttgtcactttccaaaatgccctttagaggtgacaccgtaattggtaagtgcttttgtttttaataatagcattttcttacagaatgacttcagattaaaaggtaaaaatgaacctgttaggatgggggcgataaacgattatagcttaaaggttcaagatattaatcggatacgttgccttgaagttgttacaagaacctgcttaaataatgggtacccaccgccctctccccccaacacaggagggcccttccccgccgtcacctcagtacccccacctcctcgcttccatgcccagggcccggcactctgggtcagttcttctcccaggcagacagtcgggagctgcagccacccaggccctcgtggaccaggagcgtgccggccgccgacaccacggaccctgtgggcagaggcggctccagttcctcagcagccccccacactgggctgccagagcacagtgaagggagcccccagggctgtggtgtcccggggctgtctcagcagcctcagaagttaggactttttttttgttaactgaatagccttcacatttgttgcttgtgcaggatctaattgagttaaagatttgggtttatattggtgggagccgggggagaccgtttgaaggaaaagatttaggggtaacaaaagaataaaagtttcccaaaatgtgatgtataaaaatttacagaatgctggtatttccctcaataagagcttacacaatttaacagccatgagaggaaggggccttagacttaacacaacgtggagaatgttcactttggcttttccacagattcctctcaaaggttaccatcgactttaagattagtattaatagaagctgtttttgctgttgtttttgatttcatggtgtttttgattgcctgggtacgctaacttgattttttgacagatggttggcaatggctgataaatgacactttgagacatctccatctcatctcaagtcactcccgccagcagatgaaggtacagtgagcatgggcgttcccggccggcgctgtggcggtgttagtgtgttagtcacggatggtgtttgtgttggcgactgtgcatcatgaggctgtccctgcagtagcctgataactgacaaatgggggcataattctatttggaatcccggatggtagcgtctacacggtttataaccagaaaatccaatacagccattggaatccgaatgtttaattttttattgcttctggctgttttaattatagttacctttgaaatactttttctgcatcaatagtaactgtgctctgttgagttccgtgtcctgtaggatctgaggtttggaaactccctttatgatgctcctgtgcagatgagaaaacagcaccccaggacctctgctcgcacacattgacctggtcatgttgtgtgggtgccagtgtgtgtgtgtgtccccggccacctgccctcccctcccgtcctgggggttacaggtggactttggactcacagagctgtaacgctgatctcattgcatagataagaaaccatgggcccggcgcagtggcgggtggatcacttgaggtcaggagttcgaggccagcctggccaacatggtgaaaccccatctctactaaaaatacaaaaattagcggggcgaggtggcgcgtgcctgtaatcccagctactcaagaggctgaggcaggagaattgcttgaacttgggaggcgaaggttgcagtgaaccgagatcacgccattgcactccagcctgggtgacaagagcaagaccctgcctcaaaaacaaaaacaaaaacaaaaacaaaaaaaaccatggttaccaacgttgactaggttttgatattgaggatgaagaatggaagtacatttaggtgtcttgtaattctctgacttcctccatgcttagcatttctttttccttagcatcttcaattttcttattttttttttcttaaggaacttgaacattctgtaggatccaagtaccgttctactaattgaatttgaatgcatcatgatcagtgcctcaaaattttatttcaaaagtccatgattaattcacactggccatgatgctggtgcactttgcccctgggattggcacaggtggtgactcgtggaatgcagcaccctgtagacgacgcacctcctctgctcatggcccccacctgccccgcccccagtgcctctccaaggctgctctgttggcctcggctcctgggcttcgggggagcggtggaaagaacacgtgggtttggtgtttgccacttgctggctgtgtggtcacgagaggctcctccgtaggtggcagaggtgggggttcgaggagacagtggcactgagccccgcacgcggcgggactggtgactctctgcccgctcctgctctgtgcagcaattgccgtccctcccaccacggttcctggtggccttgggatgggttcccgggggtctcctgctgtccggccccaactcctgttcccagtgcgcccccggagccctgtctctctaaatgaggctgacgtggcttggcctgaaggccctgccccgttactctgggtgcatagtgtatgcctttttcttcataactatttctgggaaagaaaaatatgctccattttattattgttccatattagaagacagacattgtggaaggaataatcaggttatccattcagtttcttagttgtagtggtagtaaagtgatgcgtgtatctgacagatgatggtgagcaggcgtgctggaaaggagtagcatgacttaggggttcttttggtttggttcgaaagtcattgctgtgccgagatctcagggtgacccgctgtgtccctggtcaggtccttctctgacctcaagggtgacctgctgtgtccttggccgggtgcttctccaacctcagggcgacccgctgggtccctggtcaggcaggggctgctctgacctcagggtgaccacggtgtccctggtcaggtgcttctccgacttcagagtgacctgctctgtccctggccgggggcttctccgagcagagctgctgtgcgctcaccgtgctgcctttgttttaggatgcagcagtctcggccctggctgctctatgcagtgaatattacatgaaggagccgggggaggcagatcccgcaattcagggtgagtggggagcccttttcttgaagactccaggggcttccagcaggaagctgctggggagtgtctgggcacggaggaggcctcggttgtgcagtggagcagagccaccacgatcatggctggagtgggactgttcgggtctcaggttcccagccgaggagctgtgggcaggtcctgcagctgcccaggatgttgcatcagctctgaacaggtggctcagcagggacgcgtctctgttgacggcaccctcttgctccatcacccaggctggagtggtgtggcgtgattcggctcactgcaacctctgcctcctgagttcaagcaattcttgtgcctcagcctcctgagtaggtgggactacaggtgcctgccaccatacccggctaatttttgtatttttagtagagacggggttttactgcattggccaggctggaatcgaactcctgacctcaggtgatccacctgcctcagcctcccaaagttctgggattacaggtgtgagccactgcactcggtcagtgtttttagaatttttgtatgcaccgtgacatttttctgctgtgtgtttcactcgttaatacattttgctgttttttccttctttatgaaagtagcattaggctggctttacgccgtgtcccgtgcgtagctgctgtgccgcctcactgtacatcctgcacccccgtgctgaagttcaggcttgcttctcgcacatcatgttcgagggatctgcttcatgaatcgtacttttatttttaaagtgtcacatgcacatatgttggcccacagtgttcctttatgtcatatgatagaacatgcattattaatcacgtcaaaagtgtgtgaatcaccacttaaaattattataagtatataaaaatcatgcattagcttggcatggtggcacacacctgtaatcccagctacttgggaggctgagtgtggggttgaggctgcagcgagctaagcttgcaccacggcactccagcctgggtgacagaatgagactctctcaaaaaaaaaattctctttctgattcctattttgaggtaggccactttggaaacgtgtctgctttgggaacctcaggcggctcctcctttgttcactgtggctttgctcctgtttggggcacacgtcgggtgtggctgtacacgatgggcagcagagggcctctcttcacactcgttgcttcctttcagaggagctgatcacgcagtacctggctgagcttcggaaccccgaggagatgactcgctgtggcttctcgttggccttgggcgcccttccaggcttccttctgaaaggccggctccagcaggtgaggctggccacgcgcagtggacggggcctagggcgagggtgtgggagcctcgtgtgttggggcatgaggtaggcccagccgttaataaacccatcagtgcttgtagctgggagggggttcctggaaaccggcacctgtggccaggaggaagggggcagagggcacccaaggtctgtggccccttagggccctggcgaaccctttgctgtcagaggacagacttgaaaaagctgaattctgggagggaggagaaggtgttgtttgtagaagcagctgccgagagtgaggagaacacagttgcctttgtgcgttgtggagccgggtcctgttttggttgcggccgtgcatcctgcatccaggtcggggcagaggtggttccacgtcctcccagaggtcagccccacgctggcctcagtgacctgctctctcacgctttcctgtggtgctggtcccactgaccaacctgccgggaactcctgcttgtctcccctccggccacctggcgtctgaagctggaataggccctggccactgggttccccacgcccttccctccccatgggatccagccttggcacttcaggatctgcagctccagacggactcctgcctgtgtggcgggtgggcctcacagccgccatgccatctaaaactcgcatgtgggggtttatccagttgaaacacagataaatgtgaaacaggatcacttggagatatgacagatgaggttgtcgggacccagcagcttcctttgtcaataccccaggtctcagcgtaggacaaaagggggggacctcaggtagggtgtggccagacccccagtgacaccctggggtgggggctggccgtggagaggctggaggtgacctctccccgggtgtccttcctgggttgtaccgggggccgtggagaggctggaggtgactcctccccgggtgtccttcctgggttgtactgggggccgtggagaggctggaggtgacctctccccgggtgtccttcctgggttgtaccaggggccatggatggccgtgaggaaggtggtgccaggagctgcctatctcatggtgtggggtctgtggctccgggccaacattgccacctccctaaagagtgcactttgttatagcttatggttcttctgtgattctttattgctttccaggttctcacaggtttaagagcagttacccacacttcccccgaggacgtaagttttgctgagtccaggagagacggcttgaaggccattgcgaggtgagtcccaacagttcctccctaaagtcgtaagtctctgaaaggccagcagatgaacgctaagggggatgtttttgctcagaggcaggacttatgattcttcacttcctaggtttcctctcttccagaggatcgtcagtcccagctgctggaggctctttcattctcttgctgtcatagtcgtagtgaatgttaaacttctttagggacactgggccccttggagaattggagaatgtgtcctggcccaaggttggcaaagaggagctgaccctgccagccagtgtttggaatgatctctgcactcgttgacagacacgcacctggggccacgccatatgccctctcctccctgcaggcacacaagaggagcagtcccgcgggggccacgcacgcccccttctctcctatgccagcatccgttccctctagtcagggtgggaagtgggagggaccagccgcagggggcgtccccatccacctttcaaccggagagacggcagagcgtgacctcggggaagcacgtcccacgttccatacatgtggaaggagctctgtgtttctgatctacccgagggtcctggactgttctgagcgtgtcttctcaggatcaggaacacacatcagccctctgcgatgtggaagatgaggctcaccgatgtttgtttgttagctcacacattttaaatttcaggatttgccagactgttggtgtgaaagcaggagccccagacgaagctgtgtgcggagagaatgtttcccagatttactgtgcgctgctgggctgcatggacgactacaccacggacagcagaggggacgtgggcacctggtacgtacgtagcagtgggtgagcgcttcttctgagaagcccatctattccgtggaaactcggaggccccgggcttttctgcagggagaaatctttgtagatttgtgccgtgttttgcgttttaaaggctctggggaagatgacctgttctctgctcccgggtgagcctgcgtggcagggctttgcaggtgcttgtccagcccgtcctcaggtgttgggcctgtgtcgtcctcgttgacagggtgtgagggaggacgcgtcttcaatgaaaggctgccggctgcttacattgggttttgccaacatttcttgctgtagtgggattgataacccctgaaacgcctgtgtgtgtaggatgcctcggggccccggtgtgtgtggctgtgggtggctccctgcacacgtccctgtagcgcacagggaacctctgcaggccccgtgactccctggcagcgtgcctgggctctgtgtggggttagtcacgggtgtcgaattcacacaggctgccggcgtggtgggcagaaccagggttggaacccccctctcaagctgggtgtctctgcctctccttgtcccatcagggtccgcaaggccgccatgaccagtctgatggatctgacacttctgctggctcggagccagcctgagctgatcgaggcccatacgtgagtgtcacgtcgcagctcttctgcatcctagagggcagccccgagcttggggaggctggcggggcgggcggtcctggtgctcagtggcatttgcactgctgggcacacaccctcctcccagagagcctctctggtccctgaccccaggtttgtgcaggcccctcctcctgcccccatagccatggcgtgagctggggcccatcctcctctgcccagtgcccccaggacgaggctctgctccccagcctgggcctccaacggtgctctggccagtttgatgacagccagcttcccggggtagggccgggcaggaggtggggacttctcagcttaggaccctgaacctgggggtctgctcctgccaggaccagctgagccatcactcagttccctgcacctgaggctgccattggggcctgcccttgctgtgtgtctctgtcgggggcactgggttgtgggtacccccaggccctgccctttctgtcggtctctctgtcgggggcactgagtcatggaggtccaggccctgcccttgcggatctctgtcaggggcactcagtcagggggtccaggccctgcccttgcgggtctctgtcgggggcactgagtcatgggggtccaggccctgcccttgctgtcagtctctctgtcagggacacttggccgtggggatcccagggcctgatttccttagttctcacctctttctctttccccctccccatctcttccccagccccagcttctctctccccatccccggcctctctgtccccatcactcttctccacccgctcctgtaatcctatttgttgtccctgcttcaaccctaagacctcatcagcacgcatgtaacacgtagcacatgtgtaacaagtacgtagcatgtatttgctgcgcacctgtagggttgggctcctgggatgtgaaggtaacggagtgtggttcttccgagccagtgtcctggtgtcagctgccaactcagccaccatgtcccgaggagcccgcatgtcctcgtggtgcttgggctggagtcacggctcggaccgcctgtgctcagtttaccgcccgctcttaatttaccgcccgcccttggtttacctcctgctctcggtttgcagctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtactgtcggggtgtaggccccccgtgctggccccgcagccatggcgagatcattggcagcccggccttgtctcactcactctcttgcaggtccgacgtggcctccgtgaactggagtgcaccttcccaggccttcccacgcatcacccagctccttgggctgcccacctaccgctaccacgtcctgctggggctagtcgtgtccctgggcggcttgacggagtcgacggtgaggaggcgtcgggctggctggggcaggaggtggctccaggagtgcctggtgcttccctgtctcttgggagcgtgtatggagctgggccttttcttccattgctttctatctctctcgggcatatttggttagggggtcaggggcccagtgtcttcctcatgacccaggaggcttagggcctgtgggatggttgagtctgatgaaggtgggacagggccagcgccactctcttcctgcggccgcagccttggagctcccagcgtcccctcggggttcaatcctccaggacctgtgtctgatgcctgcatgtgggtacctgggctccatcaggttctagatcggcctccgccctccactttcagggctccaggcccagcttctcatgtctgtggggagggtctccagagccttggtctgtggctgagctgtggaacttgaaggcctctctgcatcttgtcactcgtggcccctgcaccttgggtcatgacctgctttatgtggcaaccctgtgacagctgctaagtcctagaaaacacgtaacaggacgtgaggtgccctctgcgccgtgtgggcgcgtgcggggagacccgggccccaggacgtgaggtgccctctgcgccgtgcgggcgcgtgcggggagacccgggccacatgcgagcggggccccgagacattctgcactcgggaattgcggggattatcaaatcccgcttcagtgggaaacgtgagcgaaacccaaggtgagtggccgcagcctttcgtcacgtgctctcccgcatgtcctgagtgagggctcaggctgagctgccgttgccgagagccttgtgtctgcttcgggtgtctgcactgtgagtggctccgtgctggcgtccgcaccagccgcttggggccagaccttcgcgtctctgcagctcggagcagttctgctcttcagcagatgcttgaccggctgtagccaagcctgaggggtggcaggctcgggggtcccactgccttctgaggtgtctccgtgttgcagatccggcactccacccagagcctctttgagtacatgaagggcattcagagcgacccgcaggccctgggcagcttcagcgggacccttctgcagatctttgaggacaaccttctgaatgagaggtgagtggtgtctcttggggcctcagaggcgtgagtggtgctggtgcctctcaccacgttcccacagattcccggggtctcgcagggtctgtctggggtctgaagggagaagcgagacacacgctgtaccagttggtggctcagcgaggaagatgtgcctgcagcatatggttctccgggcggccaggcctcagcccctgcgcctcctcttctagcctccacatgaggcagggaaatgaccgttgtgtgtacaatggacgtaaaggtagtatgagtacaaggtggtccctgtgtgtaggaaggcgttgtgggagctcctccagcttggtgctcccacggacgtgcttgcggacgctcatcagccacccggcaagtgagagctctgcgttcctgaggatggaatgtcaagtgagaaacatcgctgctttctagaagtttctggctttacatggaggcagagtatagaccctgtgggccttgacctcagaattgggaacatcctctggaagggttgttcccagcatgtgcgaggacgaggacacgggcctggtgtcccctcgggcggggcctcggcagcctctcccatgagagcacagatgccgctctcggcaaacaggaactcggcccagccatgttttcttttctcgttacgactataatcagctgcacataaaggggcagttcgatcgattttgataggtgtccacccttaaaatcttccccagtcaggacggtgggctccagcccaaggtttcctcccagcccttcgagtccgtgcccctgacctgcgtcaccatagcctcagcccatggtcacttgaggcgctgggccgcgtgccggtcgctcattcctccgtgccggtcgctcattccgccttgccgttcgctcattcctccttgctgaccagtcgtgtctgttggtggaggcaccacagtgcatctgtctgtgggcattttggttgttgccgcatcggggctgttgctggtagagctgcaggcagtctgtgtgtgcgagcctgtgggtaggtgtgcacagctgggcctccctctctgtgggctgcggagcccagctctcctgtgtgttagtcggcctgtgctaaagctctcctgatgctcctgtcgcccagaggggacctccccagcctccttttctgtggggtaaataccgaggcgccgcaggctggctcacacagaggcgaatgtctagctttggaaagctgctggagggtttccagaacgcccacgtgtcatgtctttctgctgatgctgtctgaggtcactctcactggcgcgttgctgttttatattctctttggagaagtgtcttcatttttttctgttctccttccctgactgttgtggtctgatcctcccttgtcacacatgtgacttgagggtgttttctccctgcctgtcctttcacgcaccgagcgggggcctcacactttcctcacgtcccagcatctccccttgttctctgaggcacagatttttctggtgtgtctaagacagcttgcctaatccgtggtcactgagattttctgttttgtcctagaagatttatagttttgggttgtgtatttagacctgggacgcgtcttgagtgaggtttcttacatggtatagcgtcggcacaggcaccttgacgcccagcggtgcccaccccaattgctgggagggctcccctctccgctgcattgccgttgcagctttgtaagaaactgtgggtttactttggactcttctgtgcccgacgtgtttgcttcactttgcaccagggccgtgctgtttctatcccttccactttaccatcattttcgaagttcagcgtcagcctccagccttgtttcttctttccacagttgttttgtcttttcctgaagctttgcgtttccacgtaaattataaagggggcttgtcgctttccactgggatcctgctgactctcagccattcagggagttgggcgtccttgttgctggtgtccagggtctcacagctccttctcccctcagggtgtccgtgccgctgctgaagacgctggaccacgtgctcacccacggctgcttcgacatcttcaccacggaggaggagtgaggctctgcttttcatgacttcccttccgattaagcctaagtagctcatgtattaaagaaaaagtcatcagacacagagatcagaattccaggaaatgatcttccagtgcgttctgggtcagttatggtgactgtaaataccgtcatcacagctggccctcaaaataacgcaataataacatatttacataatgacatattatgactgtaagtgcagtcagccccatctggggctgaggcgggggccctgctgtgcactctccccccagctatcccaccgggccaggggtgggcctcagggttgtgctgggagccgcagggcctgaaggggcctcggctgtacggggatgagactcgcaggggagagggcagaggccggtgacctggcgaggacttgcccaggagattggagctccttgcttctgcgccacgcggatgccccaggctggtctcagctgggttgttggctctgagtggtcatctcgttgctgccatattttcttgcttcattgaatttcactgtgttgggccagtcttttttttttttttttttttttgagacagggtctagctctgtttcccaggctggagtgcagtggcacaatcacagctcactgcagcctctacctcagcctcccaagtatctgggactacaggcatgcgctgtagtctaatgtacggctaatgtttgtatttttagtagagacaggatttcactatgtttcccaggctggtcttgaactcctggccccaagtgcctgccttggcctcctaaagtgctgggattacaggtgtgagccactgcgtctggcctggatatatttgtatctggggcacgttgggtcatctggagacagcgtggtctgtttttgggggcactgcttttttttttgtttgttttgagatggagtcttgctctgttgcccagggtgtagtgcagtggctcgatttcagctcaccgcaaccccgtcccgggttcaagcagttctctcgcagacttctgagtagctgagattacagctgtgcaccatcacacctggctgattgtttgtatttttagtagagacggggtttcaccacattggtcaggctggtctcgaactcctgacctcaagtgacctgcccacctcggcctcccaaagtgctgggattacaggcgtgagccactgagcctggcttgggcgctactcttaagctgtcaggtggacccagagctgtgctggtctccagggttttctgcccctttaaggtctctgctccctggcgcttcccttcccaccgctgctggggcagtgccggggcttctggccatcttttgggtggttcgtccccagccttggacagcgtcctcgtactcaggtactggctgacccaggcccaggttagtcctcagcggcccccaggaagccccctctggtgctcagaacctgagcgagctctgcagacttggaatttcccgcttctcaccacgggcttcccgctggagtctgccacctgctggacttggctctgccttaaccttcgggcgggaggcagatctggtctctgttgctccatctttgctggacgctgcacatgtttttaaatctaacagcattgaagggtttccccttttaatttcttaatggggcatcactgactgaccttctttacacctgctgttggaacagcctccatgttcacaggtgcacccagctcggttgtggcgtattatcctttaatacaatgctaaatactccatttaaattttttttttgagatggagttttgctgttgttgcccagactggagtgaattggtgcgatctcagctcactgcaacctctgcctcctgggttcaagtgattctcctgcctcagcctccctagtagctgggattacaggcatgtgctaccatgcccaggtaattttgtatttttagtagagatggggtttcaccatgttggtcaggctggtctcgaactcccgacctgaggtgatctgcccacttctgcctcccaaagtgctgggattataggcgtgagccaccgtacctggcctaaaatattgacatatatttttctggcttaaaaatttcaaaataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcgagattgcttcccctggtgaaaagagagcaggtgagattgcttctctggtgagggagcaggttggttaatagcaggtgagattgcttctctggtgaaaacagagcaggcgagattgcttctcctggtgagggagcaggttggttaatagatagcgggcgagattgcttctctggtgagggagcaggttggttaatagatagcgggcgagattgcttctctggtgaggtagcaggttggttaatagagagcaggtgagagtgcttctctgatgaaaagagagcaggcgagattgcttctctggtgagggagcaggttggttaatagcaggcgagattgcttctctggtgagggagcaggttagttaatagagagcaggcgagattgcttctctggtgagggagcaggttggttaataaagcatttaaacaagaatgatgtcatcttcactgctgggatcctgcagctagctgtgtgtctgtggagggaggaggtggttaatgggcctggaaggcacctcctcttggttgcagccctgctgtggctgggatgggatgcagggtcagcgtcctcctcctgacgccttccactgacggggctccctggcctgggtcctgtcgtctctccggggtggggcggtggcgcttccctctggcaaatgcactgcatccctgtcccagatccggaagaccacggccagccaggtgtacgagacattgctcacctacagtgacgtcgtgggcgcggatgtgctggacgaggtggtgactgtgctcagtgacactgcgtggtgagtgaaggcccttcctgcacggccacctgggcctggcaccgcccctcttcctgtccccaccgtgtctactcgtctctcccaaaaccctctgataggaggaggaaagagggttcccaggtctccacatcctctgcttaggttttacaaggcagccgtgctgctgtagccgaaacctcttctcaaccgccctgtccccaaacagtgtcaggtgtcaggaacacagcaaagccatccatcccaccaggggagcgggcacctgtaccacaaggctgtgtctggtggcctgtggagcagagggcactgaaggcctggcaggtgctgctgccccagacctctctaaagttctcttggaataggccgtgtgagcacctgttggaaatcaagaggcacaggcggaaataagaaaagctctccccacgcctctgctctgatgtccacccccttcctcagggccatgaggccctcaggaggccatagtgccactctccacgtttactttggcaggcacagtttctgcaacatgggctggcttctttaccatgggtggagtagaatggcggttttgaaagatgtgtgtattgagttgggggtgggagggtctgaatgagagcagagtggggaaagtgcaggctcaggtgtcctgggccaaccggtatgttcctgggaacagcagtgatggtgtcttacacatatgggcatgggcacccatgctggctcacacacatgctcactcgcgcgcacacacacacacacactcacacacacacacacacttctaaaaggggagcagtctcgtcaccccgtgttggagatcaggactgaagcaaccagaggctgtgtgggtgtccacatggcatacccggggtggtggagtcccaggtgtcctgcctgtggatgctgctctgttttgagtgccgactgtgagggcctccgtgctgatcccggtgcgttgctacaggtctgtggggtccacgccccttgttgaatccagcaaggacgtaggtgacgttccctaggtgtctcctcggaacagtgaccttccaacagggctgggttcccatagagctcacgcaccaggcagccgctgtggcctcggaggacagaggtggcctctccagggcttccgcgaggttttctggtttggggaggagtgtgtgtctgctcctaaacaaacacgtggtcccaggagaggaaccgggagcagctgggctgtcttctcaacatgcgttgagagaatggccatcttaactactgctctggagacccgtttttacaatgatttttttaaaaaaaaacaccaaggtgcattctggaccagattctaaaataattggctttaggactgaagaagccaggtgtcccgagcggggcgaggcctcctccagcgaggctgggtcggggtggcctcctttcctcacatcagggagggaggaactagcagggtgggcctgggggcttctcctatcgtttaatcccctttctgttaaaaaaaaaaatccttagaatttaaagagaatattttaaattagaaacgaaaaacatgccccagatatctccacagcattgctagaatttttatttcgcatcaacagctaaattaaaacctggaaaacccttgtcagcccctccttggcctcgcttggtctgtcctcccgcagtccctgcgctgggcgtggtccttcccgaggggcaccccttgttgggaaggaaccgtcctcctgcgattccggaaagggctcaggctcgaggctctgctggagaacgtgctcctgtgacgtcttttctgccctcagcctggctatggatgtcgggggtgaggtctcctttccctgactgcggccatggaagcttgacgcgggacctccgcacacctgaggttctccggtgggcactcgagagactcacggctctccctctcctcacagggacgcagagcttgcagtggtgagagagcagcgcaaccgtctgtgtgaccttctgggcgtacccaggccccagctggtgccccaggtaaccctgtcaccttcacagcatgaggtgcctgtgcttccctgagctctggaatgttctggggccagcggctgtgcttagcttctgccagcacgtccacacggcccgttccctcgtctcatgtcaggacccctgggattacgggaccagcagagctgccttctctggccactgcccacacctgtgggcccctgtggcatccaggccacttgctctggggcgtttggggggccggggagtgggtggagctggcaccagcttgatccaggctcctcatgcctggccctggggtctgtttgtgctccaagtgccaagagtgccaccctacccctcctcatctgcttcccatgagtggggccggggctgggtgagaggcccccagaagctgcccctgtgcacctcaccagcccgtcactcttcttctaaagtaacaaaaacaagtacctcagttctcacgggggctggggcccagggttgctgtgctgtctctctagttaccagggttggctccttcctctcagcctccttccggcaggaggttatatctgagagggaggaggagaaccatgtccagatacatgggggcagtggggatgggctgagcatcaggacacagcctcccccatttctgtgtgtgtaaaggctgaactcaacagcagactttggaattaaatgtgctttttacatttttattaggaaaaatttcaaacgtgtgaatgcaggttaagagcagtgcagtgaacctcccttcccgctccccagatggggtgcccttccgaggacacgttagtcatgagcacctgtcagccacatagctcaggctgccgggtgtgtgggaaacggcacaaatggtttcctgcaggaaccgtgtcagtccccacacagggcccagaggggtgagggtcccctggctgggaatggtgtgtgttggagctgaccagcctgagcttgtcttgtctcttcttcagcctggtgcctgctgaagccagtcctggagcccatacctcacccctgcctggtgaggatgtcttgttcctgagggaggccggtgtggaaagcctcgcacagtggtgcctccagctgttgaagggtagcgctggcccttggaggctggcactagctgacagcttttcctctctgcacctgcgctctggtgacttggggtggacgcctctgccttcacttgaacacaaatgtgcttcctataaaatcatgtaccaagaagttcctgccttttgtctctgagcctgatgtgtgtaggggtgatggaaaggctcactgcccaggggtcagccagaggggaggtgggctgcactcctcctgcctggagaccaggcccccttcttgcctggtgctgtccctgctgtgggagacgtctggccacaggcagtgccccacccagtcttggagagagatgaatgttaaatcagaggttcaaatgctagagaactgagaagccctggtggcaggcatggtctggagtgctgggcagatgctgtttctgggcccgtctgcctggtgggggtgctgtcctcccccctgtgcacacgtgagcatcgtgcatgtggcccctctgcagtgcaggagtcactgattgatgggtgtgccgaccagcagcttcacaaatgtctgctgcaaggggaattgtcagagtccaatgtgtgcctctacagtaatgtgggaaataaataccattcttgaaataattacactgtcttaggagagcctgggcagagtccacacttgggtttttaggcaaagggcaggaggctacctttgtctctgtgtctgagctcgtgctgatccatcccaaagctggtgaggggaacgtgtataaaaatttcactgtggtagcaacccacacccatctctgggacctgtgctgtgctcatagggcttgaggtgcagaaccacggccagcagcaccaaagcagccccaggtgtggccactcagaggcccaagggcttgggtgagcaaccctttccctatgtgaggagcccaggggtgccatgtgcgtggtgtagattagggtggctccctggcctgctctcaggtggggatggggcctggacacaggaacatgggcaggccgagaactgggaggtgccaccgcatctgtgaggcttgtgaggtcaccaggaccacaagaccaggactgtgacagtccgtgctgtgtgtttagcagacagctcttcacgggatgtgtgtgacgacctggccacacaggagtgtggggttaacacactactgttgttgtgtttgacctggtggccaatggtctttataccctaaaagagccttgggttacatttttacgagatttaaatattttattccaacctgtgtaataggggtctcctcctccttgaactgtcccgattggctggggtcacgtggtgagggtcctgggtgaccaggcctagccttggccacatgagtccacacagtggaaaaggcttggctcctgtggtcggcacacacgagactctggttgcgcctgctgggtgtggaacaggcgcaccatcgccatgcctgcagctcacaaagctcctgctggcctgggatgcactgaggatggaaggaacaagtggcttctgagaaaaacatgatgaactgttcttagtgcaattaaaagaagattccagataaatggcattttaagacatggaggcaggtcgattacccacccagacccatcagtgacactatgtggcaaagcagttcttcttttaatgtcggtctaacttagcaacccgaggaaagtggatcactccactggccactgcctctttctttcccactggatcccatccatcactggggcacttgtgctcaccagacacctggtggcctggaaagccctctttcagcagccgtttctggagcccaccagggtccaggtgatagagtttggcaaggaaccccttgctcacatgatagctggggcagacaatagcaaatgaacaagcaagcaccatcaaggcaggcaacactgagtgctatgaacaaagataaagt

SEQ ID NO: 15655 - DNA, 5865 bp, Human
aagaaggagatagtggcatcatgtaagaacattacatctttttttttttttttttttgagacgaagtctcgctcttgtcccccaggctggagtgcaatggcgcgatcttggctcactgcaacctccgcctcctgggttcctgggttcaagcgattctcctgcctcagcctcccgagtagctgggattacaggcgcctgtcaccacacccgactaatttttgtatttttagtagagacggggtttcaccatgttagccaggctggtctcgaactcctgacctcaggtgatccgcccacctcggcctcccaaagtgctgggattacaggcatgagccaccacacctggctcattacatctttttagtagggtagaataaagtgccactgtgtgcagatcgtgctgatggaactgttgtaccatgtctatttaacgaaaaatattactgactggaacattaggcagagaatcagtgtctagaaacacagttaaattcaaaagcccccatgcaatgattgctactggaacataacatggattttattatctcgagctaaggcaactgtcaggccaaatttgtagtgtaagtatttcatcaatggaagaggaaactaatgaatgattctatttttgagttgttatattttacttgaaactaattcatataaatgaaagaaatttttttctgtaactatattctcttggtttaaaagaatttcatttcaagaatgcactatacttttaaaaaccccctttgaatagtaagtgtttttttgttttgtgtggggtttttttttttttttttttttttttgacagagtcttgctctgtcaccaggctggagtgcagtggcgtgatctcagctcactgcaatctctgcctcccaggttcaagcaattctcctgcctcagcctcccgagtagctgggattacaggcacacaccaccacacccagctaatttttgtattttttagtagagatggggtttcaccatgttggccaggatggtctcgatctcctgaccttgtgatctgcccgcttcggcctaccaaagtgctgggattacaagcgtgagccaccgtgccccgcctagtaactgttttttagttcaaagctactatgtaactgaaacctgaaatctattttgacagaattttcaagatcacaaaaagcattttggatacttcaatcttgaatgtttgatagaacaaattcaaaggaatcagaaaaaaaaattctaatctcttaaactcagatgcttgtaaagagatggcttgatggagaagaatccttttcatttagttgcagtgagtcacctggtggaatttgctgggatataagcctaccaggcagtcaaggatgtgatgggcaggtttatgtccacgttaaggtgtagattaaaaccaacagctccgttgttaatgtggcttttactttagtttttgtagaagaagtttgtctccatttgtattttattccatataggagtgcagaactttttttttactcacgttaaagtttacttggtaaagtcccttttaagaggtgagcatatctgcttggcagtgatgtaaatattaggtaacattatttagaagcaccacggtatgcatgtactgtttagaaacttaccaaccagaggctatctgtcatttccttcctgtaattgcccacacccaactatttctccatttcgcctcattaaatacagccttcctctacttctctctgggcagaggttattttatttttccctcactttcctggatcacatattctcttactgataggcctcattagggatttgtcctttacagctttatagtttaggtatttgggaacttatttcctttttgaaaatgctaacttgttgaaagaaagaactgtggccatgcctcatctgtgcttgtatgccctaaatgcttagcatatttccttgtacataatttgtaataaacatttatccagtgaataactggttttttttttattcatgtattgcagataacgaaggaggcccaacttcattcaataaggagcctgacggatttatcccagacggtagaacaaaaggaagaatattgatggattttaaaccagagtttttaaagagcttgagaatacggggaaattaatttgttctcctacacacatagatagggtaaggttgtttctgatgcagctgagaaaaatgcagaccgtcaaaaaggagcaggcgtctcttgatgccagtagcaatgtggacaagatgatggtccttaattctgctttaacggaagtgtcagaagactccacaacaggtgaggagctgcttctcagtgaaggaagtgtggggaagaacaaatcttctgcatgtcggaggaaacgggaattcattcctgatgaaaagaaagatgctatgtattgggaaaaaaggcggaaaaataatgaagctgccaaaagatctcgtgagaagcgtcgactgaatgacctggttttagagaacaaactaattgcactgggagaagaaaacgccactttaaaagctgagctgctttcactaaaattaaagtttggtttaattagctccacagcatatgctcaagagattcagaaactcagtaattctacagctgtgtactttcaagattaccagacttccaaatccaatgtgagttcatttgtggacgagcacgaaccctcgatggtgtcaagtagttgtatttctgtcattaaacactctccacaaagctcgctgtccgatgtttcagaagtgtcctcagtagaacacacgcaggagagctctgtgcagggaagctgcagaagtcctgaaaacaagttccagattatcaagcaagagccgatggaattagagagctacacaagggagccaagagatgaccgaggctcttacacagcgtccatctatcaaaactatatggggaattctttctctgggtactcacactctcccccactactgcaagtcaaccgatcctccagcaactccccgagaacgtcggaaactgatgatggtgtggtaggaaagtcatctgatggagaagacgagcaacaggtccccaagggccccatccattctccagttgaactcaagcatgtgcatgcaactgtggttaaagttccagaagtgaattcctctgccttgccacacaagctccggatcaaagccaaagccatgcagatcaaagtagaagcctttgataatgaatttgaggccacgcaaaaactttcctcacctattgacatgacatctaaaagacatttcgaactcgaaaagcatagtgccccaagtatggtacattcttctcttactcctttctcagtgcaagtgactaacattcaagattggtctctcaaatcggagcactggcatcaaaaagaactgagtggcaaaactcagaatagtttcaaaactggagttgttgaaatgaaagacagtggctacaaagtttctgacccagagaacttgtatttgaagcaggggatagcaaacttatctgcagaggttgtctcactcaagagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagattgtgttatcactctgcctgtgtatagtcagatagtccatgcgaaggctgtatatattgaacattatttttgttgttctattataaagtgtgtaagttaccagtttcaataaaggattggtgacaaacacagaactcctgctccattgcatttgatttgatggagaagaaaagtcaatttaagttataaaaataaatattaagatattttacattttatatgagagagttttctcccctgaataagagaaaactgaagtgctaagttcagcaaataatttgtttttccaggcttctaaagaaagaaaaataacagtgaattttcttgcatttgagactaattcactaaattactttatattatatatttttctgtaagattatgttttctctataattttcttaagtataaaaatacaagttgtttggtaacagcctcttcttagttatctaccctttaagtatgacacatggatgtggatagttgagtcactgatgcattttattaaagtctgttttaaaagagcagataaagactgaggatgaggcatttttatgttattataagtcttaacagttctagagtataacaatctagggaactaagctaaacactgtttagtttctaaaatttcaaagaacacgtcaattaccacatgccaaaatatataatctgagtatatataatgacattttagaagatttattaatgatgaataggaagaatggctctatatcttcagatgtttgcttaaaaattatagaagtccaaaaaaaaaaaacttcctaagtaaattgaggataagaccattattggttatttgtccaagacgctcagttgccataattatagaagtaagcgtggtcaaacgtggaccaagtgcttctgttgcaatgcctgtgactggcatctgcctctgcgtctgggatggggtggggttgggggaaagttgcgggggttggtaggtgggctgggtgttagtcaggcacagctttctccagagataactgctcaccgaagccctcttcagaatcgtctctttccacactgacctcttttctattctagaagtgggtaaaagacttgagcagtcctggaactggtgcagagtgacagtgactcagccctcacttctcacccgcatctcacgttggcagggaggcaaaatgcaggcaggaagagcccaagggtagcatcccgttttaggtgcctgtagtctgtgactctccgctttgagcacaagcctgatttttgatatgctaagtttcctgcactttcatatttttaaaaagtatggtgccttgtattaaaggcactgccagtaacacacacacacaggccatccactttgtcctttttgccacaggggtcactttcctctctgaaatctcctggctcttagggaaatgtgctgcctggctctgctcttggccttctctctccagtattttactagtggctgggtgaagcccagaggcagactcttctcatttataagtgaaagttataaagcagggaaggagagctaaaatatccgatgggagtcaggatccaaaagcctttgacggcctagatgggtaggatgaatctaacaacacgaaatataatagggatacaatgtaaagccaggttcttacattaaaaaaaaaaaaaaagcaactatccaaattcacaaccgggagaaaaataataaaataactacattttttttttttttctgagatggagtctcgctctgtcacccaggctggagtgcagtggctccatctctgctcactgcaagctccgcctcctgggttcacaccattctcctgcctcagcctcccgagtagctgtgactacaggcgcccaccaccacgcccggctaattttttgtatttttaatagagatggggtttcaccatgttagccaggatggtctcgatctcctgacgtcgtgatccgcctgcctcagcctcccaaagtgctgggattacaggcgtgagccaccacgcccggcctaaaataactacatttttaaaaatgagttttagttccctcaagcttactaagagtcaacaacagtggaatgttgggttgtgtcaatgcaaatagcattccaagcacgggtggctgtcctccgtacctggggtgc

SEQ ID NO: 15656 - DNA, 9509 bp, Human
ccacccctaaccttaaaagcaataaataaaataaaagcccagcctgccaaccgcatgcacacacggccagcggtggtgggggtttgtagtttgcatacacgtcgcggggcagaagcctgtttgcaaaggctgaaatgtagctagcaggggaagacgctgaaaaaacagagtgatttgataaaaacgtgctgggccctgttacaggagggctgctgggagtagtcccaggtactcacatcagaaggggtgcaggggaataaaatttaaaaaagcaaacccatggcgagtctttcttgctgggagtgaggggctctgcaaaatttctgggacttcagaacagaggtcgacaaggtccattgctcttcccgagactactgggtgatccagggctcctctctgaacctcagtttcgtcgttggaaaaacggggataggaacatatttctgttgctgtcaagaatttaaacgctccagtgcaggtgaaggaaatgtgctttgatgactgggtataaaaaatgtgcaaaaagaacctggcgttacaaggtggtgtcaagggagaggaagtaaaagtctgtatgacctccctgtcgcttgtcggagcgcgcaccgctcccaagtcaccctctgagtcgccagagctaccgaaaagccgatgggaataagcaggactgtttctctacttccttcattgggcttcgcaagaggctctgggaagaagcacccgtacaaatgggaatcccagtgcctggtcaccggggaggaactttacaacatcactgaaggtttgagaatagtgcttctggctggtcgcggtagttcctaagctgcctttgttcccacttctctgatccaggttaacttttaacattctgacaaactcggacaaaagtaacgttgggattacgtcaggaattcccacccttcaacaaatatttgttgcgggcctactatgtactcagtgcaatgatacccaattttgtagtctcctaaacagatcctactcgagaggtcttgattatttacagatgcagttagaaaagcgcccatattatttttaattgagttcaagaaatagaatgcagcgttgaattagaagactaattccttcttttaatatgttgaaaattttttatcgttaaacattttgtaaaggattttttgagggagtcgttagaaagtctataaatacaactacgcacactaaaaagtagtcatctttttaaaaataactttgtttaaatgcatgcttagtgtgaatggatttacctaattctcttaatagcatgcatttctgatcttccctacattaactgtaatagcaactgatataacagaaaaatgtaagtgacttgtagtcgacttggccacctgccacacgggctcggtgaaggttaatgaggagctatttggcacttcgagaataggtggcactagacacagaaatatcaacaggctatttgtatgctaactaggagtttcggtgccaggtaaccattgatgtactcttgcaggagaaagaaggatgtcgctgtacgccccgaaagagaggcatcatttttacgcccagtttggattaatgattgattgagtcgcagaaatgcttgtgatgctgatagaggccaatactggtctttctgatctcttcctcgtcgtttattaccttctcttgtggacaacgcattcctaagaatgtatctctgcttgtttcccagtccgcgagataaatggtgacttctctcttgcaggcaccgtcatacctcgggtttagattctggacaggcgagccggctgcaccgaaggcccggtaggcggactctggcggagcgcttcagagagaagagtgtagaccgcgggaggcggagggctccctgccagcgtgcctcggccaatcagtattcacaccgcctgacaaccggccaatcagaggacgtaaagctccggggcctgagcggacagtactaggaaggggagcgcagtctggagactgaagccagtggcgctgcgctgaatgcaactgcgcgcgcccgccgggtgagccagcgatctgagccaggcgggggcggcccgacctttcccgcccagcctgggtcagaggaagccgaaagcggcctcagcaaggtgaggcgcccgaggctgcagaagaccgagcagaactttgcagagttcgggatgtgctgggctaggtcgctgaggacttgactggcttcctccctccttccctccacctaccttctccctccccctccaccatccagtgggttcgttccgggcctccagctatcagctcccgatctcgtgtttgagggtagcgaccccgatttctgtttgcatgcacagccagcagccctagcgccagatcctaaagctggatatcttttaactgggctaccagcccgggcctcaaagttttggtgagtgctgtgatgccgctcggggtgtcagggagggcaaagggcgtgaatcatctttcaccttttctgtgtgacttggatgccttaccttaaatatataaaccaaggcctaagtacagagagcccacgcggctcagccctgtgcacctcaggtactattaaggctggacgggcgtctgtattgtgctctttgcccttatgggacgctaatgacaacaaaattttggttttcagttgagtattttggggaggggggtgagaggacctcttcaagcccaaggaggggtccttgtggtggtgtaggctgatgagaggcatttgggaagcatagagtggtacttcagtgagtctgaagggccacttgtaatcaaaggaaaactgttcttccacggatagttttatatgcatcatggccatactagttgagtatggggaaatccgacaagtggcctggggctgcctatttggacacaatattttgtgtgtgtgtgataagtgagttacccagggacttgtccggaaagcccgtgtaaagccagagagggccacggttaaaggtcaggtactcacagagcacttagaattaataaaataaaacctttgttgggttgtggatccctgggggccctggagatacaggaaaggcacgtgtggcctggaagtgagggacatgtaatgagaacaggatgactcaagcggccggaggcgggcagaccaggagctttgggccggaggctcagggatggtccctgacggcggccggtgggtctttggatttctttgtgtttccccagagtgagggccgccaggctcaggccccagcgaagccccgagcgccatggccgacccgcaggctggctccgcggccggggactgggagatcgatgtcgagagcctggagctggaagaggacgtctgcggggcgccgcggtccacgccccccgggcccagcccgccgccggcggacggggactgcgaggacgacgaagatgacgacggggtggacgaagacgcggaagaagagggcgacggcgaggaggcaggcgcgtcccccgggatgcccggccagccggagcagcgggggggaccgcagccgaggccgccgctcgcgcctcaggcctcacccgccggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggtgcgtacccgcccggcccgggcgtctcaggccacagtggaggtgggggagttggaggggagcggggcggccgtccacaccccccgcgcccagggccttgcggtgcctggcactccctaggaaggatggtaagaacgcttttctgcttgcactggcgagcagggtcgggagggaaaaagcaggcatctctggggaacttgggaaatgtttttgtcttaaaaagcaggcagagaggccttgaaagtgtttaggcccatttggaacatcgcgagaaaatcaatgtttttatttttttgcattttaaagtgcattttcgtggtgttgagggcgggggcttggggggagagtggttgatccacagcacggcgtgcagctccaggctcgtcactgctgtactggtgatgatggagaaaaagaaccacgcagcacgcatgcgctcggtgcttcagctgtcacctggacgtttgagatatctagaacactcattttatggatgagacacaaaatgcatgagaaattagatgcctgcagcccaaggtcatcaatccgaagctactgtccctgcaaactacctaagagcaaggggagggtctctgctgcttcccatcggaggactccagctgcgaggagagccagggctttctttccgagagacgctcttgaaccttcgattttgtatttgtttccatgtgcgcctggacagggagagttcagcgagcgaggcttcacagggcctcctcccagactcaggaccagggaagactttcaattttactttttggcggagaggagctggggagtggatcgccagacacactgaaggcagtaaccccactggaaagcctctcgagggcccaggagagcgcgctggacgccatgggcacctggtcctgggcttggtctcctcccgcgtcccgcatgggtcatcgcctgccctgcgttcccacgcgttctctgtagcatatgctgggtaggacgcgggcgtgggagggcccagaatcccaccagctggtgggataggtgactgcagaggcgagggtgggtgtccgcaaagcgcaaatttggagtttgcagccggacccaggagaccctcatctcttcattcccctatcaccccaccctgcctgccctgccacagggagaaatccgcccggcctcactgcttcacagcaggccttgggcaccttctatccgacaggtgggctcccaggacccagcctggctgcaaccatctcttgaggtcgggtgcccccctgaaagggatttcactttttcacttccctccgggatgtcccctcacttctggccataggtctgcgtatatctagagtgattagagtctagagtgactatgctgcggaaagcaggggatccagctcaccagctgaggttccagctccttgccctaggattaaggggtgctgatattaattcgtttgtaattatttttcacacggaatgggaaaattcaatacatttagaagggggagagtttctagaagatttacggacatcccgtccttcccccttctcgcccccattttctttcagggcattattgatgatgtttcttgtgtttacaggacaagaaggggctttccgggaaacagaataatttcgagcgcaaagctgtgtaccagaggcaagtcagagcccccagtttgctggccaaaagcattttagaaggtaaagcaacaaaattatccttcagccttttaaacagagttgagtgactctcattaatcagcacaaagtgtgtttattaatctgtgaaagagctatctaaagggaaagtactttttattagaaaggttttgtttaggtgttcgctgagcccgtacgctaaaactgaacccgtacggagaagattagcatggcccgggaaccagaaagttttcttctaggaaggaaaccgccacctgggaaaatgaatctcacatacctcctgaggtttctgtcaccaccagttgaagaatccctattatttggttgtctgcttagtggttaatcggttaatgtggagtgcatgtgaaatttaccccgtatgagggatgtacaaagatatactgccaagtgatcctggagcagatgtcttggaaggaaataaataacttaaacaaagcaaaacaaaacaacacaaccacgtccacttttcttagttgtgggagctgaatagatgaagtcaagtgaggagtttaacagctgctcgcaaccagtaaagccgtttagtctggaagttcaacctcagattccgctctttttcattgtacttttttttttttttttggattacttggataattcctattattccaaacttcatttttaccattttttgacagtcaaggttatagaatctgaaaaaggtttcgaatccagcaagcgaagtggaggttgaatgcgaacagtgcgaaatctctagctttctgtctccatgttctcactttcgtgaaagcctgggggtacattaatttttcttaaaatattactcatttttaaaagcatctctatttgggtatggaatttatttattgacctcaataatatattgactatttttaaccgtttctctttaaatttttaaaaatttaaataagggacaattaatgtttgctttaatcactgccacttcatgaaattcaggttgaaagtaaacaaaaatttttaagtagacatttggattctgtttttttcttgtgtagcttctgaattttgttggttctggacaggtttgtgtgtgtcctataaaaatttttaagtagacatttggattctgtttttttcttgtgtagcttctgaattttgttggttctggacaggttttgaagtttgtgtgtgtcctatcatgtgttgtatacttctgaccatagagtggtttcttatgaattaaaaatgaatttggttacaaactggataaacagatttataataatagggccacattgataaactgagattatgcaaagcaacttgtgaagtctgaggactaaatggaatagtaaattcaactaaataacttcctggcaaaaacttatcatagaaatgtaaacattaattttcaaattttattttatttgcaaatgagtataatgggtttgtcactatgtaaacacaaatataacaatggatgcttcaaacaaatatgacagaggtgagtgcttgggggtgatgaaatactccaagtattttatgcctccaggaattctatttatgttacactaatctttgtatttgagtttgctcctattcgtgcgatgacttagcctgtgttttaatgattgcttgttcaaccattttggtatccggccaaaatgattagagcttgggaagaatgtttcagaacagttattttcgatagagcagggaatactccccgccttttttgagttttgttttattttattttatttttttttgtagtggtatcaggggaaggggcctggttaaattgttcactgtagagtgtgtttgactagttaacagctcttttcaattttctatgcttctctattttcttaagccttttttttctttttctactcgctaatctcctttaactttctttctttctcttttttcctagttctccttggattattctacagctattatgtgtacataatgaaccatctttagaaaataaaagtgacatcagctctaggtatagatatattttttaataatgaaaaaagatgacatggataataataaaacattgattgatacaagataaatagtcttgtctcttaatgcgtagggggcctgggaagaatattaaaattttaatcaataaagtatgtctgttgaagcaagcaagcaaacaaatccataacaaccacaacaagcaacaagaacaagaacaacaacaagaagaagttgcagtatggatatctttcaccctcccaggaaactctttcaaacctaatctgtacttttgcatctgtataaaaatatcagtgagatggaactgtaaataattgttctgctgatctgtagtgttgctgttaccttctgggtttccacatttttattccgtagatgttaatctctttcatgtgcaatctttgcttcttgtaggctatcgccccattccagcggagacttatgtaggagggaccttccctctacctcccccagttagtgacaggatgaggaaaagaagagcctttgctgataaagagttggagaacattatgctggagagagaatataaagaaagggagatgttggaaacttctcaagctgctgctctgtttctgcccaaccgcatggtgcctggacctgactacaattcctacaaaagtgcctacagccccagcccagtggaaccaccaagcaaggacttctgtaattttttgcccacctgccttgatttaaccatgcagtattcagggtctgggaatatggaactaatttcttctaatgtcagcgtggccacaacttatagacagtatcccttgtcctcaagatttttagtttggcccaagtgtggccccattagcgacaccctcctctaccagcaatgcctgctaaatgccaccacctcagttcaagccctgaagcctggggccagctgggacttgaagggagcacgagtccaggatggactcagtgcagagcaggacatgatgccatcgaaattggaaggttccctggtgctgcctcacactcctgagatccagaccacgagaagtgaccttcagggtcatcaggctgtcccagagaggtccgcgttctccccaccccgacggaatttctctcccattgttgacacggactccctggcagctcaagggcatgtcttaacgaagatcagcaaagaaaacaccaggcaccctctgccacttagacataatccattccactcattattccagcaaacacttactgacaaatcgggtcctgagttgaaaacaccatttgtcaaagaggcctttgaagagacccctaagaaacacagagagtgtttagttaaggacaaccagaagtacacatttacaatagatagatgtgcaaaagacctttttgtagccaaacaagttggaacaaaactctcggtgaatgaaccactgtcattttctgttgagtctattcttaagaggccttcatctgccatcactcgtgtctctcagtgaaaggctgcttaaacagaaagctggattttctgcagtcttagagcattatagccatttgctactttttttaaaagttaagatgtttgtgtaaagaaatttctaatgtaaagatgatgattttgaaaaattttatatattcctaatatgcatgtactttttcttatcacatatatttaaacttacagatggaaattgcccaatgtgcaaattgttaagtaccacactttacacagcatttcaaaaagcaataaaattgacactgtcttctcaaagacccaatatttgccgaagcaaatagctgtctctgtctagatgaagaagctatttttctatgattctgtatatttgtatattttgaagtactcttaatggtcactgggggccacaggaaaacctttataatactttagttttgcattgtggagggcacataaatttaattattcgagactgtttgaggcaaaaatcactttaaggagaacatagggccatttgcatgtttacagtatcttcatttcacgtgattggacaaagctgaattaattggaagggaaatcaagtgtaatgtctcttttacattacattagatggtttgggttct

SEQ ID NO: 15657 - DNA, 8154 bp, Human
cttgatcccaggaggtcaagaacagcctgggcaacaaagcaagaccctgtcccatatttttttttgaagcagagtctcactctgttgcccaggctggagtgcagtggcatgatctcggctcactgcaacctccgccctccaggttcaagcaatcctcttgcctcagtcccccagtaggtgggattacaggcacggtccactatgcccagctaatttttgtatttttagtagagacagggtttcgccatgttggccaggctggtctcaaactactgacctcaggagggcttagtggctcatgcctgtaactttgggaggccaaggcaggaggatcactggaggccaggagttcaagaccagcctggacaacatagtgaggccccatctctataaaaaatttaaaagttagccaggcatcatgatatgtgtctgtggtcctagctactcgggagggtgaggcaggaggatggcttgagcccaggaggtcaaggctgcagtgaactgtgatcttgccactgcactccgtgtgggtgacagcacaagaccttattttccttaaaggaaaaaaaaatgctaagagtggctgggttgggtggcccatgtctataaccccagcactttgggaggccaaggtgggtggatcacaaggtcaggagttagttcgagaccagcctggccaacatggtgaaacccattctttactaaaagtacaaaaattagctgggcgtggtggcgcgcgcctgtagtcccagctactcaggaggccgaggcacgagaatcgcttgaaccaaggaggcggaggttgcagtgagcctgggcgacagagcgagactccgtctcaaaaaaaaaaaaaattagctgggcctggtggtgcgcgcctgtaatcccagctacttcagaggctgaggcaggagaatcacttgaacctgggaggcagaggttccactgcgcggagatcacgccattgcactccagcctgggcaatagagtgagactccatctcaaaaaataaaagtccttaaccagtccatatttctgaatattttgcttattcctgccggcagtgtaatactctggtgaatatttgcgttcgagatccttgcattcccgagatttccccagctcagccctctgcgtgggttgaacggtatgaacctttttaaggcttcgcttgtactgtactgtcaagctgttttttggaatattcgccccaggtttctgttccagccagcagccagcatcagccgtctgcatccttgtcctcaaactgctgttaattaaaatctttgccaatctgggccgggcgcggtggctcacgcctgtaatgccaacactttgggaggccgaggccggcggatcgcctgaggtcgggagtttgagaccagcctgaccaacatggagaaaccctgtctctactaaagatacaaaattagccgggcgtggtggcgcatgcctgtaatcccagctacttgggaggctgaagcaggagaatcgcttgaacctgtgaggcggaggttgcagtgagccgagatcacgccattgcactcgagtctgggcgaccagagcgaaactccgtctcaaaaaaaaaaaaaaaaaaaaaaagaaacctttgccaatctggtagaattgcggggcttattttatggtgtcatggaggatagcctagggccagatatacctggggccctgtgcctgctctgcgaactaggagctcactctccgagcggtgtagagggtgagactaagcagtgacagtaaaagctttcgacagtgcttgacccttccgcggagcgtattaagcaggagctccctgcgcaggcgcagaggagagagtgtctcccaccccacgaccagcagggggcctgcgaggcgggtgcggagccaggcctgatggtggccaatcgcgagctgaggcgacgatgccacgcccctcatactggcgtcttaaatgcgcaaagaaaggacgccggggacacccggttgggctctgctgctcccttctgggttccgaggcccaagcccttggcagtgtttgtgagtggaagggaggtcacgctatcgtccgcggccccagcagccctgtgccctcgttggatcccgcgacgcggctcctttaagagcctcgcgggtcgcccgccgctaggtcgctccccggccatgcgggcgctgcgggccggcctgaccctggcgttgggcgcggggctgggtgcggtcgtcgagggctggcggcggcggcgggaggacgcgcgggcggcgccgggactgctgggccggctgcccgtgctgcccgtggcggcggcagccgagttgccccctgtgcccgggggaccccgcggcccgggcgagctggccaagtacgggctgccggggctggcgcagctcaagagccgcgagtcgtacgtgctgtgctacgacccgcgcacccgcggcgcgctctgggtggtggagcagctgcgacccgagcgtctccgcggcgacggcgaccggcgcgagtgcgacttccgcgaggacgactcggtgcacgcgtaccaccgtgccaccaacgccgactaccgcggcagtggcttcgaccgcggtcacctggccgccgccgccaaccaccgctggagccagaaggccatggacgacacgttctacctgagcaacgtcgcgccccaggtagcgcccgcgccccgggccggtcgcggaatgcggggccggcgcctggcctcgcggggcctcggtttgttcttctgcagaacggggcagctgcccaacgcgcccccggtcaggcatcgcagtgacatcccgtggcgggagggaggagcactgggctccaggcacagggtctgcaggccgaccagggcttgagcttcaactgcgaaccctgggcacctccctgagcgtcgctttcctcgtcaaaaaaatggggataataccgttattcaccttcctcctgcggtagtgatgaggcgctgaggctcacagaggcaaagtgacgggcacagtgtcacacagcagaagaaggctgtctgttgtagaaccgcagcgcccaacctattgggcaccagggtgcggtttcgtggaagacagtttttccacggcttggtgggtgagggcgggtttcaggataattcaagtgcgttacatttatgtacattttatttctattattattacattgtaacatatagtgaaatatacaactcacagtaatgtaggatccgtgggagccctgagcttgttttcctgcaactagacagtcctatctggaggtgatgggcaacaacgacagatcaggcattaggttttcaaaagaagcgcgcaacctcctcacatgcgcagttcaccatagggttccagctcctatgacaatctccagccgccactgatctgacaggaggcggagctcaggctgctgtgggatcaatgggggggtggctgtaaatacagatgaagcttcccttgctcgcctgctgctcacctcctgctgtgtggcccggttctggtaccggtctgtagcccaggggttggggacccctagtctataaaaccgtgagcctccagacattgtcctaccctgcctgccttcaggcagtttcgaggcagacacctggcccacgatcaggttgttagtgccaggcactgtgcactgggccaaccaccctctcagcctgttcccagcaggtcctggcaccaatggatggagactgccatggggctctgggtggagcccatggggcaccaacctctgacccagcttccttctgggaagacagccccctatccactttccattgtcccaggcctggagagctcaggatggaggtcgattcatggcattccccgctaggctcttcctgtggctcagactgggaaaaggaacgggttggtagttggaagggctggtcttcccaggagaccctgggtggggctggggacaggcctcagtcctctctgaaaggtggagacaggctcttccttcattcgactcttgggagctgagaaaagactttgacacctgggctgtgggagggacagagggtggtggctagcactctatcagccctgggtttcagggagtgactttcattccttgagcctcagtttccccccgcttgtctcactggatatctctgagcctgtccatcccctcaggacctggggcggccctctgatagaggaggaagggtcccagccacagtcctgctaagccctatctctcctaccaggtgccccacctcaaccagaatgcctggaacaacctggagaaatatagccgcagcttgacccgcagctaccaaaacgtctatgtctgcacagggccactcttcctgcccaggtaaggtggaaaccaggggggcggcagaacctcccactcacctgaggcccctactgccactcacagggccaggcttgccccaggctctgggtcaataccagttccctactcatctggtttcttggcaagcctgtcagcttccctgcctcgagtcccctcattccacctccacagccaaagacctgtcgggtacccctgaccatctctcctctgcccatgggcagcagcaggccctgaatctgcccccgcttctccctgctgtcacctcttggcatgcccacccaatcttgttctgccaatatggaaccccccgcaggtctgcagtgcaccaagctctcccaccttccccccgcaggtctgcagtgcaccaagctctcccgccttccccctgcaggtctgcggtgcaccaagctctcccaccttccctctgcaggtccgaggtgcaccgagctctcccgccttccccatgcaggtccccagtgcaccgagctctcacgccttccccatgcaggtccccagtgcaccgagctctcccgccttccccatgcaggtccccagtgcaccgagctctcacgccttccccctgcaggtccgcggtgcaccaggctctcccgccttcagtctctgctctgcttggagcacttccctccacccttctcgggagtttgaatctagatctgcctgacccagggcctccactcttgctcctgtgcagccctgcctctcaggtggaagcaactgagcacctctgggtgtgctccgtggtttttctggcctgcagagggctggggctgagaggcaacaggtccaggctgagcagctcactctggaatccacaggctcgggatggagtccaggcctcatcacctagttccttggtgctgtgggcaaatgacctgtgtccccctctgcaaaacctgtgacctcttggttgatgtcacatgcttccccagggcctggtccatggtaagggctcggcataggctggccaaggcggtggttggggcactgatcaaatttcattagcaggtgcctcctagggcctggtggaagggaggagactctgctgagggggagcccccgtccggtgtcctggcacctgtgctggtgctgggatgtcacctgtcatggtccttgcccacttgttgctcacctctgtggggagagatggacagtcgttaagtctcccctcagacgaatgtgaatattcagaaggctcgattctcctagcagcgtttattgtcgcccactctgcctgacccagtgttgggcataaggaaaacagagggaaagagttaaccaccctggagagagttccagcctcaaggaggagccaggcaggctacagaagtctcacagtgagggcgtggtcctgcaggttgacagaagttagaggacagatcagggaaggctgcctggaagaggtggctttgggttcatccaggccccctgcccacgtgtgcctgggtctgcccacaggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggagacaagtctggtggcgtccgtcccaagtgacctgcagagcccctggtttcactgctgcttcactgatgtcctcggccccttagaactttcaggtgtgccgggcacccgcctgggtgaggccaggctgcagggcggccagggagatgaggatggcttcctggaagagaagcgtggcagtgggctggggcctggggggctagcgggtgcccccgctcccagcctgtcttcagtgcctggctgcccgagacccggcccactggtgtcccctgtccttagtagggcctggtgaggttaatgacaggcccaggttcacactgcacacttgccacctggaggaccacacagcctgctcctcaggctcctcttctgtaaaatgggggcgaaggtaacaacgcccacctcccagggccaggggagggcaagaagaggggcaagaagttttcacccctcgtgcaggggttggaagggtggcagccagggttcctgctggggggtatggctgtcaggctcagagtgctcggcttgggcaaggccttagggatgggtagacagggctgtcggcccggcgagactgatgggagtaccagccttcccagcagagttcccgtagcacagcgtcctatgcctgaccccaaaagtgggtacacaggttccatgaggccaggacgaaggctccagctgcacgtggcttcccccgtgggacagatgcaagtgagaccccaaggggagagctgctgtgcccaccgtggtcacacacaaggaagtggcagaaccagggccctgggagatcactgagcgcacggctaaggaaccagaggcccggagcaggggtgggcagggccccctgggtcacccagtctgggagcacaggacgggcactagcacccatggttgactcccagctacactcatgtctcgtcgctgtggcaagaggccaagggggatgagaggaccacctccagacaaggcagccacgggcaagggtgggtgacagggcaagagtagcacccgcccctcggacagatcccaaggccccagcggctggcagtcggggaggcaggcgggctcacctccgtgcggatggtacggctaccctggccaggacaggtattgacgtacaggtcaaagaggacactgggttcagccacctccaggttggggtcagcatccgctccagcttccagaccctggaggcccccgaacaccacaagagcatgcctggcccatgtaagagggggtcacctgagcggccaccgaggccccacccagcacagcgcccagacctcagtccctccccaccccagacagcaggggcccatctgtgcagcttcacccaccaggcaggttcctggccacattcctcctgccctggccgcagccccaggaggtacacacctgaagttgggaagctgggcagaggccacatctgagccgcgctctgacgtcccgatggtcaggtcatacccatcttggaagggggcctcagcaaacacagcacctgggggtggggccagctcagtgcaggtcctgctccccacaagccatagctccgggtattatgtgtgtgtgtactgaggcgggggtgggtgggaagagctgtgtggtgtgtgtgtgtgtgtgtgtgcgtgtgtgtactaaggtaggggtgggtgggtagagctctgcctgtgtgtgcactgaggcaggggtgtgtgtgtaccgagcaggggtgggtagagctgttcctggaaagtcaaggactgagcagggcagacaccaagcctgtgcttggctggggaacagggcagagactggataggaagaggcaccaagaacatgaagtgggcctctgacttctctggcccttttgcctccattcccaaccctacagaaacattattgatcaataatgatacttttgctcagtagtccttaacagcattccaggcagtgcatccagggagaacaaggcccagagaagggaaaggacttgcccaaggacacacagcaagttgacaggacaaaa

SEQ ID NO: 15658 - DNA, 15004 bp, Human
cacctgcatggcctggggcttctggggtctggctcgttcctggcttcaaagctgtgcatgagccttctctttcagggagccctctttaactgcagcctgtatgtgggcttctcccttgcccctgcttctctagtctagaacttgtagctctgcatctgaatagtcagcttgggcgctgtagggtgctgcttcccatgatcccctgtgcccatcccagaacccagtacctggtagggactcaataaatgtcaactgagccaggcgcggtggggttcctgggccatggaagacctggcacttactcaaatggtcccaaggcccctccaggacaggggggcctggtgttgagattactgtggctgccaccctgaccaggtccttgccagcttctcttctgaccctgggcaggtacctgagcctcttcaagcctcagtgtcctcatctgttagatggagactattgtggcacctctagtgagagtgcagtgggaactgagcgaggtggaactgagcaaaatcctgagccagggttcactattgaccacagcaggtggctgagaagaatgttggatccccagctccacggcccaccagccatctgggactggcaaacccacaggaacggaaggttcctcagggaccacaaagcccatgtgaggtccctgctgctgaagggattctgaggacaggaggagccaaattacctatccagggtcacccagccaaggtgggttaggacctgagtttggtggctctcaggtctggccaatttctttctttctttttttttttttttttttttttttggtagagtcttgctcgttgggtcgggcaggagtgcagtggctggcacgatcttggcccactgcaatctccatctcccaggttcaagtgattcttaggcctcagcctcctgagtagctgggattacaggcatgtgtcatgacgcccagataagtttctttgtttgtttttcccagactgagtttcactctaatgctcaggctggagtgcagtggtgtgctcttgcctcactgcaatgtctgcctcccaggttcaagtgattcttgtgcctcagcctcccaagtagctgggataacaggtgcgtgctaccacgcccagctaatttttgtatttttagtagagatgggggtttcaccatgttggccaggctggtctcgaactcctgacctcaggtgatctgcccgcctcagcctcccaaagtgctgggattacaggcgtgagccactgtgcccagcccctggccagtttctgcacaccagtggctgaggagggagctggcctgggaggaacaccgggaggggaggggcgagccaggagccaggaccccgggaccctccgaggagcggattagtgcctccctcagagttaggacatggccttgggtccaacaggcctaagtctgagtgtgtgtgttgtgtggccttaaacacatcactccccctcctgcaccctccagcctctgttttccaccttctgttttctcattgataagataggcctgaccaggtcattcagggaatgaaatggaagtgcttagcaagacctctgtaagtggaggctgctgctgtcactgttgccattatcctccctctccgctccacccacctcctgctcctcttctttaaccctcagcccttcctgagtcagactttaacctggccaagtcagggctctgtctcaggacgcatggagccagggctggaagtctccactgggcaggcgccaggcagcccctgcaggctggggaggtggaggctgctggagtcaagaggaaccaggtgagggtgttggagcataacaggcttgggaggcaggcagaaacctgcccttctgcaaactctatctcttccccctcctgggagcagacaggatggcgctgtggcctgaaagcagctgtccctcctgtgtgcaagctcggactgctgcacccagacagattccatctctgaccttccacttgttcgtctccagctcgccatggccaaacagctgcaggcccgaaggctagacgggatcgactacaacccctggtgagccagctgggctggggaggtgtgtgggtgtcccctcgggcatgggttggccatccctgggtttacagcaactcagtagtactccagatggtggcggtacacagactgccagattccagccatagctcaggagagacagggcccgagggagtaggcttggttcaaatctcagctttcttctgcatgactgtgccactaggacaggtgacatacctgctctgagcctcatctccccagctgcaaaatgaagagttatacccacctggagagcgttggggaggaaaaagtaaaatgctgtccaaagccattctacccaggcaccaagctaaggcctttccagggatgactctttctcacttggtatagagtcagataaactaagataagtaaaataagcaagtaagatacagtcagctcttcaccagacatttgcagaggttgatattgttttcttttttgacttgttttattttcattttatttttgagacggagttttgcccttgtcgcccaggctggagtgcaatggtgcggtctcggctcactgcaacctctgcctcctgggttcaaatgattctcctgcttcagcctccaagtagctgggattacaggcgtgcaacacaacgcccagctaattttttttctttttcttttcccccgcaagacagaatcttactctgtcacccaggctggagtgcagtggcatgatctcggctcactgcaacctccccctcacaggttcaagcaattctcctgcctcagcctcccaagtagctgggattacaggcgtgcgccaccacgcccagctaattttttttttttttttgtatttttagtagagatgagatttcaccatgtttgccaggctggtctcgaactcctgacctcgtgatccacccgcctcagcctcccaaagtactgggattacaggcatgagccactgtgcctggccctaatttttatatctttagagaaaatggggtttcagcatgttgtccaggctggtctcaaactcctgacctcaagggatctgccctcctcggccttccaaagtgctggggaatacaggcataagccaccgggcccagccaaaaatgacacattttagacatatttattggtatgcaaattcaactcagccaggtcttcactctgctccaaactagccccaaaccacataccagcctcttcatccagcttcccagcctttctcccacctggagaggtggcccccaggcagggccagaacagaggattatgggtccagagatgatgtgtgcctgggctggtggggccctgttctgcccagagtagggtcaagagcatcaaactttgcttgagatggaagtagaaaggctggctggctgtgccttgtactagctgggaggctttaggcaagtcactccactccttatccccacagtggtccaggaacaagacgtgcctcacaggccattgtgaaggctatatgagcagagcgtttaactgtggtgttgacgaatccaaggaggagtcatgcaatctgtacagggggtctcaactagtatttggaaagaatagagtaggataggacaggacagaaaatactgcagtagattgcaccaagaaggatgaagcttccattccatgtttgtgctccacagggttgatgatgcaaaggtgatttcttggccggtagtggtggctcacgcctgtactgctagcactttgggaggccaaggggggcggtggatcacctgaggtcaggagttcgagaccagcctggccaacatagcaaaaccccatctgtactaaaaatacaaaaattagctgggcgtggtggcgggtgcctgtaatcccagctactcaggaggctgaggcatgagaatcgcttgacctcgggaggcggaggttgcagtgagttgagattgcaccactgcactccagcctaggggatagagcgaaactctgtcaaaaaaaaaaaaaaaagatgatttcttcctatgggtcatggtggaagaacttggaaagcccctgggctgattcctgcgattaacaatgtgcctgactgacctaatctcaatgtaggggaccagctgtgacacttaggcagatcttcaggccaggacagttgctgattgtctagtttttgtttttcttgtgtgtgtatgtgtgtgttttttgttttttgtttttgtttttttaagacagaatctcactcttgttatccaggctgcagtgcaatggtgcgatctcggctcacttcaacctccggttcccgggttcaagtgattcttctgcctcagccttccaagtagctgggattacaggcccctgccaccatgcctgactaacttttgtatttttagtgaagacagagtttcaccatgttggccaggctggtctcaaactcctgacctcaggtgatccgcccacctcggcctcccaaagtgctgggattacaggcgtgagccaccacacctggccggttgtccagtttttctaaacaggccgaagtccaggtcaccatggagggctgggctggtgctgattctccatttgttacccagggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttgtgagtctccccatctctcgtggaggcactgggggaggaaggggacagggctttctggacttcaagcccacacagctgtcaggcttcaggggacagagccaggggattctgtatgaccatagttcagtgtttactgagcgtatcctctgtcccagagccttcgcctcgtggtctagtggggatggcagacaagaagccagtaacgacaggcagttgatacatgatgtgatggaggaggatgggatatcgtgcgagtaagaaagagggaatgaaacctggggagggggctggagagatgcacgaagacttcctggaggaggtgacacttaaaccaagtcctgaaagatgagctactggttggattacacaataaatccaaacgttttccggaaaggaccacatagtaaatatgtgacactgcttggattagaacagtggttctttttttctttttcttttttgagacaaggtctcactctgttatccaggctggagtgcaatggtgcgatcatggtccactgcagccttgaccctgccagtctcaagtggtcctcccacctcagcctctggagtaactgggactacaggtgtgcatcaccatgcccagctaattttatttatatatttatttatttatttttgagtcagggtctcactcctgtcacctaggctagagtgtagtgacatgatcacggctcactgcagcctgtacctcatggggctcacatgatatgccatttcctggggctcatgtgatcctcccacctcagcctctagagttgctgggacaacaggggcatgccacctcacccagctaatttagagacagggtttcaccatgttgctcagactggtctgaaactcctgggctcaagtgatcctgccacctcggcctccaaaagtgctgggattacaggcgtgagccactgaaccctcattcttttttttttttttttttttgagatggagtctccctctgtcgccaggctggagtgcaggggcgcaatctcggctcactgcaacctccccctcccaggttcaagagattctcctgcctcagcctcccgagtagctgggactataggggtgcgcccccacgcccagctaatttttgttttgttttttttttaagacagtctcgcactgtcgccccggctggagtctggagtgcagcggcacgatctcggctcactgcaacctccgcctccgcctccgcctccgcctcctgggttcaagccattctcctgcctcagcctcttgagtagttgggattacaggcgcccgccaccatgcccagctaatttttgtatttttagtagagacggggtttcaccatgttggccaggctggtctcaaactcccgacctcgtgattcgcctgcctcggcctcccaaagtgctgggattacaggcgtgagccaccgcacctggccattttttgtatttttagtggatactgggtttcaccatgttagtccggttggtctcgatctcttgacctcgtgatccacccacctcagcctcccagagtgctgggattacaggcgtgagccaccgcacccgaccgcactcgttctttttaatggctgcatactgttctgttgcctggatgtgccataatttatttaagcagttctgcactgatggactgcttctgctatctcaatatcataagcaatgccacagcaaatatccctgtgtggacatctttgtatacatatgtatttctctaagataaattcctggaggtaaaactagcaaaagaaagactataaatatttataaatacaataggtggatattgttaagaaacagtgtgtgcctataatcccagctacttgggagtctgaggcaggaagattgtttgagcccaggagtttgaggccagtgcaacatagtgagatcctgtctgaaaaataaacaaacaactaagtaaataattgccctccagtaaggtttactcatttacatccctgccaataggctggtctcagagctggttggaaagttccttctttgatccaaaaaaaaaaaaaatcatttgggtatgtatctttttcttttctttctttctttcttttttttttcttttaactagagacaaaagctgggtacggtggctcacatctgtaatcccagcactttgggaggccaaagcaggcagattacccaaggtcagaagttcgaaaccagtctggccaacatggtgaaaccccgtctccactaaaaatacaaaaattaaccaggcatggtggtgcgtgcctgtagtcccagctacttgggaggctgaggcaggagaatcacttgaacccaggaggcggaggttgcagggagccgcgattgtgccactgcactccagcctgggtgacatgagtgagaccctgtctcaaaataaataaataaataaataaataaataaataaataaataaataaataaaagcctctcccgcaaagctgctgggaggatcaagtgggcacaaacatgcttcttaaacttacagatgtggaaagtggggagtttctactgccttgtgggctcttggactgaggttcatggaggcaagcacttcctctggttctctgctaaatccccgccctgggcttcgggcctggcacagaacaggccctgtggcaaatgctggtggaggagatggaagagcttagcactggatatctgagtcagtgcaggcctggtggttggcaccctggagtctgggaccatatagattgtgtgacctttacctcccagagtacacaggatcacaatagcacctgcctctgggttgttgagaggatgagatcaaagaaatcccacaaatagcttggtgtgtagaggaatccagagtgttgaaagctgatctattccacgtcccctggggcccaggctaccagtacctgactttgcccccaggcctgctgctggaaggtgctagaattgcctggatacagctgggccggaggatgggcccaggctgagctggacagttaacccctgctgtcctggcagggttacccaccactgacgaagatcctggcaagtttctttggggagctgctgggtcaggagatagacccgctcaggaatgtgctggtgactgttggtggctatggggccctgttcacagccttccaggccctggtggacgaaggagacgaggtgagtgggcaagacttgggctgagtgggactgagaggtcagggccatgctgactccagctgatttgacccttatatcaggtcatcatcatcgaacccttttttgactgctacgagcccatgacaatgatggcagggggtcgtcctgtgtttgtgtccctgaagccggtaaggatgctaggtagaggatggatgggcagagggatccaaggcgtgggctgagttggaccctgggagttggaaaaggaggaaagaagtgaaggaagccagttcctctaagctgggagggcagaggggaggtgtgtgtgttgggatcccaggggagagaaggtggggatagatgctggggaagacctgcatgtcaggtggttaagtggtaccaccccgtgccacctgctcttgcagggtcccatccagaatggagaactgggttccagcagcaactggcagctggaccccatggagctggccggcaaattcacatcacgcaccaaagccctggtcctcaacacccccaacaaccccctgggcaaggtactggagggacctccttccctggccccctgcggacctggtcatgtctcctgcactgttactgagttgctgctgtggggcctccgtttcttcgtttgtgtgtgggagggccacacacaatgagcactgaggaccaagactccagaggtcccaggacaggggcaagaatccccagggaaggcctgagggctgggacagtgaactgggctgggagccaccatcacttcccagtgaccctggaatagtgactatgcctctcgaagtatctcatctgtaatgtgggaacctgagggaactgacctcatggtcagtgttgcagggatccaatgtgatggtgcagaacagcccttagcactgggcttggctgtattcgccatttatttatttttttgagacggagtctcgctctgtctcccaggctggagtgcagtggtgtgatcttggctcattgcaacctctgcctcctgggttcaagcaattctcctgcctcagcctcccgagtagctgggattacaggcacccgccaccatgcccagctaatttttgtgtttttagtagagacggggtttctccatgttggccaggctggtcttaaactcctgacctccagtgttccgcccgcctcggcctcccaaagtgctaggattacaggcgtgagccaccgcacctggccgcagctgtgttctttaacctctctgagtaggcctctgtgtttggggacggtcccagctgcaggtctgtgctctccttgggcatctgcaggtgttctccagggaagagctggagctggtggccagcctttgccagcagcatgacgtggtgtgtatcactgatgaagtctaccagtggatggtctacgacgggcaccagcacatcagcattggtgagccaagccagcctggggcccctcccctgcacattggtgggagggccttgaccccacctgagagtcagcacaggcctggtagttagaacccagggttatggagccctgcagatcctgtgacctttgcctcccagagtacacagtgtcacagtagcacctgcctccctggttgtcgaaaggttgaggtcaaagaaatcctatgccgagcatggtgggtcacacctgtaatcccagcactttgggaggctgaggctggcagatcacttgaggtcaggagtttgagaccagcctggccaacatggtgaaaccccgtctgtactaaaagtacaaaaattagctgggcatggtggcacgtgcctgtagtcccagctactcaggaagctgaggtaggaggatcactggaacctgggaggcggaggttgcagtgaggcaagatggcgccattgcattcctgcctgggcaacagagcgagactccatctcaaaaaaaaaaaaacaaagaaagaaatggggggtggagggagggagggagagagagagagagagaaagaaggaaggaaggaaggaaaggaaaggaagaaagaaagaaaaaaaattgtgcaaataacttagtatgtagaggaatccagggtgtcaaaagcctatgcgtgtcccctggggcccagaccaccatcctcccccgtccccctcaccccagtctcagcagctgttctgttcggccttgggcagccagcctccctggcatgtgggaacggaccctgaccatcggcagcgccggcaagaccttcagcgccactggctggaaggtgagttgctgagggtgggaggtcaccaccccctgcaagatccttggcaagtgaggtgggcctgagaatgaagaaggctttagccaggtctggaaggacctctccccctacctgcgcccctgctgcaggtgggctgggtcctgggtccagatcacatcatgaagcacctgcggaccgtgcaccagaactccgtcttccactgccccacgcagagccaggtgaagaggggcaggacgtcacgggggagtggggggacaacaaaagagcccaggctggcccccgcgtcagggaacagctgatctatctgtgtgtccatctgccctgcccaggctgcagtagccgagagctttgaacgggagcagctgctcttccgccaacccagcagctactttgtgcagttcccgcaggccatgcagcgctgccgtgaccacatgatacgtagcctacagtcagtgggcctgaagcccatcatccctcagggcagctacttcctcatcacagacatctcagacttcagtgagtgagacttgccggtctgggcagggcgcaggggctggaggctgcagggggctcagtgtggcctctgtctcccagagaggaagatgcctgacttgcctggagctgtggatgagccctatgacagacgcttcgtcaagtggatgatcaagaacaaggtgggctgggcctctgccaggcagccatgtatggtttcacaggttgtgtgctgctcaagggtgcccaggcaagaggctcctgggctagatcttagtccagcctctgccgtcaaccttggggcagggttgtatccacttcagagaatgaggaggctgtttctttttttctttcttttttttttttggttgagatggagtctcactcttgcccaggctggagtgcagtggcgcgatcttggctcactgcaagctctgccccccaggttcacgccattctcctgcctcagcctcccgagtagctgggaccacaggctacttttttttgcccggctaattttttttgtatttttggtagagacggggtttcaccatgttagccaggttggtcttgatctcctgaccttgtaatccgcctgcctcggcctcccaaagtgctgggattacaggcgtgagccactgctcctggcctttttttttttttttttttttttgagacagagtctcactctgtcgcctaggtgggagtgcagtggcgcaatctcagcacactgcaacctccacctccagggttcaagcgattctcctcccttagcctcctgagtagttgggtaactgggattacaggcatgtacaaccacgcctggctaatttttgtatttttagtagagacggggtttcaccatgttggtcaggctagtctccaactcctgacctcagatgatccactccccttggcctcccaaagtgctgggattacaggcgtgagccaccgtgcctggcctgaggaacctgtttctaacttgcacagagatgctgtgtgggctggcaggatttcctgcctctttggatctccatcttcccatctgtacagtgaggagttggcccattaactcttgagttcatccaggtttgatctgtgactctaaggctttgttcttctctggctctgccctgacctgctccatgatcctccctctgtcagcctccctctgccctctatacccagggagggacttggaatgatgttctgggattcttttcttctgactttgtgtttgtttttgttttggatggattttctctctttcgcccaggctgcggtgaagtggcgcaatctggctcactgcaacctccacccccgggttcaagcaattctcctgcctcagcctcccaagtagctgggattacaggcatgcgccaccacacccggccaatttttgtatttttggtagagacggggtttagccatgttggccaggctggtcttgaactcctgacctcaggtgatccacccgtctcagcctcccaaagtgctgggattataggcgtgagccaccgcacctggccttgttcctctgactttgatgcagctctaggtgctggattggagctaactctccttccccgcctggtcgtgggaacctctctgtcccctccggagccaaggcctgctgggccacgaggccgtgttgagacatgtccttcctcctccccagggcttggtggccatccctgtctccatcttctatagtgtgccacatcagaagcactttgaccactatatccgcttctgttttgtgaaggtaaagggcagggctgggggaggaaagacctcacagagcttcccaaggccggctgggcacatggggagagtgtaggactaatctgtgctggcgcaggatgaagccacgctccaggccatggacgagaagctgcggaagtggaaggtggaactctagccctgaagtcacgccttggccctgacatccccacatgcccgcagagatcctctttgagtgtctgtctttgtccaggtttcagacatttctaggttggggaagatgctattgggaaacctcttctccgtgacacagaatgttctgggtgggagccgcccttcttcatcttagagaaccaagtgcctcctgtctgaaaggtgagggtggcctgacctgggcctctccctgcccctccataggtgggtttgtagggtcttgtgttgcttctggtctctccaggcttggctgagacggacggtagacttccaccatgtaccgatcacatcccagctctgcatggcccctgctaaggctcaggtataacctcaccttccctggctcatcttggccttggggagttgcctttaggcttgagtcctcaagcctctccttttcgtccataataaaatgtttaagttattaagatccttattgacggcttctctctgcttcacactcatgctgatggctgatctaacttgtgaagaatgcccagaagaacctcagacacccccacaactttgtacaaatggttactgtagtcacatagtggcacaaccaggcctagcacccaaggccctcaaatgaattcctcactattaatctttgttgttgttgttgttgttgttgttgttgttgttgttgtttttgaaacagagtctcgctctgtcccccaggctggagtgcagtggcatgatcttggctcattgcaacctccacctcctgggttcaagcaattctcctgcctcagcctcctgagtagctgggactacaggcacctgccaccacgcccggctaatttttgtgtttttgtagagatggggtttcaccatgttggctgggctggactcaaactcctgacctcaggtcatctgctcgcctcggcctcccaaagtgctgggattacagacgtgagccaccatagctggcctctcatattaatctgatggtagcagttattggtgctgggtgtggtggctggggtgggggtgtcatatgtgtttgtgtgtgtgtgtgtgtgtggagaggattggggttcgtgacaaggaagacatggacattcccacaggggtgagagaacagcacagtgggggccaggaggaccagggacttaaataattctcaggaggaggactgaatgttgatcgtgcaagccctacctgcgaggcactcagacgcacatcatcttacacaaccctctgagactgagacctgagttatctccagttcacaagagaggaaagcactctggaggtgaggtgaagtggtgtgcccaggccttctagctggccccgattgagtctcactggatagcaatagtagctcctgaatttctttggaaggtggtgttaggggcctggtcttgaagttgcatttgcatagcaagcgcatgggtttggctcatatcatatgtttaactgggggagctgataggaatatatcatataataaaatacatatttggtgtttgcccctggtccttagtaaagaattcctaaaatccttggagtttctggaagataggcatgtcttgttagtcacatggaatccctctgcactgtacgattacggggtcagaacttttagcccatcgggccccctccatctctgcctccatggaggtgtgagggactagactttgagcccaatcacatggtccatgtctgtttgttattgttgttttggggggatttttgtgtttgttttttcaaatggccaatgtcttaatcagtcatgcctacaaaataaacctgtcaaaaatcacaacaaatttagtataagatctaagttcgagaccaggcacggtggctcacacctgtaatcccggcactttgggaggccgaggcgggtggatcacgaggtcaggagatcgagaccatcctggctaacacggtgaaaccctgtctctactaaaaatataaaaaattagccgggtgcagtggcgggcacctgtagtcccagctactcgggaagctgaggcaggagaatggcatgaacccaggaggcggagcttgcagtgagcggagatcacgccactgcactctagcctgggcgacagagcagagcgagactgtctcaaaaaaaaaaaaatctaagttcgagaccgggcacggtggctgacacctgtaattccagcactttgggaggccgaggcgggtggatcacctgaggtcgggagttcaagaccaacctgaccaacatggagaatcccgtctctactaaaaatacaaaaattagccgggcttggtggcaggcgcctgtaatcccagctacttgggagcttgaggcaggagaattgcttgaacctgggaggcagaggttgcagtgagccgagatcatgccactgcacttcagcctgagcaacagagtgagactagatctcaaaaaataaaaggcattaatggctcaagtctataa

SEQ ID NO: 15659 - DNA, 11129 bp, Human
atgcctacaaaataaacctgtcaaaaatcacaacaaatttagtataagatctaagttcgagaccaggcacggtggctcacacctgtaatcccggcactttgggaggccgaggcgggtggatcacgaggtcaggagatcgagaccatcctggctaacacggtgaaaccctgtctctactaaaaatataaaaaattagccgggtgcagtggcgggcacctgtagtcccagctactcgggaagctgaggcaggagaatggcatgaacccaggaggcggagcttgcagtgagcggagatcacgccactgcactctagcctgggcgacagagcagagcgagactgtctcaaaaaaaaaaaaatctaagttcgagaccgggcacggtggctgacacctgtaattccagcactttgggaggccgaggcgggtggatcacctgaggtcgggagttcaagaccaacctgaccaacatggagaatcccgtctctactaaaaatacaaaaattagccgggcttggtggcaggcgcctgtaatcccagctacttgggagcttgaggcaggagaattgcttgaacctgggaggcagaggttgcagtgagccgagatcatgccactgcacttcagcctgagcaacagagtgagactagatctcaaaaaataaaaggcattaatggctcaagtctataatctcagccctttgggaagccaagttgggaggattgcttgaaccctggagtctgagaccagccctggcaacatagtgagacactatctgtacaaaaagaaaaaaaaaaattagtcgggcatggtggctcacacttgtagtcccaactaatatagtctgttaattaaaagagaacgaggccgggcgtggtggctcatgcctgtaatcccagcattttgggaagccgaggtgggcggatcacctgaggtcaagagttcgagaccagcctgaccaacatagagaaactccatctctactaaaaatacaaaatcagccaggcgtggtggtgcatgcctgtaatcccagctactcgggaggctaaggcaggagaatcgcttgaacccaggagttggaggttcctgtgagctgagatcgagccattgcactccagcctgggcaagaaaagcgaaactctgtctcaaaaaaaaaaaaaaaaaaaaaaggccgggtgcagtgggtcacgcctgtaatcccagccctttgggaggccgaggctggaggatcacttacggtcaggagttcaaccaggctggccaacacggggccaacatcaacaccatctctactaaaaacacacacaaaaaaatttgctgggcatggtggcacgctcctgtaatcccagcttcttgaaaggctgaggcaggagaattgcttgaacccaggaggtggaggttgcagtgagccgagatcgcgccattgcactccagcctgggcaatgaatcgagactctgtctcaaaaaaaagaaagagtacgtgaacgaatctataagaaacctggagtaaattatctcattttcagctctgaatcacactacagctcaaggccccagggtccccatgtataaagccttccaggagctaggcgtggtgctgcgcacctgtggttccagctactcgggaggctaaggtgggaggatcccttgagcccaggagctcaagcctgcagtgagctagaattgctccactgcactccagcctcggcaacatagcgagaccctgtctcaaaaaaaattatttttaaacaagtgaactactcagaggtctgagtgttgtatttgtcccaactcagaggggggctccgagccatccaaaattcagcacagtacccgcgatgccgcctatttggacacctactctgcccaacctactccagcccgcgtgcccctgcagcccgtcgggcgcccaggccacgcccctgggcgatattggctctccgattggacagcttaatggaggtgtggccggaagaggcgagtctcattggcagaggcgggaccgacggtgtgtgcggaacatggcggagcgcggcaggaagcggccgtgcggcccggtaagtgcgggcggcgggaccccgtgcagggcagcatggtggaggcgtgagaaccagtggcgtgggggccttcgccggggccgggccgcgcctcctgctgcctgcttcccgctgatcccaggccggaagcccccgaaggtgccgcgtgagcctcagcaggatgggaacagcgcccgtgtcctctccggaactccctgcggctccctggcccccgctggattacggaggcgggaccctgctcgcctccggatgctgaatccggagccctttcgtggcttctggagcccttttctgacttccagggcgactgtgggcagtgctgtaccctgagcctcagttttctcttctgttttgtgggaactcattcgacagtttcttgagtgctttctgtgtgccaggctgggtcccaggcgctggggatacagcgggtccctgccctcctgccgctttctggggcagcagttcgcagaggttccttggcttccttgccgccccgtgtggaggggctggctatggtgcagcaaacggaccccctccaggtgtgaccatcagcctcacactcataatcctcctaccactccttctccagggtgaacacggccaaaggattgagtggcgaaaatggaagcaacagagtaagtaagggtgggtaagagtatcttcccataggccactccaccagtgctcagtcaaaccctggagaaagacaccaactttgttccctctgggtcctgcagcacacaaagtggggaggcaggggccgggagccctggggaggctcccttgctgccctctggctgctcacccagcagctctccagagtccaggctgacccaatgagtgggaactgtctccttggccaattaggatgttcttttatccagagaaagaggagaaaaaaaaatggaaggatctcaagctgatgaaaaaactggagcggcagcgggcacaggaggaacaggcaaagcgcctggaagaggaggaggcagcggcagagaaggaggaccgcggtgagctggggtcttggggagggccacaggttgtggcccacggtagttgtcctgcaggcagagcagagatgtcttatctgaaagggcctttacagaccagtaggtccaaacatcttgtcctgatggagaaactgaggcccagagaagggagggagccagcaaactgagttctgacctcctgcttaggtaaatttcaagcctatggaaggcaagccttatctctcttttttttttttttttgagatggagtcttgctctgttgcccaggctggagtgcaacggcgccatctctgctcactgcaacctccactgcccaagttcaagcaattttcctccctcggccccccgagtagttgggattacagaagtgtgccaccacacctggctaattttcgtatttttagtagagacgtggttgcaccatgttggggaggccggtctcgaactcctgacctcaggtgatctgcccacttcagcctcccaaagtgctgggattacaggcatgagccaccgtgcccggcccaagcctcatatctcttaacttagacctctagaacttcatgatcttcctgattttttgacttttttattgagcattttctgtgtgctttaatttcatttttcaattattttgatttcataataaaaatgaaagaaaactacaaagaagacaggaacaatcccagcaaacattgtagcaaaagcttgtccaaacaattatagctacttatccatgtgtagcaaagtacagatacaatgttacaacagtgaaaccatgttatctatgtgcttcttgggcttttttgtttgtttttgagacacagtctcgctctgttgcccaggctggagtgcagtggctcgatctccgctcactgcaatctccacttcccagttcaatcgattctcctgccccagcctccggagtagctgggattacaggcatgcgccaccatgcccagctaatttttgtatttttagtagagacggggtttcgccatgttggccaggctggtcttgaactcctgacctcactcaggtgatccgcccgccttggcctcccaaagtgctgggattacaggcatgagccaccttttgtgtgaccttgggccatgtatttgacttcccggggctgaaggcccctggtctgtaaatggggataatggcagtatcctcactagggatcaggttaatggctatcgggttaatgtgcacacactaaagacttattagatatcagctttcattttatccccatttgatagctggagaactgaggcagtaagtgggagagccaggatgtgaacttaggccattgctactaaccgctccacagcctcgcccagtggtttgccctgctcagaggagccatggagactgctgggagactgaggcccagagaggggagctggatctattttgctcatctcaaaattcctcccacttgggaaattctcaaaccatgggcgctagggacagaggaagggagagaaaggtagggggcccttgcctctcacactggctgggaacatccctcccctgctcagggcggccctacacactgagcgtagccctgccgggctccatcctggacaatgctcagtcgccggagcttcgcacctacttggccggtcagattgccagagcctgtgccatcttctgtgtggatgagatcgtggtgtttgatgaggagggccaggatgccaagtaaggggccatcccacagggtgccagggttcagggagagggaggggctgccgggatgggccgaggcttcaccatgcccccgtccacatgcctggctcttccctcgtgccctgcctgaaatattccctgtgtaatccttagtgggtagagttgccaggtgggggtgatgactacagaggtgggattgggagccagaaggcctaaacctgtatctcagctgtcaccccggctggagtgcatgcagtggcatggtcatggctcactgcagcctctacttgctgcactcagatgatcctcccaccttagcctcctgagtagctgggattatacgcgtgcacttgtagacaggagctcttgaaggggccacagctggatcctgagcccccatctctctctctccaggactgtggagggggaattcacaggagttgggaagaaggggcaggcgtgcgtacagctggcccggatcctgcagtacctggagtgtccacagtaagggggtcactcccctaagcatgagggaggggtgtgtcaaagtggagaccaggtaggaggcggcttcccctgggaacatcctgaggtcagcattctttcctaggtacctgaggaaggcgttcttccccaagcaccaggatctacagtttgcaggtaacgctgtgtgggcccgcccccccatttcccctggatcatgccacagacactgagaccacccagtcctaccctgcgctgtccaggtgggaaagcaggcctgggagagcaagacctgtgtctgatgccaagacgcaggtctgtggcagagccggtactccgctccagggtccccactgcaccctgtgtgccctagcacttcccagactcttcccggctctgcctccacagggctcctgaaccccctggacagcccccaccacatgcgtcaggatgaggaatccgagttccgagagggcatcgtggtggatcggcccacccggccaggccacggctcctttgtcaactgtggcatgaaaaaggtaggaacagaaagatgggctaggacacacctccaggacacaccctggcaatggagggcaagcagatggatgttgcggagagccctggacctgcccgaaatccctcactgatgcaaatttgggccagagaattgtgcaaaatggggctcaatagataaagccaggaatgaatttactgttgcttaaaaagcaaatcaacagaagacagtcctcatgctccaaacaaaaccctgcagaaacaagttgaaagtcactctggagctgctcccatgtggcacagagccaagctgggatgagggcattaatttgccgcctctttatcctcaagcctcctcaaatcagaggcagaaacctttacatgtatggagtcccttcctgtcagaaagcacaacccaagcgcagtggctcacgcctgtaaccccagcactttgggaggctgaggcaggcgggtcatttgaggtcaggagtttgagaccaacctggccaatatggtgaaaccctgtctctaataaaagtacaaaaatgatccaggtgtggtggcacgcatctataatcccagctactcgggaggctaaggcaggagattcacttgaacccaggagacagaggttgcagtgagctgagatcgtgccactgcactccagcctgggtgagagagccagactccatcttaaaaaagaaaaaaaagaaaaaaaaagttgcagagctaccaaaatgtagaaaactgagtttcatctacttctatcctgtgccatgagcgccccaaaggtgcatgtttggccagtgacctgtgttttgcacaaatgatctcttgtgagcaggttcagccggtgccaggggtggagggtggcaggttgacctggaccccttggtcccttgccagccccggggctcccctggtggcatctggaagagccgtggcccctgctgatcttgagaggaatggcacccatttcttctggcttctccccaggaggtgaagattgacaagaacctggagcccgggcttcgggtgactgtgcgactgaaccagcagcagcacccaggtatctggaaggttctccaacccctgggttggcctgatgagctccagggttcagccacctgcttccattccctcaccccatctttacagactctgttacccctccagactgcaagacctaccatggcaaagtggtatcatcgcaggaccctcgcaccaaagctggtctctactggggctacaccgtccgactggcttcctgcctcagtaaggacagaccttacttctctgaatatccatccatccctctgggaggtggccgggagccttgcctgacccaaatatcagaccagggtttttgtcctgtcaacttgctgtgtgtccttgggcaagtcctttcccttctctgggccttgttctccctggatgcactgcctggaatgctgttaaggactactgagcaaaagtatcattattgatcaataatgtttctgtagggttgggaatggaggcaaaagggccagagaagtcagaggcccacttcatgttcttggtgcctcttcctatccagtctctgccctgttccccagccaagcacaggcttggtgtctgccctgctcagtccttgactttccaggaacagctctacccacccctgctcggtacacacacacccctgcctcagtgcacacacaggcagagctctacccacccacccctaccttagtacacacacgcacacacacacacacacacaccacacagctcttcccacccacccccgcctcagtacacacacacataatacccggagctatggcttgtggggagcaggacctgcactgagctggccccacccccaggtgctgtgtttgctgaggcccccttccaagatgggtatgacctgaccatcgggacgtcagagcgcggctcagatgtggcctctgcccagcttcccaacttcaggtgtgtacctcctggggctgcggccagggcaggaggaatgtggccaggaacctgcctggtgggtgaagctgcacagatgggcccctgctgtctggggtggggagggactgaggtctgggcgctgtgctgggtggggcctcggtggccgctcaggtgaccccctcttacatgggccaggcatgctcttgtggtgttcgggggcctccagggtctggaagctggagcggatgctgaccccaacctggaggtggctgaacccagtgtcctctttgacctgtacgtcaatacctgtcctggccagggtagccgtaccatccgcacggaggtgagcccgcctgcctccccgactgccagccgctggggccttgggatctgtccgaggggcgggtgctactcttgccctgtcacccacccttgcccgtggctgccttgtctggaggtggtcctctcatcccccttggcctcttgccacagcgacgagacatgagtgtagctgggagtcaaccatgggtgctagtgcccgtcctgtgctcccagactgggtgacccagggggccctgcccacccctgctccgggcctctggttccttagccgtgcgctcagtgatctcccagggccctggttctgccacttccttgtgtgtgaccacggtgggcacagcagctctccccttggggtctcacttgcatctgtcccacgggggaagccacgtgcagctggagccttcgtcctggcctcatggaacctgtgtacccacttttggggtcaggcataggacgctgtgctacgggaactctgctgggaaggctggtactcccatcagtctcgccgggccgacagccctgtctacccatccctaaggccttgcccaagccgagcactctgagcctgacagccataccccccagcaggaaccctggctgccacccttccaacccctgcacgaggggtgaaaacttcttgcccctcttcttgccctcccctggccctgggaggtgggcgttgttaccttcgcccccattttacagaagaggagcctgaggagcaggctgtgtggtcctccaggtggcaagtgtgcagtgtgaacctgggcctgtcattaacctcaccaggccctactaaggacaggggacaccagtgggccgggtctcgggcagccaggcactgaagacaggctgggagcgggggcacccgctagccccccaggccccagcccactgccacgcttctcttccaggaagccatcctcatctccctggccgccctgcagcctggcctcacccaggcgggtgcccggcacacctgaaagttctaaggggccgaggacatcagtgaagcagcagtgaaaccaggggctctgcaggtcacttgggacggacgccaccagacttgtctccaaaaatcaccacctttaatactccccggcctgcacacacccacagtctcactgggctccaccctcacttactgcccgccgtgatggccttgaggctgcctgcccgcgccaggatgtttggcacaaagagcagccccgaagcccgctcaatgctctcgatgggcaccaggaagcgctccagtgggatggcctcatccacaggtgcgttgggcatcacgtaggtgcggagctcaatttgcccacctgctgcctccaggatcagcaccttgaagaagtgtgtgggcactgccacgtggttcttgccgatgacctggtactttacgtaggatttcccatcagcctctgtcctgtgggcagacccaggcacacgtgggcagggggcctggatgaacccaaagccacctcttccaggcagccttccctgatctgtcctctaacttctgtcaacctgcaggaccacgccctcactgtgagacttctgtagcctgcctggctcctccttgaggctggaactctctccagggtggttaactctttccctctgttttccttatgcccaacactgggtcaggcagagtgggcgacaataaacgctgctaggagaatcgagccttctgaatattcacattcgtctgaggggagacttaacgactgtccatctctccccacagaggtgagcaacaagtgggcaaggaccatgacaggtgacatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcgtgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcactgcagacctgcggggggaaggtgggagagcttggtgcactgcagacctgcggggggttccatattggcagaacaagattgggtgggcatgccaagaggtgacagcagggagaagcgggggcagattcagggcctgctgctgcccatgggcagaggagagatggtcaggggtacccgacaggtctttggctgtggaggtggaatgaggggactcgaggcagggaagctgacaggcttgccaagaaaccagatgagtagggaactggtattgacccagagcctggggcaagcctggccctgtgagtggcagtaggggcctcaggtgagtgggaggttctgccgcccccctggtttccaccttacctgggcaggaagagtggccctgtgcagacatagacgttttggtagctgcgggtcaagctgcggctatatttctccaggttgttccaggcattctggttgaggtggggcacctggtaggagagatagggcttagcaggactgtggctgggacccttcctcctctatcagagggccgcccca

SEQ ID NO: 15660 - DNA, 18200 bp, Human
gacatgtggggacaggggagagacagctggacggtgacctcctccttcctcctccacaggtctcaatgactcgccctcggccctgcccctctgtccccgcccgccgtggtcccgcccccgactcgcagccagcctactgcgacccgctaccgggcgacgccccgcccctccgtccccgcccctcctgtccctcctcaaggagactccgccccatcgatgccccgcccccgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgagtgcggcggatcccgggcctgagggccctggacggcctgggcgggccgtgcggttgcgtccgggaacggagaccgcgtcctgcggccgctgttcgacccggcctccagctgatggggtggggtcaggcgggcgtcccaggtttggcagagcaggagattggggcgcaaggtcagaagcgggattaaacccacgtcctggagcattcagttccaacgacccaggaaagacaagggggaccccggcttcagttagcacccccacccttagacccagagacaggccggtaggggagagagaccaggagcatccagaccctagctcactctcccagttattctccgattgacacacccgtcgcacgcttaggccagagccactcctccgaccctgtccagttggtcacactcctttggtttatcagacggtccctggggaattgtgtgtggccagagaaacacgcggaggcatcaagctagaaaggcctcagaactggcaggtggcagccccatggtctccctcccctccagcccccttccccaccctggctgtatccttccctccagcccccttccccaccctggctatatcctcccctctagcccccttccccaccctggctatatctacccctcagtcctccccggtgagcagcccggatgctagcctaatttcagtcccttccgtccctgatccaagcatatgttgctggtgtctcactctgtctcagacacacactacggggccagagggcggagggtgcatccaggctcaggcctagaggctcttttaggtgttgcaacaccctgagcctccaccgcacccttgtcactgtctcccaagctgcatccatcccacaaacagcctctagatcatcctccaggaccatccgactggactggttaccttcctgcagggaaactgaggcaaggagggacttgcccagagtcccctggacctgctcattcaaatccagcccaatcccagtgtcctttggtttatttttcataccaaaagtcctccgctcttggaccctagctgaatgagccacagctcaggaaaaaatgagtgttcgtagagggatggctcagatgggtcccaggagtcctggagagaaacaggaaataggcagggcttctggctgtcccatccactgatggccttttcctggtgtctgctcccttgcaccaaccctaatttcaggaccgatcccagggctgtggtgtaacctcagcggccaggcagtctctgtcctccagccaagttttccctcatcaaaacgatcttcgcagattctgacaggtggattttttattaccttttggcctgactccctggcactgagcccatgcagagaagaaaggaaagaactttccaggttcccttctactggaatgcccccccactagccctctcacctgctccccattcctctacttctgggagctcgggagggtggagcagcttctagagtccaggagcttcccctgccactgccacaacccccgatgccaccacagccatcgccactgccacctgcctcccgctgaatcttggctcttgtcttctctttccagcccaggcaagtggctgcctctggctaggttctgctcacccactttgtagcacagttaggcttagagatccagccaaggcagacagacagggcccagaacctcagtcctgccatggaggaggacgggcagcagagagagaaggtatggaacagagctcctgccactcgcctgcccactgcaagagcagcctcgggccctcctgtctctgcccactccagggcctcctggactttctctttctctctctgccgcctctcaccctccatgccaggccacccggctctctcgccacagcactgccctcaccccacccctgccccatctcaaaggcaggaggaagcccaaggcccctcacccgaaggtgctgccattgtctggctctctgtgattctctcttcttcccttctgtttctcaacctggaaagggtgggagaaaaggacgtggggacctccaagagggacagtcaccactctgctggctggctcctcttccagggtgagaaaggaggggcctgtgcaacccaacaggtgggcggtccccctcacctctgccaccccaaaggtgccgttcatcctgacttggttcccctgagccttgctaagaaccatggccacaccccaccctcccccatccctacctgcatctccaggccccagagaggcggggacacctagagctctagggctgggaggccagggccagccccacccaagaggccgtctctgcccccagggatgggcacttaagtgcccaggactacagctttggggctgccagggctccagagccggggagggaatgaacaggatgttctgctacctgcaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactgggtgagtgagggcatcctcactgtgacctgctgctggctgcacatgcacagttctccagtgcccactgctctggcacggccgttcgtttgctgcccagagtttcgtgagcacatactctgtgtctggcacttggcagggtgctgggtgatcaagaaggacacagtcaccagctccttggagctaacattcaagtagggaggagagaaaggtaatgaacaggatacaggttgtggacaaggtttcatgttccaggacagaggcaggagtggggtgcacggcaggtacaaccagatagaagatgcccttgtgcttggtgggacagcctcaggcaggggatatgtgtcactcagtgaccgatcgcccaggttctgtatctgatctatgacacaggtgtacccagtttggcaaatatgtctacaccaatgtttggtgtgcttttctatttgcatctcatacttcaatacacagatttaaaaagtggcagctggatgcagtgactcacacctataatcccagcactttgggagtccaaggcgggcagatcacaaggtcaggagttcgggaccagcctggccaacatgatgaaaccctgtctctactaaaaatacaaaaattagccaggcgtagtggcacgcacctgtaatcccagatactggggaggctgaggcaggagaattgcttgaacctggcaggtggaggttgcagtgagccaagattgtgccactgcactccagcctgggcgacagagcaagactctgtcttgggaaaaaaaaaaggtgacccagctgctgggagggaggcagagtggaagccagaggcgagggggaggggtgacatcacccccaaggagctgtggcagcctgggtctgacaccggatgggagagagggagagtcgttaggtccaggactgttttggaggcagtgccagtgtcacttgccaatgaggtgggggcacgggtggaatttgccaagtcggggttgcctgagagagaagctacctgtgggagagccagagcgggtccggccctgggaaatgctgtgttatagggggtgccatggggaggggaggtagagctctagccctggggcttggcggaggctgtggggctgcacacaggaggtgggagttgtcaacatttgctgagacgcgtcaggtcaggactttggactccagaaccaagatgcttcccccgaaaggtccttagagcgtctgggggctggtggttttccgacttcatttagcctgggactccttcaaacagaagctcctggttaaaggggtgggggcacccctccttccactcacggggccaccgaagggtctccgccaccacctggcagattctcgctgggggagtacccatacctgcggggtctcctctggtctcccaagctttggccagaggctctgggatccctagtggagtacaggcccctggctgtttccccaagggaaggaagctcctgtctgcccttcactgatctacagatgaggaaaactaaggcccagagaggtggcccaaaagcccagagccacacagcagctctcaaggaagccctcggccacacaggaaggtctgactgactcagggacccagttcttaggggctaccagtcacctgttgtacaacttggggacaagttgcctccccctcaccccttgccaagttgcctccccctcaccccttgccaaaggctagtggcccagtgctgcaggggagtgcgtgtgatgaagaggcgcatcctgctgctgttcaccacgggttgagggggcgcaggtgggcccaggtctctgggggtggaaggccagagaaagctgtactggctgtgtgcaggaagggtgggtgttgcagtcagcatagaggacacagggtgacagtcacctgggagtgtgcgcagcgccagacatggagcctttaataccacatccctggctggtgcccagagaccccccaccccccagagagaggacagaccgtcagggcagagagtaaggatgtgtcacccacatcttgtcactagcataaggattcatccttgcagggagcatcccctcaagattgccctgaccttgagatcaaagtgggtatctactccccgaggccacaggttcctcaggctgctctgataccccagtctcctgcctccttggacagttctctgctggggatggtcaaaaactcacttattgggccagacgcggtggctcacgcctggaatcccagcactttgggaagctgaggcaggtggatcatttgaggtcaggagttcaagaccagcctggccaacatggtgaaaacctgtctgcagcaaaaaatacaaaaatgagccaggcatggtggtgcgcacctatagtcccagctactcaagaggctgaggcaagagaatcgcttgaatgcaggaggtggaggttgcagtgagctgagatagcaccgtggcactttagcctgggtgacagtgagaccctgtctcaaaaaaaaagtcactcattggactttgtttttgtagacccttcccttttttcctttctatctattcaggcatacattttaatttaacatatgacagtcattgacagagaatgtgtaagatgagaatttgttcaccttgccgggcgcggtggctcacgcctgtaatcccagcactttgggaggccgaggcgggaggatcacgaggtcaggagatcgagaccatcctggctaacacggtgaaaccccgtctctactaaaactacaaaaaaaaaaattagccgggcacagtggcgggcgcctgtagtcccagctactcaggaggctgaggcaggagaatggcgtgaacccaggaggtggagcttgcagtgagccgagatcatgccactgcactccagcgtgggggacagagcgagactccgtctcaaaaaaaaaaaaaaagaccgggcacagtggctcatgcctgtaatcccagcactttgggaggccaaggcgggcggatcatgaggtcaggaaatcgagaccatcctggctaacacggtgaaaccccgtctctactaaaaatacaaaaaaatagccaggtgtggtggcgggcgcctgtagtcccacttactcaggaggctgaggcaggagaatggcgtgaacccaggaggcggagcttgcagtgagccgagattgcgccactgcactccagcctgcatgacacagcgagaccctgtctcaaaaaaaaaaaaagaattcgttcaccttgctgcccctccccacaccccgggtttcctcctgatctttctttcacatcctttcttagcagcagcatctgattgatctggctaatactgatcactcgggctaaagggaagaggctggtgggtttaagttgtggggcagggagggtgggttctggatctaggcatttactttgagaatctccatagccaggtagagggcatgggggccagccaggtcccctagccctggggaacagggggcaccagggcccatgcacccctcctgacaggctctggcacttttcccagctgtctgagtggtggctcaagaccgcctacctccagtaccgccagcctgtggtcatctactcgagcccaggcgtgatgctacccaagcaggacttcgtggacctgcagggtcagctccggtgagtggctggggtttgggggccaggaggcagccgggcccctcgagttcacttcgcccagccgcttggaggggccccaaccctgtttatctttctgccccacaagcagccttatgaagtagggagcatcctccctattttacaaatggggaaattgaggctcggagcagggaagggagctgcccaagaccccattcaggaagcagggtctctccagctctaaagcctcatggctgttaaccaccacatcttcgcagaggccccatcctcctccatacctgaggcttctccccgaccccagttttagcacttcacctctcctttccactcttctcagctagccacaggggtgacctctgtacacagtcctcttttccacattcagccaggtcacctgccccagcccctattccagtcctaccagagataaaaataccagtgacaaggatctcctgcccaaggaccagccactggctgccaccacctgcttctcttaaagggaccagggtaccctgggaagggccggggttcaggcccaggaactccagccactggtccccatggtgggatccaggggcggccccaagcattgagggtggttgccatgggccagacagccctgggaggaaggcggcctgggggacacagaggcccagagtggggaagggacctagtggagggaacaccggagccactgctctcccatcacaccaccccaggggcccggggcctccagaaccgatgcttcagagcagatgacaccccctccagattctaggctgaggttcaggagctcaggccctttgtgggtagacccagcccactgacccctaaccaagccacactccagctgcagggggccagcacccaagtcctactaggcccttggccaccagcacttccccgagccctcccgaccatgctccctctagaggttatgaagaagcacacacaggctggcaagctgggactcacaggcccctcccttgcgctcccaggctttctggaagcggtgagagaggctggaagactagacctcccgctccccaagcaggtgtccctagcccggggcctccctcagggtgtccacgcagcttctaatctctaatcaatctttccagatttgctgccaaactcattgagggtgtgttggatttcaaggtcatgattgacaagtgagcatccccacccctgcccagccccacacctgcccaggcctgcttaattaccacagccacctctgaccccagccctggcccggcatgccagcttgggccctgggccctgctccagctgctggaatctcctcttggtgggtgaccctgtcccatcccaactaaagaggaccccagagttttattcgctgcttcatctcccctgtgacaaactgaagcccagagaggggaaaggagggagtttctagatgacttctgaacaggacccatctggggcagaaagcgagccccctgcccacagcacagccctgaggtgtcctgctcatctgggagtgggagcagggacactgtgtgagcccccagcagtacctagcaggtccctgtctaccctgccctcctccccattcacttgcccagtggtggcctcactgcccctctaccccatagcgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccaggtgggtggcccccacccacacctacaagccccggccctgctgcaggagtacagccggacggccgcagtcggcttccccactggggttccccagcacacgtgcccacgtgccccaggaatgggcgcccctggcttctccattgggggcccagggaggccaggaggggccgtgggcctgcccagcccagaagggtgatccaaggacctcctccccctctcacccttggcctgactccatcccctccaaggccaaggccaggaggaggcaggtgtggggaggtggctgctctcagcctgaggtccccactcagctccctcctcttacctgcctgtgccccaacagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaaggtgcctcttgggggccgtgctggggctgcacacccaggcctcttcccctgttggggaccagcctcaactccacctgtagggtacccgaagtctgctggcaacaaaggaatgagaagagacaggttaagagttcatgaaggtgggagccaggggccagttgcaaaatggaggctgcaaaaggcgcagagttctggtctccacactattgagtgcagtcacttagctctaagaagcacatgttcagggcgaaacagtgaaagggaggcagtgcctcataggaggcataatctatagcaatagcagtttaaatgaatctcctttgtgctcaaacagcgtgtctttaacttatcggagagtagctggtgggagcgggcttaactaggagcctgcacatctgtccacttcccagtgtttcaaaggagtgtctttctccttgaacacagtgtttacagataggagagcgggtctcgctctgagcatgggaacatgatggcaattagtaggctttcctcctccgtggcctcttctggctttccacaacttattgtcccctatttttatggccagtttatacaggcaccccacaagcccttttcccaacattcccccggcatgctgggccccgcacagccatgggcagacatgtttcccgctgcatcctctcaacgtggagcaggcaatgtgggccccatgtcctagttgaggacacctcatggttagggtagtttctctcagctaaatagcaagttaggattagagtccaagtcctctggctgagaagcccacccgcctccacaccccctgtgcccccaagtaccagcagtcctccaaagcatgtcttgctcaggggcattgaccccaaagtcagaccacctgtgtgggttccccggctgccacaccagctcccatgtgacccctgggcttcggtttcctgtgtctaaagtgggccaggtgttgggccctgcctcgaggagtgctgtgggcctgcagggtcctgttgagttcgaagctctgaacccacaccctgcacttggtgaatgccctggagggccggcgaggtggggggtctcctcatcccagagaggtacaaatgggtcagaagagcccagggcaggaggctgcggaggggctggtccatctctcccacaccatgagaccccattttgcgtctccccgccccatgccacctgcagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcaggtgaggcccggcagggcttcgcccactcacacacacctgaacaggacctctgcagcctcgggacttcctgcccgtccccggctgcgtccccagcctcctagcttgtaaagcaggcaggaagccagcaggctggacgctgccgtaattaccaggcagccagcctgtcatcaccagtcctgcctctggcctggaaaccgctgtcacccccagcacaccccctcagcacctcacagagaacctgggatccggggtcaccagtgcaatcctggcacaacagtccctctccacacctgtaaaatggggtgatggtcaacctcaccggtagagtagtttgaaggactcagtcaggcacgctgagcgtgggatgtgcttagcacaccagggcacctggtgagtgtcagctattgttaataacagtaataagtcatcatagccccttgagatggcttcagagaggcccttgcctcaaccaaagagtggttgggtgaggggccaccccccagggccctggggctgaccggggtctcccttcccttccacagttcatcgtggcagaagatggctcctgtgggcttgtgtacgagcatgctgcagcggaggggccccctattgtcacccttctggactatgtcatcgagtacacgtgagtacagtcacatctctcgcctagttccccagcttctagtgacaggtgacacacaggtgatagaccagtttatagagaaatatcactctcctttgtgcctgggaatctgtttttttccaaggaagccagccagatatggtggctcacgcctgtaatcctgacactttgggaggctgaggtgggaggatcaattgaggtcaggagtttgagatcagcctggccaacatggtgaaatgccatctctactaaaaatacaaaaaaaaaaaaattagccaggtgtggtatcacatgcctataatcccagttactcaggaggctgaggcaggagaattgcttgaacccaggaggcagaggttgcgttgagcggagactgtgccactgcactccagcctgggtgacagagcaagactctgtctcaaaaaaaaaaaaaaaattaggccaggtgcagtggctcatgcctgtaatcccagcactttgggaggcggatcacctgaggtcaggagttcaagaccagcctggccaacatggtgaaaccctgtctctacaaaaattagccaggcatgatggcgggtgcctgtaatcccagctacttgggaggctgaggcaggagaatcgcttgaacctgggaggcagaggttgcagtgagctgagatcacaccattgcactctagcctgggcgacagaatgagactctgtttcaaaaaaaaaaaaaaaaaagttagccacgcgtggtggtgggtgcctgtaatcccagctactcaagaggctaaggcacaagaatcacttgaacccaggaggtggaggttgcagtgagccgagatcgttccattgctccagcctgggtgacagagcaagactctgtctcaaaagaaaaagaaaaaaattagccaaggtggcgggcatctgtaatcccagctactcaggaggctgaggcaggagaatcgcttgaaccagggaggccaaggttgcagtgagctgagatcgcatcactgcactccagcctgggcaacagagcaagactccatctaaaaaaaaaaaaaagaaaaaagaaaaaaaagctgaagtgagggtggttttcagaacaaactcacacctccctgggctggccccctccagcttcaggtacccatcctccccaccctggtcccagaatggacccaggctctagaggcaccagcatgagcctgaggccccgtttactgtgcaggaagaaacccgagcttgtgcggtctcccatggtgcccctgcccatgcccaagaagctgcggttcaacatcacccccgagatcaagagcgacatcgagaaggccaagcagaacctcagcatgtaagtgcctgcccccgccatccctgtgctggatgggtgaggccaggcccttgagcttgagaggctcctgtgccagctctgtcatgacacccagaccctccgtggggttggcaggggctgccggggcctgctcctcacctgctcttcccacacccccagcatgatccaggacctggatatcaccgtgatggtgttccaccattttggaaaagacttccccaagtcggagaagctaagcccagatgccttcatccagatggctttgcagctggcctactacaggtgcgcctctgtggcccacccatggaggagggaggagacctgggggcaggggagggggtgcccgcctccaaggggcgtgcttagccccatttcccaccaggatctacggacaggcatgtgccacctatgaaagtgcctccctgcgcatgtttcacctgggccgcaccgacaccatccgctcggcttccatggactcactcacctttgtcaaggccatggatgactccagcgtcacggtgagaggtctggggcgagggtgggtgagctgggcctgagcccctccctcctgctcactcagtcaacacacaataattgagcacctacaggattccagccccatggtgggcacggggaatctaacagaagctggagccgtgaatctagctctgagcttcctggggaccaaagaggaaaagggagtcattcatttgttcattcatttattcattggcagtaagcaactgccctatgtcaggccctggctgaggaccaaggagttggtagttgcaatactcgctctttttttttcttgtttttttttagaaagagtctcactctgttgcccaggctggagtgcagtggtgtgatctcgactcactgcaacctccacctcccgggttcaagcaatcctcctgcctcagcctcccaagtagctgggactacaggtgcctgccaccatgcccggctaatttttgtatttttagtagaaacgggatttcaccatgttggccaggctggtctcaaactcctgacctcaagggatccacctgcctcggcctcccaaagtgctgggattacaggcgtgagccaccgctcccagccccaatatttcctcttaaagagctcagaatctagtgctgggtgggggtgggctactgaggtgggccagaagagaagggacagtgcttcagctccctctgaccctcaccactctaggagcaccagaaggtggagctgctgcggaaggccgtgcaggcccaccgaggctacaccgaccgggtaagtgagcccgcttgtgcctactcacttgtcccttagtgtcagccatctgtctgtccctctgactgtccgtccctgcagccaatggctgccaaccctttgctaggaccacatctcccccaacctgggagcacctggagccaggctgaatagcccccaactttttctttttttttttttttgagatggagtcttgctctgtcgcccaggctggagtgcagtggtgtgatttaggctcactgcaacctccgcctcccaggttcaagcaattctcctgcctcagcctcccaagtagctgggattacaggcacccaccaccacacctggctaatttttccatttttagtagaaacagggtttcaccatgttgacaggctggtctcaaactcctgacctcaggtgatccacccacctcaggctcccaaagtgctgggattataggcgtgagccaccgtgcccggccaaatatccccattttaaagttggagaaacccagcctgggcccagtaactgccttggttccaggttccagggctggcctgggccctagatgttgggtcacactctctccctgatgctaggtatctctccctgacgctaggtatacatggtccagcagacagccagtttcctgccctccagcagcttgggctgcagtcagggaggtggctgtctggatgcgtgtcctggctctgtctctgagcacctgtgtgtccaggctctgaccgtgctacatgcacacgtccatttagagctcaccgccaccctgcgaggggagtgtaggactcacccctctttacagatgaagacactacagttccagaacctaagcaacctgccaaggccctgcagccaggatggggctaggtcacccagctccagggccctgccctacaaccctgcactttcctgcctccctgggcaaatccccgcccctccctgagccttggtttccccatctgtgaaacgaaggctctctctggccagaatactctggtcttgtggttttgagtggccagtgcctgcgaagggtggcgctgccacaggctgaagagggcagggataccccgggggtccacagcccctgctcctgacagctctcccaccccaacaggccatccgcggggaggcctttgatcgacacctgctgggcctgaagctgcaggccatcgaggacctggtgagcatgcccgacatcttcatggacacctcctacgccatcgccatgcacttccacctctccaccagccaggtgggccactgccccaggtgccccgggggctggaggcagagaacccactggtagtttgatgtggcctacacaggccccactgacccattgccaacacagctgagttccagaggaggagctgggggcaggggcctctctgcagcccaggcaggctgagaaggggtcagtgctcctcatgggagaatcagcttcgctgactcactggtcaggtataaaggaacatttgattcgtgccagcctgtagtggttgctgggatatagcaggggacagaccatgatccctgcccacaaggggcctgcagtcttggcggaagcacaggcagcctgggaagtgctgggggcgtcaaggtaggggagctgagagctttcatcctgccgtccccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctaggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaagaggtgtttcagctgagaggcaggcagggtgggggcaggcacctggccttgccctcttcagctttccctgggcctcggagctggtgtccaagcagccggtgggcctgagggctttggcccaggagccaaggtccagctgtgaccttggggcactgggcccagaaccataccagagccagggctgcgtccttcaccagcagcttcccacctgcctctggcttgggccttcccaagtcccatgggttgtgggtaggggcaactctcccaggggactgtggggcccagcaggcccaggtctggtgggctgatgaatgttgctaatacccaggggcccagggtgtcattctacttcccccaactgagcccagcaaaagtaggagtacagcagcaggctcagcttgccccaggcccagccgctgccaggacagacaccttcgggggtgggcaggtgcgatcagagcagaaccacatacctgcccatagccccgtgtccatggctgaggcagggcatcctggcaaaaccaagcgtgcagtttgtggagaggggagagtctcccattaggacactggcctgtgaggaaggcctgtgtgaaaccacaagggcggatgccggggtgggctgggggaggttggctggcctgtgagtgaagggctctgtgacctgactaagctgggacagtcatccgagagtggggcctttggttttctccgtttgtcagatgaggaagcaggcttagcgaggttaaggtcaccgggacgctaaatggcagagcaggattcacagaggccacacttgtctcctctaggccggggctccaagaagcccctccctagagccaggtccccagccccaggccacatccacctaggtgtcccgcagcagggggtggagaaagggatgctatgggtggaaaccggcccagcctcaggaccacaaggaagcgggtaaagagggaggctgggctgagcctgagctctaatcaggcgcagggacctgccaggcctgaccattggtggtgtactcagcaggagagggcagccacttgcccagtgccccaagggcacaggaggtgtagcccagacaatggaggaaatggatggaggcagagaaagggatgcctctggggggaacacgcaggcctggaagagaatgtcacctggaccagcacccggactctgctcctcgctacacaacagggtgctccctctgggggtgactagaaccgctaggaaacagggtacacagcagggcagagtgctgcatgagcagccaggagtgggcctgcagccagcccaggcaggacagggaggggagagcgaacagtcaagaggctgccagacagacaccctggattcccaaaactcgcctaagaaccctacaggtctgaatataaggttggattttttttcccccagaattatccttctgaattgaggggcatccccttagggtggtggcattacaggccccatcacatggaagccccctcaattccttggagccaccaagtattgttcagggagggcgcattcagcatctgagcaacctcagtcatggtgagagggaatccctagaggtcctttgtgggggaaaaaggcaaagaaacaagatttcgccgttcttccttaggggtaattcctgagacctcacactctcaagtgttggatgtcgggataaaccagcgcttaacgttgtgccagggggcacttgtggcttggaatgaaatttctagagctagtgctgtgcatgaaatcctacaggcgctgcttaaaggctagcatagccaagacagcggccccaggagagcaggctcagctgacccagagggggctccaggggtgaccaaactctggcgccagtgatgcagacgaaaaacgtgattcgtttttgcaaaatgagtgaaaaaaagctgttctgaattggtatatcttgagcaatgcatcatttgacatttgaatgagtaataaatttttttttttttgag

SEQ ID NO: 15661 - DNA, 18200 bp, Human; identical to SEQ ID NO: 15660

SEQ ID NO: 15662 - DNA, 19719 bp, Human
gccttttctgattttcaacatttctccctcctgagaccttcccagggaccccaacattggagacaggatagcaagaatatcaaatgctttcaaaacattagctgtgtttggtcggccaacctatttgcctctgtcgggaatgtaaaagttatctatggccagtccttcttagttcaaggtaggtcggcaaacagccttctccttctgcacaaaaagggtctctaagatccttccgtagcacctccatcccagttatttaagatgaactaaaaagaggctacaaggtaaataagagttaccgaaggagatgccggagagactaacctccttgcacaaccagccttttaaaattagggatttagacaccacgggcagtttccctcaataaattctcaggcactggaaccagagagtaggaggatgaggggtgagcaggacgcggaggccgaaactggaggcgaggcgggcgcaggcccacggagcaccaccccatcccctaagcagcgactaataaagacggcagcctccggaatcactttcgcccccctccctggcagcttccccaccgagtcaacagcttacttaagcacgcgctgcccagagatgcaaaaggcccccttatgaccacggcgctgcccacccagcattcgggcagcctggactcccacaaaacccagagttgcgccccaatcaccacccctttgcagcccctggttccctccccagcggcgccccaccacccacctctcccctaaggccattcaactcagtccctcctcggggcccctcagcttttgcccctccagttcctccgtgtcatgactctcgccctcctgagcctcccacacctggcaccgcccccaccctacccgaccccggcccggcctggccccgccggccttacctggcggcggctgccgctcgccctcagccatcttgctccggccaggagccgacccggatgcttgcagtcccctctcgcctttcactcttgcacccacccttcctctccccggctccaccaaaggctccgagcttcctgaagacaagtgagcgccggccggctataaccgaaaaccgagagttaaagtcaccacagcgaagacggccgccatgtcggtgcggggcgctcagggagcaagcctattaacggccggcgcgcggcggacgcgcggacccgggcgacggccatgtcagtgcggggcgcgcggggcgcatgcgcgccaacggccgccaagcgctaggaccgctcacggccgcccgaacgtcgggcgccgcgactgccacgattgtgcggggcgtcaagtttgggttgtgctcagccatgtttttccgggacagtctcctgtcccggagtaccacctgtcatctttgtgggtggtactgaccctaacccaaggaatattagaggacattccccggtcaacatggttgtgttttcctatcactctaagagttaggctcaaggacaccagacggagttggaaaggtgcacaccactacctccaacagcttagaagacatgtggggacaggggagagacagctggacggtgacctcctccttcctcctccacaggtctcaatgactcgccctcggccctgcccctctgtccccgcccgccgtggtcccgcccccgactcgcagccagcctactgcgacccgctaccgggcgacgccccgcccctccgtccccgcccctcctgtccctcctcaaggagactccgccccatcgatgccccgcccccgccccacagccaacctcccgggcaccgttgcccgcccggggcccgctaccggcccaggccccgcctcgcgagtcctcctccccgggtgcctgcccgcagcccgctcggcccagagggtgggcgcggggctgcctctaccggctggcggctgtaactcagcgaccttggcccgaaggctctagcaaggacccaccgaccccagccgcggcggcggcggcgcggactttgcccggtgtgtggggcggagcggactgcgtgtccgcggacgggcagcgaagatgttagccttcgctgccaggaccgtggtgagtgcggcggatcccgggcctgagggccctggacggcctgggcgggccgtgcggttgcgtccgggaacggagaccgcgtcctgcggccgctgttcgacccggcctccagctgatggggtggggtcaggcgggcgtcccaggtttggcagagcaggagattggggcgcaaggtcagaagcgggattaaacccacgtcctggagcattcagttccaacgacccaggaaagacaagggggaccccggcttcagttagcacccccacccttagacccagagacaggccggtaggggagagagaccaggagcatccagaccctagctcactctcccagttattctccgattgacacacccgtcgcacgcttaggccagagccactcctccgaccctgtccagttggtcacactcctttggtttatcagacggtccctggggaattgtgtgtggccagagaaacacgcggaggcatcaagctagaaaggcctcagaactggcaggtggcagccccatggtctccctcccctccagcccccttccccaccctggctgtatccttccctccagcccccttccccaccctggctatatcctcccctctagcccccttccccaccctggctatatctacccctcagtcctccccggtgagcagcccggatgctagcctaatttcagtcccttccgtccctgatccaagcatatgttgctggtgtctcactctgtctcagacacacactacggggccagagggcggagggtgcatccaggctcaggcctagaggctcttttaggtgttgcaacaccctgagcctccaccgcacccttgtcactgtctcccaagctgcatccatcccacaaacagcctctagatcatcctccaggaccatccgactggactggttaccttcctgcagggaaactgaggcaaggagggacttgcccagagtcccctggacctgctcattcaaatccagcccaatcccagtgtcctttggtttatttttcataccaaaagtcctccgctcttggaccctagctgaatgagccacagctcaggaaaaaatgagtgttcgtagagggatggctcagatgggtcccaggagtcctggagagaaacaggaaataggcagggcttctggctgtcccatccactgatggccttttcctggtgtctgctcccttgcaccaaccctaatttcaggaccgatcccagggctgtggtgtaacctcagcggccaggcagtctctgtcctccagccaagttttccctcatcaaaacgatcttcgcagattctgacaggtggattttttattaccttttggcctgactccctggcactgagcccatgcagagaagaaaggaaagaactttccaggttcccttctactggaatgcccccccactagccctctcacctgctccccattcctctacttctgggagctcgggagggtggagcagcttctagagtccaggagcttcccctgccactgccacaacccccgatgccaccacagccatcgccactgccacctgcctcccgctgaatcttggctcttgtcttctctttccagcccaggcaagtggctgcctctggctaggttctgctcacccactttgtagcacagttaggcttagagatccagccaaggcagacagacagggcccagaacctcagtcctgccatggaggaggacgggcagcagagagagaaggtatggaacagagctcctgccactcgcctgcccactgcaagagcagcctcgggccctcctgtctctgcccactccagggcctcctggactttctctttctctctctgccgcctctcaccctccatgccaggccacccggctctctcgccacagcactgccctcaccccacccctgccccatctcaaaggcaggaggaagcccaaggcccctcacccgaaggtgctgccattgtctggctctctgtgattctctcttcttcccttctgtttctcaacctggaaagggtgggagaaaaggacgtggggacctccaagagggacagtcaccactctgctggctggctcctcttccagggtgagaaaggaggggcctgtgcaacccaacaggtgggcggtccccctcacctctgccaccccaaaggtgccgttcatcctgacttggttcccctgagccttgctaagaaccatggccacaccccaccctcccccatccctacctgcatctccaggccccagagaggcggggacacctagagctctagggctgggaggccagggccagccccacccaagaggccgtctctgcccccagggatgggcacttaagtgcccaggactacagctttggggctgccagggctccagagccggggagggaatgaacaggatgttctgctacctgcaggtgaagcctctgggcttcctgaagcccttctccttgatgaaggcttccagccgcttcaaggcacaccaggatgcactgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggagcgtcgggccaggaagacggagaactgggtgagtgagggcatcctcactgtgacctgctgctggctgcacatgcacagttctccagtgcccactgctctggcacggccgttcgtttgctgcccagagtttcgtgagcacatactctgtgtctggcacttggcagggtgctgggtgatcaagaaggacacagtcaccagctccttggagctaacattcaagtagggaggagagaaaggtaatgaacaggatacaggttgtggacaaggtttcatgttccaggacagaggcaggagtggggtgcacggcaggtacaaccagatagaagatgcccttgtgcttggtgggacagcctcaggcaggggatatgtgtcactcagtgaccgatcgcccaggttctgtatctgatctatgacacaggtgtacccagtttggcaaatatgtctacaccaatgtttggtgtgcttttctatttgcatctcatacttcaatacacagatttaaaaagtggcagctggatgcagtgactcacacctataatcccagcactttgggagtccaaggcgggcagatcacaaggtcaggagttcgggaccagcctggccaacatgatgaaaccctgtctctactaaaaatacaaaaattagccaggcgtagtggcacgcacctgtaatcccagatactggggaggctgaggcaggagaattgcttgaacctggcaggtggaggttgcagtgagccaagattgtgccactgcactccagcctgggcgacagagcaagactctgtcttgggaaaaaaaaaaggtgacccagctgctgggagggaggcagagtggaagccagaggcgagggggaggggtgacatcacccccaaggagctgtggcagcctgggtctgacaccggatgggagagagggagagtcgttaggtccaggactgttttggaggcagtgccagtgtcacttgccaatgaggtgggggcacgggtggaatttgccaagtcggggttgcctgagagagaagctacctgtgggagagccagagcgggtccggccctgggaaatgctgtgttatagggggtgccatggggaggggaggtagagctctagccctggggcttggcggaggctgtggggctgcacacaggaggtgggagttgtcaacatttgctgagacgcgtcaggtcaggactttggactccagaaccaagatgcttcccccgaaaggtccttagagcgtctgggggctggtggttttccgacttcatttagcctgggactccttcaaacagaagctcctggttaaaggggtgggggcacccctccttccactcacggggccaccgaagggtctccgccaccacctggcagattctcgctgggggagtacccatacctgcggggtctcctctggtctcccaagctttggccagaggctctgggatccctagtggagtacaggcccctggctgtttccccaagggaaggaagctcctgtctgcccttcactgatctacagatgaggaaaactaaggcccagagaggtggcccaaaagcccagagccacacagcagctctcaaggaagccctcggccacacaggaaggtctgactgactcagggacccagttcttaggggctaccagtcacctgttgtacaacttggggacaagttgcctccccctcaccccttgccaagttgcctccccctcaccccttgccaaaggctagtggcccagtgctgcaggggagtgcgtgtgatgaagaggcgcatcctgctgctgttcaccacgggttgagggggcgcaggtgggcccaggtctctgggggtggaaggccagagaaagctgtactggctgtgtgcaggaagggtgggtgttgcagtcagcatagaggacacagggtgacagtcacctgggagtgtgcgcagcgccagacatggagcctttaataccacatccctggctggtgcccagagaccccccaccccccagagagaggacagaccgtcagggcagagagtaaggatgtgtcacccacatcttgtcactagcataaggattcatccttgcagggagcatcccctcaagattgccctgaccttgagatcaaagtgggtatctactccccgaggccacaggttcctcaggctgctctgataccccagtctcctgcctccttggacagttctctgctggggatggtcaaaaactcacttattgggccagacgcggtggctcacgcctggaatcccagcactttgggaagctgaggcaggtggatcatttgaggtcaggagttcaagaccagcctggccaacatggtgaaaacctgtctgcagcaaaaaatacaaaaatgagccaggcatggtggtgcgcacctatagtcccagctactcaagaggctgaggcaagagaatcgcttgaatgcaggaggtggaggttgcagtgagctgagatagcaccgtggcactttagcctgggtgacagtgagaccctgtctcaaaaaaaaagtcactcattggactttgtttttgtagacccttcccttttttcctttctatctattcaggcatacattttaatttaacatatgacagtcattgacagagaatgtgtaagatgagaatttgttcaccttgccgggcgcggtggctcacgcctgtaatcccagcactttgggaggccgaggcgggaggatcacgaggtcaggagatcgagaccatcctggctaacacggtgaaaccccgtctctactaaaactacaaaaaaaaaaattagccgggcacagtggcgggcgcctgtagtcccagctactcaggaggctgaggcaggagaatggcgtgaacccaggaggtggagcttgcagtgagccgagatcatgccactgcactccagcgtgggggacagagcgagactccgtctcaaaaaaaaaaaaaaagaccgggcacagtggctcatgcctgtaatcccagcactttgggaggccaaggcgggcggatcatgaggtcaggaaatcgagaccatcctggctaacacggtgaaaccccgtctctactaaaaatacaaaaaaatagccaggtgtggtggcgggcgcctgtagtcccacttactcaggaggctgaggcaggagaatggcgtgaacccaggaggcggagcttgcagtgagccgagattgcgccactgcactccagcctgcatgacacagcgagaccctgtctcaaaaaaaaaaaaagaattcgttcaccttgctgcccctccccacaccccgggtttcctcctgatctttctttcacatcctttcttagcagcagcatctgattgatctggctaatactgatcactcgggctaaagggaagaggctggtgggtttaagttgtggggcagggagggtgggttctggatctaggcatttactttgagaatctccatagccaggtagagggcatgggggccagccaggtcccctagccctggggaacagggggcaccagggcccatgcacccctcctgacaggctctggcacttttcccagctgtctgagtggtggctcaagaccgcctacctccagtaccgccagcctgtggtcatctactcgagcccaggcgtgatgctacccaagcaggacttcgtggacctgcagggtcagctccggtgagtggctggggtttgggggccaggaggcagccgggcccctcgagttcacttcgcccagccgcttggaggggccccaaccctgtttatctttctgccccacaagcagccttatgaagtagggagcatcctccctattttacaaatggggaaattgaggctcggagcagggaagggagctgcccaagaccccattcaggaagcagggtctctccagctctaaagcctcatggctgttaaccaccacatcttcgcagaggccccatcctcctccatacctgaggcttctccccgaccccagttttagcacttcacctctcctttccactcttctcagctagccacaggggtgacctctgtacacagtcctcttttccacattcagccaggtcacctgccccagcccctattccagtcctaccagagataaaaataccagtgacaaggatctcctgcccaaggaccagccactggctgccaccacctgcttctcttaaagggaccagggtaccctgggaagggccggggttcaggcccaggaactccagccactggtccccatggtgggatccaggggcggccccaagcattgagggtggttgccatgggccagacagccctgggaggaaggcggcctgggggacacagaggcccagagtggggaagggacctagtggagggaacaccggagccactgctctcccatcacaccaccccaggggcccggggcctccagaaccgatgcttcagagcagatgacaccccctccagattctaggctgaggttcaggagctcaggccctttgtgggtagacccagcccactgacccctaaccaagccacactccagctgcagggggccagcacccaagtcctactaggcccttggccaccagcacttccccgagccctcccgaccatgctccctctagaggttatgaagaagcacacacaggctggcaagctgggactcacaggcccctcccttgcgctcccaggctttctggaagcggtgagagaggctggaagactagacctcccgctccccaagcaggtgtccctagcccggggcctccctcagggtgtccacgcagcttctaatctctaatcaatctttccagatttgctgccaaactcattgagggtgtgttggatttcaaggtcatgattgacaagtgagcatccccacccctgcccagccccacacctgcccaggcctgcttaattaccacagccacctctgaccccagccctggcccggcatgccagcttgggccctgggccctgctccagctgctggaatctcctcttggtgggtgaccctgtcccatcccaactaaagaggaccccagagttttattcgctgcttcatctcccctgtgacaaactgaagcccagagaggggaaaggagggagtttctagatgacttctgaacaggacccatctggggcagaaagcgagccccctgcccacagcacagccctgaggtgtcctgctcatctgggagtgggagcagggacactgtgtgagcccccagcagtacctagcaggtccctgtctaccctgccctcctccccattcacttgcccagtggtggcctcactgcccctctaccccatagcgagaccctgcccgtggagtacctgggggggaagccactgtgcatgaaccagtactatcagatcttgtcctcctgccgagtgccgggccccaagcaggacacagtcagcaacttcagcaagaccaagaagcctcccacgcacatcaccgtggtacacaactaccaggtgggtggcccccacccacacctacaagccccggccctgctgcaggagtacagccggacggccgcagtcggcttccccactggggttccccagcacacgtgcccacgtgccccaggaatgggcgcccctggcttctccattgggggcccagggaggccaggaggggccgtgggcctgcccagcccagaagggtgatccaaggacctcctccccctctcacccttggcctgactccatcccctccaaggccaaggccaggaggaggcaggtgtggggaggtggctgctctcagcctgaggtccccactcagctccctcctcttacctgcctgtgccccaacagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaaggtgcctcttgggggccgtgctggggctgcacacccaggcctcttcccctgttggggaccagcctcaactccacctgtagggtacccgaagtctgctggcaacaaaggaatgagaagagacaggttaagagttcatgaaggtgggagccaggggccagttgcaaaatggaggctgcaaaaggcgcagagttctggtctccacactattgagtgcagtcacttagctctaagaagcacatgttcagggcgaaacagtgaaagggaggcagtgcctcataggaggcataatctatagcaatagcagtttaaatgaatctcctttgtgctcaaacagcgtgtctttaacttatcggagagtagctggtgggagcgggcttaactaggagcctgcacatctgtccacttcccagtgtttcaaaggagtgtctttctccttgaacacagtgtttacagataggagagcgggtctcgctctgagcatgggaacatgatggcaattagtaggctttcctcctccgtggcctcttctggctttccacaacttattgtcccctatttttatggccagtttatacaggcaccccacaagcccttttcccaacattcccccggcatgctgggccccgcacagccatgggcagacatgtttcccgctgcatcctctcaacgtggagcaggcaatgtgggccccatgtcctagttgaggacacctcatggttagggtagtttctctcagctaaatagcaagttaggattagagtccaagtcctctggctgagaagcccacccgcctccacaccccctgtgcccccaagtaccagcagtcctccaaagcatgtcttgctcaggggcattgaccccaaagtcagaccacctgtgtgggttccccggctgccacaccagctcccatgtgacccctgggcttcggtttcctgtgtctaaagtgggccaggtgttgggccctgcctcgaggagtgctgtgggcctgcagggtcctgttgagttcgaagctctgaacccacaccctgcacttggtgaatgccctggagggccggcgaggtggggggtctcctcatcccagagaggtacaaatgggtcagaagagcccagggcaggaggctgcggaggggctggtccatctctcccacaccatgagaccccattttgcgtctccccgccccatgccacctgcagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggttcgacaagacgctgcaggtgaggcccggcagggcttcgcccactcacacacacctgaacaggacctctgcagcctcgggacttcctgcccgtccccggctgcgtccccagcctcctagcttgtaaagcaggcaggaagccagcaggctggacgctgccgtaattaccaggcagccagcctgtcatcaccagtcctgcctctggcctggaaaccgctgtcacccccagcacaccccctcagcacctcacagagaacctgggatccggggtcaccagtgcaatcctggcacaacagtccctctccacacctgtaaaatggggtgatggtcaacctcaccggtagagtagtttgaaggactcagtcaggcacgctgagcgtgggatgtgcttagcacaccagggcacctggtgagtgtcagctattgttaataacagtaataagtcatcatagccccttgagatggcttcagagaggcccttgcctcaaccaaagagtggttgggtgaggggccaccccccagggccctggggctgaccggggtctcccttcccttccacagttcatcgtggcagaagatggctcctgtgggcttgtgtacgagcatgctgcagcggaggggccccctattgtcacccttctggactatgtcatcgagtacacgtgagtacagtcacatctctcgcctagttccccagcttctagtgacaggtgacacacaggtgatagaccagtttatagagaaatatcactctcctttgtgcctgggaatctgtttttttccaaggaagccagccagatatggtggctcacgcctgtaatcctgacactttgggaggctgaggtgggaggatcaattgaggtcaggagtttgagatcagcctggccaacatggtgaaatgccatctctactaaaaatacaaaaaaaaaaaaattagccaggtgtggtatcacatgcctataatcccagttactcaggaggctgaggcaggagaattgcttgaacccaggaggcagaggttgcgttgagcggagactgtgccactgcactccagcctgggtgacagagcaagactctgtctcaaaaaaaaaaaaaaaattaggccaggtgcagtggctcatgcctgtaatcccagcactttgggaggcggatcacctgaggtcaggagttcaagaccagcctggccaacatggtgaaaccctgtctctacaaaaattagccaggcatgatggcgggtgcctgtaatcccagctacttgggaggctgaggcaggagaatcgcttgaacctgggaggcagaggttgcagtgagctgagatcacaccattgcactctagcctgggcgacagaatgagactctgtttcaaaaaaaaaaaaaaaaaagttagccacgcgtggtggtgggtgcctgtaatcccagctactcaagaggctaaggcacaagaatcacttgaacccaggaggtggaggttgcagtgagccgagatcgttccattgctccagcctgggtgacagagcaagactctgtctcaaaagaaaaagaaaaaaattagccaaggtggcgggcatctgtaatcccagctactcaggaggctgaggcaggagaatcgcttgaaccagggaggccaaggttgcagtgagctgagatcgcatcactgcactccagcctgggcaacagagcaagactccatctaaaaaaaaaaaaaagaaaaaagaaaaaaaagctgaagtgagggtggttttcagaacaaactcacacctccctgggctggccccctccagcttcaggtacccatcctccccaccctggtcccagaatggacccaggctctagaggcaccagcatgagcctgaggccccgtttactgtgcaggaagaaacccgagcttgtgcggtctcccatggtgcccctgcccatgcccaagaagctgcggttcaacatcacccccgagatcaagagcgacatcgagaaggccaagcagaacctcagcatgtaagtgcctgcccccgccatccctgtgctggatgggtgaggccaggcccttgagcttgagaggctcctgtgccagctctgtcatgacacccagaccctccgtggggttggcaggggctgccggggcctgctcctcacctgctcttcccacacccccagcatgatccaggacctggatatcaccgtgatggtgttccaccattttggaaaagacttccccaagtcggagaagctaagcccagatgccttcatccagatggctttgcagctggcctactacaggtgcgcctctgtggcccacccatggaggagggaggagacctgggggcaggggagggggtgcccgcctccaaggggcgtgcttagccccatttcccaccaggatctacggacaggcatgtgccacctatgaaagtgcctccctgcgcatgtttcacctgggccgcaccgacaccatccgctcggcttccatggactcactcacctttgtcaaggccatggatgactccagcgtcacggtgagaggtctggggcgagggtgggtgagctgggcctgagcccctccctcctgctcactcagtcaacacacaataattgagcacctacaggattccagccccatggtgggcacggggaatctaacagaagctggagccgtgaatctagctctgagcttcctggggaccaaagaggaaaagggagtcattcatttgttcattcatttattcattggcagtaagcaactgccctatgtcaggccctggctgaggaccaaggagttggtagttgcaatactcgctctttttttttcttgtttttttttagaaagagtctcactctgttgcccaggctggagtgcagtggtgtgatctcgactcactgcaacctccacctcccgggttcaagcaatcctcctgcctcagcctcccaagtagctgggactacaggtgcctgccaccatgcccggctaatttttgtatttttagtagaaacgggatttcaccatgttggccaggctggtctcaaactcctgacctcaagggatccacctgcctcggcctcccaaagtgctgggattacaggcgtgagccaccgctcccagccccaatatttcctcttaaagagctcagaatctagtgctgggtgggggtgggctactgaggtgggccagaagagaagggacagtgcttcagctccctctgaccctcaccactctaggagcaccagaaggtggagctgctgcggaaggccgtgcaggcccaccgaggctacaccgaccgggtaagtgagcccgcttgtgcctactcacttgtcccttagtgtcagccatctgtctgtccctctgactgtccgtccctgcagccaatggctgccaaccctttgctaggaccacatctcccccaacctgggagcacctggagccaggctgaatagcccccaactttttctttttttttttttttgagatggagtcttgctctgtcgcccaggctggagtgcagtggtgtgatttaggctcactgcaacctccgcctcccaggttcaagcaattctcctgcctcagcctcccaagtagctgggattacaggcacccaccaccacacctggctaatttttccatttttagtagaaacagggtttcaccatgttgacaggctggtctcaaactcctgacctcaggtgatccacccacctcaggctcccaaagtgctgggattataggcgtgagccaccgtgcccggccaaatatccccattttaaagttggagaaacccagcctgggcccagtaactgccttggttccaggttccagggctggcctgggccctagatgttgggtcacactctctccctgatgctaggtatctctccctgacgctaggtatacatggtccagcagacagccagtttcctgccctccagcagcttgggctgcagtcagggaggtggctgtctggatgcgtgtcctggctctgtctctgagcacctgtgtgtccaggctctgaccgtgctacatgcacacgtccatttagagctcaccgccaccctgcgaggggagtgtaggactcacccctctttacagatgaagacactacagttccagaacctaagcaacctgccaaggccctgcagccaggatggggctaggtcacccagctccagggccctgccctacaaccctgcactttcctgcctccctgggcaaatccccgcccctccctgagccttggtttccccatctgtgaaacgaaggctctctctggccagaatactctggtcttgtggttttgagtggccagtgcctgcgaagggtggcgctgccacaggctgaagagggcagggataccccgggggtccacagcccctgctcctgacagctctcccaccccaacaggccatccgcggggaggcctttgatcgacacctgctgggcctgaagctgcaggccatcgaggacctggtgagcatgcccgacatcttcatggacacctcctacgccatcgccatgcacttccacctctccaccagccaggtgggccactgccccaggtgccccgggggctggaggcagagaacccactggtagtttgatgtggcctacacaggccccactgacccattgccaacacagctgagttccagaggaggagctgggggcaggggcctctctgcagcccaggcaggctgagaaggggtcagtgctcctcatgggagaatcagcttcgctgactcactggtcaggtataaaggaacatttgattcgtgccagcctgtagtggttgctgggatatagcaggggacagaccatgatccctgcccacaaggggcctgcagtcttggcggaagcacaggcagcctgggaagtgctgggggcgtcaaggtaggggagctgagagctttcatcctgccgtccccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctaggatgggccacccaccagggctcagctccttggttccctcttccttggttccctcttccctggtccccccaaatctactgagccacggaccgcatcctccagggggcctgcaggccccagccaagtgccttccgtgggtcatcccagcacctgccagggcccgacctggggctgagtgcagaggctgagcaggacgttaggcccgggcccctggcacgtcctccaccggtgcctcctctggggaagggaaccagccctccagagcaggagactggcaagagctctttgtctcaccagctcagccccggccactccctgccaactccatgaccaggccaccatctgtaccctgcttcccaaactcccaggacctggagacaggattgtctggggccgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggggaattgtgttggtgaagaggtgtttcagctgagaggcaggcagggtgggggcaggcacctggccttgccctcttcagctttccctgggcctcggagctggtgtccaagcagccggtgggcctgagggctttggcccaggagccaaggtccagctgtgaccttggggcactgggcccagaaccataccagagccagggctgcgtccttcaccagcagcttcccacctgcctctggcttgggccttcccaagtcccatgggttgtgggtaggggcaactctcccaggggactgtggggcccagcaggcccaggtctggtgggctgatgaatgttgctaatacccaggggcccagggtgtcattctacttcccccaactgagcccagcaaaagtaggagtacagcagcaggctcagcttgccccaggcccagccgctgccaggacagacaccttcgggggtgggcaggtgcgatcagagcagaaccacatacctgcccatagccccgtgtccatggctgaggcagggcatcctggcaaaaccaagcgtgcagtttgtggagaggggagagtctcccattaggacactggcctgtgaggaaggcctgtgtgaaaccacaagggcggatgccggggtgggctgggggaggttggctggcctgtgagtgaagggctctgtgacctgactaagctgggacagtcatccgagagtggggcctttggttttctccgtttgtcagatgaggaagcaggcttagcgaggttaaggtcaccgggacgctaaatggcagagcaggattcacagaggccacacttgtctcctctaggccggggctccaagaagcccctccctagagccaggtccccagccccaggccacatccacctaggtgtcccgcagcagggggtggagaaagggatgctatgggtggaaaccggcccagcctcaggaccacaaggaagcgggtaaagagggaggctgggctgagcctgagctctaatcaggcgcagggacctgccaggcctgaccattggtggtgtactcagcaggagagggcagccacttgcccagtgccccaagggcacaggaggtgtagcccagacaatggaggaaatggatggaggcagagaaagggatgcctctggggggaacacgcaggcctggaagagaatgtcacctggaccagcacccggactctgctcctcgctacacaacagggtgctccctctgggggtgactagaaccgctaggaaacagggtacacagcagggcagagtgctgcatgagcagccaggagtgggcctgcagccagcccaggcaggacagggaggggagagcgaacagtcaagaggctgccagacagacaccctggattcccaaaactcgcctaagaaccctacaggtctgaatataaggttggattttttttcccccagaattatccttctgaattgaggggcatccccttagggtggtggcattacaggccccatcacatggaagccccctcaattccttggagccaccaagtattgttcagggagggcgcattcagcatctgagcaacctcagtcatggtgagagggaatccctagaggtcctttgtgggggaaaaaggcaaagaaacaagatttcgccgttcttccttaggggtaattcctgagacctcacactctcaagtgttggatgtcgggataaaccagcgcttaacgttgtgccagggggcacttgtggcttggaatgaaatttctagagctagtgctgtgcatgaaatcctacaggcgctgcttaaaggctagcatagccaagacagcggccccaggagagcaggctcagctgacccagagggggctccaggggtgaccaaactctggcgccagtgatgcagacgaaaaacgtgattcgtttttgcaaaatgagtgaaaaaaagctgttctgaattggtatatcttgagcaatgcatcatttgacatttgaatgagtaataaatttttttttttttgag

SEQ ID NO: 15663 - DNA, 19719 bp, Human; identical to SEQ ID NO: 15662

SEQ ID NO: 15664 - DNA, 15165 bp, Human
tctcggctcactgcaacctccacctcccaagttcaaggaattctcctgtttcagcctcccatgtagctgagactacaggcacacgcaaccatgcctagctaatttttttgtattttcagtagagatggggtttcaccatattggtcaggctggtcccaaactcctgacctcaggtgatgcacctgcctcagcctcccaaaatgctggattacaggcatgagccaccatgcccagccagtttctaatgccattttacaatgaaaggaatcagggttcctcgtagaaaataggattctaggactggggcaggaaatacaagatgagcccggagtatcctgtagtgtcagaaaggaaagaggcactcaaacccaaataagctggtatatacactgggtgtatgtcaaaggagcacaaggaaccactcaaattcccagtggccaaaatgagaacaatttgaaaaaaaaattagtactgtagtataacaaaggataaaataacaatggtccacactgatataaatgattgaatacatgggggagaagaaacaaatctcccatgcagaattccaaataatttctgtagatactctgcccccaaggaggtggagcaaaatccccgactccttacgtgtgggctgtgcatggggacgtccttccaaagagtacagtagagaaaagaggggtggggggacctgacaaacactacttcagtcaagtgatcaagtcagcaccaacagtggtaagtaacgttgaacagtaagaacccttccttggtaggatgtgatgagcatagcactttacctctgtgatcttccttccaaaacgccataacgcttgtctaatcctgagaaaaacatcaaatcccaatagagggccagcccaccaaagatttggccagtactcctcaaaactatcaaggtcatcaaaaataaaaagctgaggccaggcgcggtggctcacgcctgtaatcccagcactttgggaggctgagacgggcagatcatgaggtcagatcaagaccatcctggccaacatggtgaaaccccgtctctaccaaaaatacaaaaattagccgggcatggtggtgtgtgcctgtaatcccagctgctcaggaggctgagacaggagaatcgcttgaacctgggaggcagaggttgcagtgagctgagatcatgccactgcactccagctaaaataaaaataaaaggctgagacactgtcattaacagtagtctaagacatgacaacgaaatataatgtggtatcctgaatggaaacctgcagcagaaaaaggcattaagtaaaaggaaggaaatctgaataaactacactttagttaatatgacaacagtgcatcgttaattttaacaaatgtagcacactaataatgtaagattttagtaataggggaaattgcagggatgggtggcacatgggaactctctactatgttctcaatttttctgtaaatctgttctaaaaaataacgtccgttattattattattattattattattatttgcggggaggggacacagtcttgctctgtctcccaggctggagtgcagtggtgagatctcggctcactgcaatctccgcctcctgggttcaagcgattctcatgtgtcagcctccccagtagctagggctacaggtgcctaccaccacacccggctaattttatatttttagtagagacgtggtttcaccatgttggtcaggctggtctcgaactcctgacctcaggtgatccgcccgcctcagcctcccaaagggctgggattacaggcaggagccaccatgcctggcaaaaataacgtccataaacaaaaacacgtggccaacaggggcggagcagaaccgagtttccggaagcaaaacagggctttgtaccgaacaaagatggcggccgccggcgtcgggaggagggctgccctaaagaaagatggcctccgcgagaggaggaaccggaagcgtgggtctggcggctgcaccggttcgcggtcggcgcgagaacaagcagggtggcgcgggtccgggcatgaagctgggccgggccgtgctgggcctgctgctgctggcgccgtccgtggtgcaggcggtggagcccatcagcctgggactggccctggccggcgtcctcaccggctacatctacccgcgtctctactgcctcttcgccgagtgctgcgggcagaagcggagccttagccgggagggtaggctggggcgggggctggaggctggggctggggctggggctgggcgatggcactagggctgaactaggaccagggcatggagaatggaggatggaggccgggggatggcaccagggccgggctaggactagggctggagcggggcctgggggctggggctgggcgatggcactagggccgggttggggctggggctgggggatggagcggggcccgggggctgggggtggggctgggggatcgcactagggctgggttaagaccagggcggttggctggggctaggggattgaggatggtggatggaggctgggggatggcagtagggccgggctaggactggggctggagcggagtttgggggctggggctcaggagcgggggctggggctggggctggggctgggggatggcactagggccaggccggggtaggggtcacatcccaggagggccgggcctgggcagagctgagtccgcgggggccggaccccggaagccaagcggccggcctgcaggatgaggcctggctcctcggccatgaccacagacgtgccagacttaagtcggagacctgaggagccaggctgcaggttggcctactttgcgctaagctgggggtggaccagtggtaacctccctccgaagtgggttctgcctcctttctagcctagcgggagacaggaaggatggtgaggactcttccgcagccgaccaggagggaccaaactgtttcctttcccggctctgccttggggtgggaggagcagcacaggggttaggggtgcaaactggtggcagtggcagtggcaccaaggggcttttcgggaaggagtcgggccagggctttagaataggcaggaccagcaaagggagggctccctggaccgccgtcccctctgggccaggagcttacagaccgcagtacttgaggtttcgcaaggtgcttggagggcgtctagacggctttgctggctttcttatgggctgtaaatgtggctacattttgccgctgtttcttccccactcctgattggctttgtctttcccagcactgcagaaggatctggacgacaacctctttggacagcatcttgcaaagaaaatcatcttaaatgccgtgtttggtttcataaacaacccaaagcccaagaaacctctcacgctctccctgcacgggtggacaggcaccggcaaaaatttcgtcagcaagatcatcgcagagaatatttacgagggtggtctgaacagtgactatgtccacctgtttgtggccacattgcactttccacatgcttcaaacatcaccttgtacaaggcaaggatggaagtttggaatcccttcctggatgtcatcgggtttggggtctctttgttgtgggatgagatttgggagttctatgttgaaatgagtgagcccggaaaacggttcatgtctcagttccccttggaaaggtgtagaagttaagagtttgagatgcgtggagcagttaataccatcaaagctttgtggtgggttctgaaaatcggtccagtgagtatgtagggtcatgggattttagaggtggacatgatcaaatccatcttagagatcaacacatctcactcatttttttatttttttctttattttgagacggagtttcactcttcttacccgggctggagtgcaatggcatgatctcagctcactgcaacctctgcctcccggttgaagcaattatcctgcctcagcctcccgggtagctgggattacagggtcctgccaccatgcccagctaatttttgtatttttagtagagatggggttttgccaacttggccaggctggtctcgaactcctgatctcaggtgatgtgcctgcctcagcttcccgaagtgctgggattacaggcgtgagccaccatgcctggccacatctcactcattttgtgaaagaggaaacatgtagagtcctaagtttgttgaacctactgttgtaaactgcctttttttttttttctttgagtcagggtctcactctgttgtccaggctggagtgcagtgacgccatctcagctcactacagcctccaccttcccggttcaagcgattctcctgcctcagcctcccaagtagctgtgactacaggcatgtgccaccacagccggctaatttttgtatttctagtagagatggggtttcctcacattggccaggctggtctcgaactcctgacctcaagtgatctgcctacctcagcctcccagagtgctaggattacaggcgtgagccaccttgcccagccgcaaacagcttttatggttgaactcactgatgagcagcttgggctttggcagcagacacatctggatttgagtcctaacactctcccagctccgtagtcttaggaaagttgcctgacctgagactcagattctgacttacaaagtgttgcttgtaacaatccagggagctctgtctgtcaagtgcataacatgtacctggtgcatgttacaaataaatgttaactgttgccttttagatccttgtagcagacctgcaagatgggcaaaacagtcaattatttatttatttatttttgagactgagtttcattcttgtcacccaggctggagtgcagtagcaccatctggatcttgatctcggctcaccgcaaactctgcctcccggattcaagtgattctgctgcctcagcctcccaagtagctggtattacaggcacctgccaccacacccagctaatttttgtatttttaatagagacagggtttcaccttgttggccaggctggtctcaaactcctgacctcaaggtcatccagctgtctctacttcccaaagtgctgaaattacaggtatgagccaccatgcctggcctcaatcagttatttatccctgactgtatctatggaaaaatgtgaacacatttttcccttctgtctgggtgagcgtgtgggtcacccactgtccagcggttctgtactaaaatgcgaatgttccacgggtgtggtggctcatgcctataattctagcactacgggaagccaaaaccggctgatcccttgagctcaagagttccagaccagcctggggaacatggtgaaaccccatctctactaaaaaaatacaaaaaaattagtcaggcatggtggcatgcacctgtagtcccagctacttagggggctgaggcagaaggatggcttgaacctgggaggtcgaggctgcagtgagcagacagccactgcagtccagcctgggtgacggagtgagaccctgtcccaaacaaacaagaaccattctagacgaatcaggataagttgatcatcttagaattgaggcttcactaacaataactgtgactttgggcaaagttacttcacttgtctgtgcctcagttttctcatttgtaaaagaaggagcacaatggtaactaccgtgatgggttttgggaggtcacagtaaaatgttctatgaacagaccaggtgtggtggctcgcgcctgtaatcccagcactttgggaggccgaagcgggtggatcacaaggtcaagagttcaagaccagcctggccaagatggtgaaaccccatctctactaaaaatacaaaaattagctgggcgtggtggcaggtgcctgtagtctcagctactcagggggctgaggcaagggaatcgcttgaatctgggaggcagaggttgcagtgagctgagatcatgtcattgcactccagtctgggtaacagagcgagactgtcaaaaaaaaaaagttatatgaacagtgcttagaatattgttgttcccatagtgaacactcagtgcatgttccctgttattgcatataagtttggtcaccagagtgagaaaccttggctgctggagcctaacaggtctgagtgaatccttgtttattttatttatttattttattttattttatttatttattattattattattttttttttttgagacggagtcttgctctgtctcccaggctggagtgctggagtgcagtggggtgatcttagctcactgcaacctccacctcccaggttccagcgattctcaagcctcagcctcccaagtacctgggattacaggcgcctgccactatgcctggctaatttttgtatttttttttttaatggagtcttgctctgtcgccacgctggagtgcaatggcttgatcttggctcaccgcaacctccgcctcccaggttcatgcaattctacctcagcctcctgagtagctgggactataagcacctgccaccatacccagctaatttttttgtattttttttagtagagaccaggtttcaccatgttggccaggctggtcttgaactcctgacctcaggtgatccacccactttggcctcccaaagtgctgggattacaggcatgaaccaccatgcctggccctaatttttgtattttaatagagatggggtttcaccatgttggccaggctggtctcaaacccctgacctcaacttatccgtctgcctcagcctcccaaagtgctgggattacaggtgtgagccaccatgcccgaccccaccccctttttaaataaaaatcagtatcctcatgacatcccacattgcccctttgatgacaaaagagcagcatctctgacagcatccgtgtggcatctcgcagtgcgggaaccgtaaccaaagtatcgggctttggagtgagacaggactgggttcaggtcccagctctgccacatatagtcttgggcaagtggagtaagcgctctctgtgcctcagttccctcatctgtaaaatgagaacgatagtgcccactccatggggttggtaggaacaaagaagattttgggcatgtaaagttcttagtgccgagtgcacagtggtctgtaagtgaagctgcggttcttagtggtagaaggagctgattgatggccctggctgagaactttgtgttcgctttttccccttttaattcaggatcagttacagttgtggattcgaggcaacgtgagtgcctgtgcgaggtccatcttcatatttgatgaaatggataagatgcatgcaggcctcatagatgccatcaagcctttcctcgactattatgacctggtggatggggtctcctaccagaaagccatgttcatatttctcaggtaaggtcagggctaggacatgatggatgggccccgagcccaagcctctgagctccaggagaaaaccctgtccttacccactgggattgttttgcagcaatgctggagcagaaaggatcacagatgtggctttggatttctggaggagtggaaagcagagggaagacatcaagctcaaagacattgaacacgcgttgtctgtgtcggttttcaataacaagaacagtgagtagggccatccaccgccagtcccatctggttcctaatcctgcaccctaagtgttaaaagcatcagggtcactgtcagcatcacctgggagctgggtagaaagaaatgcagattctcagtccccttccgagtcatgaggggaatctttgctgatgaactccaggtaacttttatgaacactaatgtttgacaagtgctgttttatttttatttttcagatagttttactctgtcacctaggctggagtgcagtggcgtaaccttgcctcactgcaacctctgcctcccgggctcaagcgattcttgtgcctcagcctcctgagtagctgggattacaggtgcacaccatgcccagctaatatttgtatttttagtagagatggggttttgtcatgttggccaggctggtcttgaactcttacctcaggtgatccgcccacctcggcctcccaaagtgctgggattacaggcgtgagccactgtgctcagcttattttttgagacagagtctcactctgtcacccaggctggagtccagtggtgtgatctcagctcactggagtcttgacttcctaggctcaagtgatcctccagcctcagcttcccatgtaggtggaaccacaggcttgcgccaccatgcctggctaatttttttttttttttttggtagagactgggtcttcctatgtttcccaggctggtcttgacttcctggacttaagtcatcctcccgcctcagcctcccaaagtgctggaattataggcatgagctacatacctggcctgctgtttttttttttttttgagatggagtctcgctctgttgcccaggctggagtgcagtggcgcgatctcggctcactgcaagctctgcctcccaggttcacaccattctcctgcctcagcctgccgagtagctgggactacaggcacctgccaccacactcggcaaattttttgtatttttagtagaaacggggtttcaccatgttagccaggatggtcttatctcctgacctcgtgatccgcctgcctcggcctcccaaagtgctgggattacaggcgtgagccaccacgcctggccagttcccccattttcttcagctacatgattttctttgtagaagaaagagccagtggttgagcaaggaaggatgccgtgggcagctcagggggagagatgacctgttagttcctccctttctctgcattgcccaagagcaacagccaaatagcggttcggcccttattttgtactgggcaccgtgtgaaacagcctgcctgcggatttcactcagtcttcaccatacctcgcagggtagagactgagactcagagatgtggcagcttgcccagggccatgcagcctgttcggtatctctgattctaaaacctgagcttttaagttttagctcactacttctccaaatgtcatgagacctttgaccttgaacctggggaggtggaaagccagcctgatggaggctgactcactggctaagacctgtgagttgtgcagggctggctgttcaagtctttgcgcttcaggttctggagatgacaaaacagaagggctcatttgaaacagacttgccaagaaattaatcctacagttagtgaacagcatggggtacagtatgtcagtgtgtgcaagtggaatactactgaggaaagacaagtattttgtaacatgttggatagtttcttgccttgccaaaaaacatgagcacatgcagtggaaactttagcctaatgctgaggcagatgagccccgtggcctagaatccacgctgtggaggttacacggtgcttaggagtgccaacctgggagtcgggcagccctggcccacagactgactgtgacctcaggcagatggctgaacattgattcagcacatgtatatggagcatctggtaagtgccaggcatcatacctaggacgggggacacagcagtgaacaaacacagaaattcttgcccttatcaatcctacatcctagtgataataaagaaagaaaatgtatcagatgatgggggatagatatgttgatgtgtgtgatgtgtttgtgtgtatacatgcagtacatatgcacacatcgcacatgtacacatgtggacatatagatatctttccccccggggccagtaggggaaaaaaatcaagaaaggctttggggttcagggtaaggatgggctctgctttaatagagtggacagggaaggctccctgtgagggtggcatttgggctgacccgagggagtgagccatgtggatgtctgagggaaaagcattccccagtgcggacagcacgtccaggggcccgaggggggcctgtgcttggggtccctgtgactggttgaggataaacagaggagggaaacgggaggtgatagaagaggcgagatttggggtggaggtgcagaccgtgggaagcctggcgggccatggtgaaccttgagtcttattccaagtggaagagagaggcctggagggtcccgggcaggtggtgctgtgatctgacggggccttcacaggaccttgctggcaactgggtggaggacagacccacagccacaggggcagggagcccagcgtggaagcggtgggggtggagggacacggttggcttctgggtgtgttttgaaggtagaacctgtaagacttcctgcagaattgtatatgggaatgagagaagaatcaaggacctggcttgagcgatgggaagggtggcactgccattgaagggaagggacagcaggaaggacgggcgagctcagtgggcaatggcatcagggcatcagagcagagccacgaagctccagggaggccatcaggccaggagggcaaacttgggagtcctcaggagatgactgtgaagtctcagggctgcctgaggtcacctgttctgccgtcactcctgggtctgcgtggctgggtccttgttgctcgggctctgccctgaggtcctgcccagcctgctccacctcccgctctccatgtccgttctgctgtgtggcattcgccactccaagcaccatctgagattgtttcctgccctagagtggtaaagccgtgaggtccgtctgccctcagctgtgtccccaggcccagggcgtgcctggcacagagcaggcctctgagaaccagcctcccacgtgagttcatgatagcaagacagcccctcgttcccattcagtggttggttctgttctttccctggccataggctccactctgtcagtcagccacacatttattgagtaccagttgtgtgcaaagcactgttgggcatgaaaagcattaacccagtgaatgaggaggagcttgggttggggacggagccccagaattacatggcagaccagaagggaatcagctcagtagaagacacgcatgggctcgtgggcgacgcagtgtgtgctgtgtcatctggggctgggaggaagtgtcctgggtcaggagttccaggagcccaggaggagtggacgggtcagtgcagagccagcccgcattcaggggagaaaacacggccaaggccaggccttcacggggagcccagcgtgggctgcacatctgcactctccaggctagttttggtgcccacatgctctgcagggtctgggcactgtggcagcggcagcaggcttccctgttgctagtccagctgctgaaactccagggagagtcaaaaagttcccaaatacagaggcgtggctggtagtccttcccgggaattcttcttgcttcccgctttctgtggaactctgccttccccactctgcctctctgcttgttcctgggccccaggacctctttcccatcttcgatctcttaagtcataccttgggaggcctcccccagcccgccgtgtaaagagggctgtcacagcttctgctgtcacagaagcattacaatgtgcaggtgcctgttaacatctgccttccccactgatctggagctccacaagggagagggcacacccagtaggtatgtgtgggatggataggagggtggatgacacccagtagatgtgtatgggatggataggagggtggatgacacccagtaggtgtgtatgggatggatgggagggtgggtgacccctagtagatgtgtggggggtgggtgggtgacccccagtaggtgtgtgtggcatggataggtgacccccagtagacgtttgtgggacggatgggagggtaggtaagtgacccccaggaggcgtctatagggcaggtgggtggatgtggatgaacagcaccttgtttcttcttcccaggtggcttctggcacagcagcttaattgaccggaacctcattgattattttgttcccttcctccccctggaatacaaacacctaaaaatgtgtatccgagtggaaatgcagtcccgaggctatgaaattgatgaagacattgtaagcagagtggctgaggagatgacatttttccccaaagaggagagagttttctcagataaaggctgcaaaacggtgttcaccaagttagattattactacgatgattgacagtcatgattggcagccggagtcactgcctggagttggaaaagaaacaacactcagtccttccacacttccacccccagctcctttccctggaagaggaatccagtgaatgttcctgtttgatgtgacaggaattctccctggcattgtttccaccccctggtgcctgcaggccacccagggaccacgggcgaggacgtgaagcctcccgaacacgcacagaaggaaggagccagctcccagcccactcatcgcagggctcatgattttttacaaattatgttttaattccaagtgtttctgtttcaaggaaggatgaataagttttattgaaaatgtggtaactttatttaaaatgatttttaacattatgagagactgctcagattctaagttgttggccttgtgtgtgtgtttttttttaagttctcatcattattacatagactgtgatgtatctttactggaaatgagcccaagcacacatgcatggcatttgttccacaggagggcatccctggggatgtggctggagcatgagccagctctgtcccaggatggtcccagcggatgctgccaggggcagtgaagtgtttaggtgaaggacaagtaggtaagaggacgccttcaggcaccacagataagcctgaaacagcctctccaagggttttcaccttagcaacaatgggagctgtgggagtgattttggccacactgtcaacatttgttagaaccagtcttttgaaagaaaagtatttccaacttgtcacttgccagtcactccgttttgcaaaaggtggcccttcactgtccattccaaatacccacacgtgctctctgctggattctaaattatgtgaattttgccatattaaatcttcctcatttatactattatttgttacgttcaatcagaatccccgaaacctcctataaagcttagctgccccttctgaggatgctgagaacggtgtctttctttataaatgcaaatggctaccgttttacaataaaattttgcatgtgccattggtgagtacgtttttgaagagggagaagcgcccctccactgtagaccttatgaggtaaggctgcgagtgaagacctagcagaacaatccaggttggaaagaaacgaagtctcacacagggatctgaggatcctaggatggctctgtcccctcgcccagtggtctgggaagtcgccctccattgtggggttcttggagctcctgacacccagccacggagttcaagtacagctgagatgccagcaggaacagtgccgtagactaaggtaagcacaccttattttatccaacatgcctgtgtcccagcacgtgggcagtgctcccatgggtgcggctgctgcagagagcactgcagggaccacttctagtaggcacagaagacgagtttgtggcctcgactgcaggtctaacgcaggaaccctctgccttatggcttcccagcctgcatggggtccccctagggcagcccagggcacctaaagatggctccaagcgttagaaagttcttggtattgagctgcagccagcctgctatgtccctgggagtcacagattaggtctaatcattcctttgaagagtgtggcccaggcaccagaagtccctagttagagaacacgggtcccctgacagttttggaaggttcagtcttagtagatgaggcagtgtaggtagaataggaactgcgttaagactgagaaccagacctagaaagtcagtctcctgggaattgagtaacttcagctgagaaaataagggagtgggtggggtgatggtgatgagggtttgtgctttctagtaaatctgctaatccttaatcctgtgaagagggtgggtgttagcaattcactgatgagacaatactggattatgtgtaattaagctgagatcagattagcataactagaattttttttgagacggagtttcactcttactgtccaggctggagtgcaatggcacgatcgcggctcactataacctctgcctcccaggttcaagcgattctcctgcctcagcctccctagtagctgggattacaggcatgtgccaccacacccagctaattttgtatttttagtagagatggggtttctccatgttggtcaggctggtctcaaactccccacctcaggtgacccacccacctcggcctcccaaagtgctggaattacaggtgtgagccaccgcacccggccaggatttatttaccagtttcaatggttaggtttcctcacctgagctcaggttcaggctgtcagaggtgagttttactttaccagtacctcaatttcctcccacgttaattttgggagaaagtccatctctttgatgaaatatccatcagctaatttaacttctatttgtctggggaagagcctttaaggtaaatattgcttctgtatcgcgctgactgcccacccgcctgtcccggatatggtgagtctcacagctgtgctgctgaaattcattctgaactttggaaccaaataaactagaaaaagttagcaagtggcatttcacatgataaaatctagaatttactattttatagtcagtaggtcaataaagctctcgtccacatcttataagggaggtgggggaggcggggtcatgatcaaccatagccttttcaagttacaaatcagtaacggcagtccaaaggtggcaaacatatttattgcctcactgtaaatagagaaaatcttgtcttctctcgaccagatgcccaaaaggttataaaagaagtataacttagctccaatttgaggatatgtactaaaaattttaaacgtcaccttggtgtttttttcaagactaagtgtgataccacgtaaggcatttccatgtcataaattaattctaccatatttttatgtaaaaaatgctgcacgttgttgtgtctgcagctgtgctgtgattatgagacagatacaatgattcacactggctggaagctaagtctcacgtcccagggatcagggcagtccagcccggtg

SEQ ID NO: 15665 - DNA, 60785 bp, Human; identical to SEQ ID NO: 12774
  misc_feature (1)...(60785): n = A,T,C or G

SEQ ID NO: 15666 - DNA, 41593 bp, Human
  misc_feature (1)...(41593): n = A,T,C or G
cactcattttttcctgagctgtggctcattcagctagggtccaagagcggaggacttttggtatgaaaaataaaccaaaggacactgggattgggctggatttgaatgagcaggtccaggggactctgggcaagtccctccttgcctcagtttccctgcaggaaggtaaccagtccagtcggatggtcctggaggatgatctagaggctgtttgtgggatggatgcagcttgggagacagtgacaagggtgcggtggaggctcagggtgttgcaacacctaaaagagcctctaggcctgagcctggatgcaccctccgccctctggccccgtagtgtgtgtctgagacagagtgagacaccagcaacatatgcttggatcagggacggaagggactgaaattaggctagcatccgggctgctcaccggggaggactgaggggtagatatagccagggtggggaagggggctagaggggaggatatagccagggtggggaagggggctggagggaaggatacagccagggtggggaagggggctggaggggagggagaccatggggctgccacctgccagttctgaggcctttctagcttgatgcctccgcgtgtttctctggccacacacaattccccagggaccgtctgataaaccaaaggagtgtgaccaactggacagggtcggaggagtggctctggcctaagcgtgcgacgggtgtgtcaatcggagaataactgggagagtgagctagggtctggatgctcctggtctctctcccctaccggcctgtctctgggtctaagggtgggggtgctaactgaagccggggtcccccttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtccgcgccgccgccgccgcggctggggtcggtgggtccttgctagagccttcgggccaaggtcgctgagttacagccgccagccggtagaggcagccccgcgcccaccctctgggccgagcgggctgcgggcaggcacccggggaggaggactcgcgaggcggggcctgggccggtagcgggccccgggcgggcaacggtgcccgggaggttggctgtggggcgggggcggggcatcgatggggcggagtctccttgaggagggacaggaggggcggggacggaggggcggggcgtcgcccggtagcgggtcgcagtaggctggctgcgagtcgggggcgggaccacggcgggcggggacagaggggcagggccgagggcgagtcattgagacctgtggaggaggaaggaggaggtcaccgtccagctgtctctcccctgtccccacatgtcttctaagctgttggaggtagtggtgtgcacctttccaactccgtctggtgtccttgagcctaactcttagagtgataggaaaacacaaccatgttgaccggggaatgtcctctaatattccttgggttagggtcagtaccacccacaaagatgacaggtggtactccgggacaggagactgtcccggaaaaacatggctgagcacaacccaaacttgacgccccgcacaatcgtggcagtcgcggcgcccgacgttcgggcggccgtgagcggtcctagcgcttggcggccgttggcgcgcatgcgccccgcgcgccccgcactgacatggccgtcgcccgggtccgcgcgtccgccgcgcgccggccgttaataggcttgctccctgagcgccccgcaccgacatggcggccgtcttcgctgtggtgactttaactctcggttttcggttatagccggccggcgctcacttgtcttcaggaagctcggagcctttggtggagccggggagaggaagggtgggtgcaagagtgaaaggcgagaggggactgcaagcatccgggtcggctcctggccggagcaagatggctgagggcgagcggcagccgccgccaggtaaggccggcggggccaggccgggccggggtcgggtagggtgggggcggtgccaggtgtgggaggctcaggagggcgagagtcatgacacggaggaactggaggggcaaaagctgaggggccccgaggagggactgagttgaatggccttaggggagaggtgggtggtggggcgccgctggggagggaaccaggggctgcaaaggggtggtgattggggcgcaactctgggttttgtgggagtccaggctgcccgaatgctgggtgggcagcgccgtggtcataagggggccttttgcatctctgggcagcgcgtgcttaagtaagctgttgactcggtggggaagctgccagggaggggggcgaaagtgattccggaggctgccgtctttattagtcgctgcttaggggatggggtggtgctccgtgggcctgcgcccgcctcgcctccagtttcggcctccgcgtcctgctcacccctcatcctcctactctctggttccagtgcctgagaatttattgagggaaactgcccgtggtgtctaaatccctaattttaaaaggctggttgtgcaaggaggttagtctctccggcatctccttcggtaactcttatttaccttgtagcctctttttagttcatcttaaataactgggatggaggtgctacggaaggatcttagagaccctttttgtgcagaaggagaaggctgtttgccgacctaccttgaactaagaaggactggccatagataacttttacattcccgacagaggcaaataggttggccgaccaaacacagctaatgttttgaaagcatttgatattcttgctatcctgtctccaatgttggggtccctgggaaggtctcaggagggagaaatgttgaaaatcagaaaaggcatcccctccatgccccacaaaagaggtgaacaaagagctgggttccgtttcttaggacattcaaaaccagacatttattttgtacaaaacctctgggtgtgtgcccttagaacaaggatgtccaggccaggcgcggtggctcatgcccgtaatcccagcactttgggaggccgaggcgggctgatcacctgaggtcgggagttcgagaccagcctgaccaacatggagaaactccgtctcttctaaaaatacaaaattagccgggcgtggtgacacacgcccgtaatcccaactactagggaggatgaggcaggagaatcgcttgaacctgggaagcagaggttgcggtgagctgagatcgcggcattgcactccagcctggacaacaagagtgaaactccgtcacccccccaaaaaaaaaaccggggtgtccactcttttggcttctctaagccacattggaagcagaattgtcttgggtcacacataaaatacactaacactaacgatggctgatgagctaaaaaaaaagtcacaaaaaaaaaaatctcataatggttttgtgtttcttttttttgagacagtgtctcactctgtcccccaggctgaagtgcagtggcatggtctcggctgactgcaccctctgcctcccgggttcaagcgattctcctgcctcagcctcctgagtagctgggactacaggtgcgccaccatgcctggctaatttttgtatttttaatagggacagggtttcaccatattggccaggctggtctcgaactcctgacctcgtgatcctcctgcctcggccttccaaagtgctgggattacaggcatgagccaccgtgcctggcctatgttttaagaaagtttacaaatttgtgtccggctacattcaaagctgtcctgggctgtgggttggacaagctagccttagaagttctggtgatgactccgggcacagtggctcacacctgtaatcccagcactttgggaggccgacacaggcggatcacttgaggtcaggagttcgagaccagccatggccaacatggcaaaaccccgtctgtattcaaaatacaaaaattagctgggtgtggtggcacacgtctgtaatcgcagctactcgggaggctgaggcaggagaatcacttgaacccaggaggcggaggttgcagtgagccgagattgctccactgcactccagccactgcaccccagcctgggcgagagagctagactccatctcaaaaaagaaaaagttctggtaaggacatcaggagataggagatataaggcaaccactgttatcagtgagatgaatgtgtccctgaagatgagtgggggtggggagtgggaggagagagaacctgtgccctgaaagagagctgtgctcagggaggttatccgtggctggaaacagccaggtccctggttgtggtccttttttgaaatttgaaacaaaacttttgggaacagctggaaagaacttcttctttttagtttttttttgagacagagtttcactttgtctcccaggccagggtgcagtggtgcaatctcagctcactgcaacctccgcctcctgagttcatgcgattctcgtgcctcagcctcccgagttgctgaggcgcccaccactgtgccgggctaattttttgtatttttagtagagatgggatttcgccgtgtgggccaggctggtctcgaactcctggcctcaagtaattcacccgccttggccacccagagtgctgggattacaggcgtgagccaccgcgcccggcgagaagttcttaatgtaatgatgaaaactttggattttggagtcatacatatctggctctgcctggcaagtcacagctctgtgagcctcagttacttctctcttttttaaaatttctttttttttccctaagaaaaagcctcagttatttcttaaaataactataggctactatactttcttcatagaattgtagtatgtgttttataagatgtgtgcaaagcatgggacatagtaggcgatcagtaaatgctgattgcccttatctttttcaaagtttcaaagttgtacaggttgaacatgtagacaagtttcaaatggccaatgataatgctatatattatagtctttgttggggggcttaggaaggaacatttctaaaattctgaatgttgattttatactgtgaggttgttgggaatccactgtcccttggaacctatgtctctataacctgaggctggagagactgtgggcgtgacctcatttatcaccatcctgcctttgaaggcttgtttctttgatttgggattgtgtgttctggcaacttgtgtgtgtttcatcagtaatttgttatagtgcttcctggtaaggtagccttttcccaaacatggactggcctgaaggctctcttcctgtgaaatatcccggttaaataatgtcaggagtgccatccctttttttatttttattttttgagacagagtctcactctgtcacccaggctggagtgcagtagcatgatcttggctcagtgcaacctccgaggagagctgtccctttgcagagaatggtgatctcacacgtataaaagggctgtatgttcccaaagattatttccaagttgattatttggaatgtgggacacattttcccataaaagcaatgtggttgggttactagtctgacctacaaagctttttatttggcatcttagttgaagtgccaatttactaatagcagttttgggttctgggaacagagcttgcaggacaggtgggaggaggaagagagcttctgatctctttctggggccttggtttgagttaggcagagatttgtctttctctaaactcaggttctctatccttctccttaggtctccaagtcccctggcacttttcttttcttcagttcctctccagacaggctctatttctccaaatgttatatgttccagaaacttcttaggtccctgtccctttttctccatgtagctgatgtcagccaggttttaggaggaaggcagggggacaaatttataccaggttgtgagtgattgatgatagtcctttactcttccactttagggagagtttgcatttttttttttttgagatggagtttcactcttgttgcccaggctggagtacagtggcgtgatcttggctcactgtaacctctgcctcctgggttcaagtgattctcctgcctcagcctcccgagtagctgggattacaggtgcccaccaccacgcctggctaatttttttgtatttttagtagatatggggcttcaccatgttggccaggcttggtctcaaactcctgacctcaggtgatccaccagcctccgtctcccaaagtgctgcgattacaggcctgagccaccgcgcctggccaactgcctcctgggttcaagtgattcttctgcctcagcttcgcgagtagctgggactacaggtgtgcgctaccatgcccggctaattttttttttttgagacgagtctcgctctgtcgcctggtctggagtgcagtggcgcgacctcggctcactgcaacctctgcctcctgggttcaagcgattctgcctgcctcagcctcctgagtagctgggattacaggcactcgccaccacgcctgactaatttattttttatttgaggcggagtctcgctctgttgcccaggctggagtgcagtggcgcgatctcggctcactgcaagctctgcctcctgggttcacgccattctctcacctcagcctcccaagtagctgggattacaggcatgcgtcacctcgcccagctaattttttttgtatttttagtagagacagggtttctttttttttttttttttttttgagacggagtctcgctctgttgaccaggctggagtgcagtggcacgatcttggctcactgcaagctccgagttccatgttctcgccattctcctgcctcagcctcccaagtagctgggactaaagcacccgccaccatgcccggctaattttttgtatttttagtagagacggggtttcaccgtgttagccaggatggtctcgatctcctgaccttgtgatccgcccgcctcggcctcccaaagtgctgggattacaggcgtgagccactgtgcccggccacacccggctaatttttgttatttttagtagagacagggtttcgccatgttgaccaggctggtcttgaactcctgagcccaggtgatctgcccacctctgcctaccaaagtgctgggattacggacatgagccacttcacctggctaatttttaaattgtttgtagagatgggggtctccctgtgttgcctgggctggtcttgaattcctgggctcaagcgatcctgccgcctgggcctcccaaagtgctgggattacaagtgttagccactgtgcctggtctagattttcttctttctacaagttatgaaaatttccattatgtgggcatataattaattacacatcatcttatcaactgatatttgggttgtttctaatttttttttgttttcaagacagggtcttgctctgtcacccaggctggagtgcagctcacttcagcctcagcctcctgggctcaagtgatcctcccgcctcagcccccgaatagctaggactacaggtgtgcaccactacacctggctaatttttgtattttttgtagagatggggtttggccatgtggtccaggctggtttcaaactcctggactcaagcaatctgcctgcctcggcctcccgaagttttgggattataggcgggaggcactgtgcctggcctagattttattcattttataagctatgaaaatttttattatgtgggcctatcttttttttctcttttttaaatttgagacggagtcttgctgtgttgcccaggctggagtgcagtggcgtgatcttggctcactgcaacctctgcctcctgggttcaagcggttcttctgcctcagcctcccgagtagctgggattacaggtgtgcgccaccatgcctggctaattttttgtatttttagtagaggtggaatttcgctatgttggccaggctggtcttgaactcctggcctcaagtgatccacccgcctcggattcccaaagtgttgggattacaggtgtgagccaccacacccagcctctttttttttttaagacagtctcactctgtcacccaggctggagtgcagtggaacggtccagctcactgcaagctctgcctccccagttcaagcgattctcctgcttcagcctcccaagtagctgggattacaggtgtgtgccgtcatgtcaggctaatttttgtattttttagtagagatggggtttcaatatgtttcccaggcctggtctggaactcctgacctcaaatgatccacctacctcagcctcccaaagttctgggattacaggtgtgagtcaccatgccggacctgggcatatcattatttacccattgtcttatcaactgatatttgagttgtttcttttttttttttttcccccgagatggagtcttgctctgtcaaccagagctggagcgcaatggcacgatctcagctcactgtaacctctgcctcctgggttcaggcaattctcctgcctcagcctcctgagtagctaggattacaggtgtgcgccaccacacttggctaatttttgtatttttagtagagatggggtttcaccttgttggccaggctggtttcgaactcctgatctcgtgatctgcctgtcttggcctcccaaagtgctgggattacaggtgtgagccaccacgcccagcctatttgggttgtttctaattaataaaaaatttttttatttgagtcagagtttcactcttgttgcctaggctggagtgcgatggcacgatcttggctcactgcaacctctgcctcctggttcaagcaattctccttcctcagcctcccaagtagctgggattataggcatgcgccaccacacctgaataattttatatttttagtagaaatggggtttcactatgttggtcaggcgcatctccaactcctgacctcaggtgtgatccacccactttggcctcccaaagtgctgggattgtaggcatgagccaccgcgccccgcctaaaatttttttttttttaaagtagagatggggtctcgctgtgttgcccaggttggtgtcaaactcctggactcaagtgatcctcccacctggggctcccaaagtgctgagattacaggtgtgagccactatgcccagcttttttttttttttttgatgcattaaacacctttgtgtttccgtgagcacatctgaaagatagattcctgtaagtagacctgttgactcattgtgtatatgcagttttttattccaaaagattgtccccttaggaggtccttcccacccacagagcgggagaattcttgtttcctcttcctggaatcttgttttgtttttattgagacagagtctcgttctgttgtccaggctggagtgcagtggtatgatctcagctcactgcaacccccacctcctggactcaggtgatcctcctgcttcagcctcccaagtagctgggactacaggtatgcaaccacacccagctaatttttaaattttttttgtaaagatggcgttttgccaagttggccagcctggtcttgaacccctggcctcaagtgatctgcctgccttggcctcccaaattgctgggattaggtatgagccaccacacctagccagatgtttttaatttgccaaccttatccagaaagagaaatcacatataatttacgtgtccgtgcttattcaggaggttggcaatttattccaaatgtttactgcaattaggttttttttttttttttgagacgaagtctcgctctgttgcctgggttggagtgcagtggtgcaatctcggctcaccacaagctccgcctcccaggttcacgccattcttctgcctcagcctcccaagtagctgggaccgcaggcgcccgccaccacgcctggctaatttttttgtacttttttagtagagatgggatttcaccatgttagccaggatggtctcgatctccttaccttgtgatctgcctgccttggcctcccaaagtgctgggattacaggcgtgagccaccgcacctgacctgtttttttttcttctgtgaattgcctgtgtatgtctgaaacatcaacttggttttatttttctaacggttctgctctggtggggagagggaagggagggcatggttattgaagggattgtcagtattgcccttctctttcctccccagagtgagggagggcaggaggctgtgggtttggcttaacaagcccttactctgtcctggaagtatgtgtctggtttattctaaggctcaggtgttggagtcctggtttaaaagtgagagagaggccgggcgctttggctcatacctgtaatcccaacactttggaggccaaggcgggtggatcacctgaggtcaggagtttgcgatcagcctggccaacatggtgaaaccccgtctctactaaaaatgcaaaaattagctaggcatggtgacatacgtctgtaatcccagctactcagaacactgaggcaggagaatcgcttgaacccgggaggcagaggttgcagtgagctgagatcgcgccactgcactccagcctgggcgacagagcgagactctgtctcaaagaaaaaaaaaaaaattagctgggtgtggtggcacgtgcctgtaatctcagctactcaggagactgaggcaggagaatcgcttgaaccctggaggtggaggttgcattgagccaagatcgtgtcactggactccagcctgggcaacaagagcaaaactccgtctcaaaaaaaaaaaaaaaggtgaaagggagtgtgtgtgttgtaggggaggattctatttacctgtttgttttttcatttttttttgtcaagattcttcagaggaggcccctccagccactcagaacttcatcattccaaaaaaggagatccacacagttccagacatgggcaaatggaagcgttctcaggtaccatttggaactgtggtgagaaacttgggcttttcaaagacagtggttttcctagcatgacgggcggtaagttcctggcccttcttgctcttggagcctgacttttcagaagctagggagaaaggtgacaggggagctggctgtctcttcccttcagaggcagtactcagagatgctttatcaggaaggttgcctactttttcaggctgctgccagggtagcccgggagagttccgctcctggttctcttaagccattgccccttgagtgttgctgtattggctgaacatgagtgtttgaaatgatggagcgagtcactttgattcttggctgcaagtaacagcaagtgtggcagccagtgcctcaaggggagaagaggctatctcatggaaactttggccagggatatggctaagcctgcaaatacctgggagctgggacccagagcactgggcacagactggctttctctgctgctcagctgaaatgatgggcagaagataactacttgtacctcccaggcttgtggtacaggctgtggaaagacagactgagcaaaagaaagccaatttcaatttctcagggaaggcctctggcccagttctcgtcaggctcctgctcccggcctggtgagctgggctggagagtgttgctcatgcagaaggctgggcacaggggtccttgcatgctgggcagattctccaggagacccacaccctacagcttctatgccttgtcctcactggggcttggggccatctaaacctgtctgattcctttttcacaagcctgccctctcagtatttggaaatagttatcatgtcttttctgaatcttcaccaggatcaacagtcccttcagcctagggggcagcttggtcccttcagctgctcaaaggatatggtttcagtcctttcatcatcttggttgctttacctcggggcatctcaatgtcagcactatggacattgaggggcagataattcttcattgtaggaggccgtcctgtgccatgtaggacgtttactaatatctctggcttctacccactagatgttggcagcatgcctttccccagctgtcacaactaacattgtctccagatcttgtcagatcttctctgagccagattgctctagttgagaacctgcttctttgtctgaatccaaatgtgacacttcctttgctgcttctcatccatgtgttccagtgtagctgcagtcaggacaggggctcagacttgccctggtctgagagagttgctttggagaggcctggcctgctgggggtcatcccatggctggcaggaggatcttggtataggaatacttccttctagatatcagggcttgtctcagggcttactgtggacaccccggcttggataaggagaaaggaagaaagagagaggaaaaagggatgaagaagaaacaaaaccaatcaggagtcacttgttcccagcaactgcctctctaggggcctgcacctcaatgctatttttttttttgagacagggtctcaccctggcccccaggctggagttcagtgatatgatcatggctctctgcagcctccacctcttgggctcaagcagtcctcccacctcagccacctgagtagctgggaccacaggcacgtaccaccacacctggcaaactttttaattttttgtagagatggggtctcactatgttgcccaggctggtctcaagctcctgggttcaagtgatcctcctgcatcagcctcccaaagtgctaggattacagacttgagccacaatacctgaccctcagtgctttcttatccctgtgttgggtgtaactgcagcccagcagggaagaagagtgtctagttgaaagctgggaatggttgtgtggggagacctgtctgtggcaggcatctgcactccaactagacagcctggcccgcctttggtcgctgattgctgggggtgagacacttggtggtactccttgaattcctggtggtagagcatcatggacaagcatgtgcccactcagctttgaagttaggctactgggtcctagctccatgtctaatgatatcttggtcttgggagaccttgggcggatcacttctcttgaaatcttggtttcctcatctgtaagatggcgccagcagtgtctaccttatagggctattgtgtaaaaaaactgctggcagcaatagtgagtacttggttcactctggctggagatcagcgtgttgctgtggtcactgtcttgccagcttttctggagggtaggggtcggtatttggcattacgtttctgcttctcctgctattgggttgggagtcagggtcaggagaagtagaaagctcggagctctttggtaacctggtggagctcggggcaggtggggcgggggggtctgccacccctctccccatccccattctcctctctgtttggtaggcatacgctgactacatcggattcatccttaccctcaacgaaggtgtgaaggggaagaagctgaccttcgagtacagagtctccgaggtaggcccaaggaggagctgctgcagcagcctttccaaaaatagctccagagtcactgggtgcggtggctcacctctgtaatctcagcaccttgggaggccgaggcaggcggctcacgaggtcaggagatcgagaccatcctggccaacatgtgaaaccccatctctagtaaaaatacaaaaaattagccgggtgtggtgacgggcgcctgtagtcccagctactcaggaggctgaggcaggagaatggtgtgaacccaggaggcagagcttgcagtgagctgagatcgcgccactgcactccagcctgggcgacagagcgagactctgtctcaaaaaaaaaaaatagctccagagtccttgtgggctcagtgcccaccacggggccagagcagaaaataagatcgcccaaannnnnnnnnnnnnnnnnnnnggccagagcagaaaataagatcgcccaaatacatgtgcacttcacattttcatatctatatttctaatttttgaaatctgtgaatagatggatatttataaaattgagatcaaggtaaatatgctgttttgtagttagtatttttgctaattggttttttctttcttttttttttattttgagacgtagttttgctcttgttgcccaggctggagtgcagtggcgcgatcttggctcaccaaaacctctgcctcctgggttcaagcgattctcctgcctcagcctcctgagtagctgggattacaggcgtgtgccaccacacctggataattttttatttttagtagagacggggtttctccatgttggtcaggctggtctcaaactcctgacttgaggtgatctgcctgcctcggcctcccaaagtgctgggattacaggcatgagccactgcgcctggcctggtgtttttatataacttgaaattaaaacagattacaaaacagtaaatgtgctcactggagagatcagtaatagacatgtgtatgacattcacagcagagctgatctctccctgtgtttctcatacccagcttccagggcagcccctcctgacagtggtcacccaggaaagcaagagcttctcttctcctgcagtgagctgtgccctcatttatttatcttattttattttttttttaaatatagagacagggtctcactatgttgcccaggttggtcttgaactcctgggctcaagcagtcctcctgccttggtctctcgaagtgctggggtgacagatgtgagccaccaagcttggcccctcatttatttaaacagcccatcttcagacttttaggttgtcttggtaaacattgctcctcgcatatcattgcatccccgcacatagatctgtgggccttgtttccgaaggattcattcttagacgtggaaatgtggagtcaaagggcacatgcattttttttttgcgtttgggttcacactgcctggtgggtgctttttggacgttgtttcagagatagttttgtttgtgtagagagggcaagagctgaggggaggcagatactgattggcaggtgtggccttactggctgtttgcttttgctggatgctgtctcccagggctaggacctaggcctccaggagcctcttgggttcatgtcccaccttgagtctcttatctcagacaccagggcctgaagggcctccctttactttggcctacccagctctctagccacagccttggacctgttgggtaagatgtagccctgccctggcccagtttttccacctgccccaagattaacactgtgtgcctcaccctcatacccggcccctggcagagctgcctattgctgggcctgtctggctattaggtgacctaggtcctgttctgtccacttcaggagaaccaggcctgtgcttctggtagacagccttcccttgggagccaggcccattagtggctttttgggttccttttgggctcactcagtcctttgggactgaggctctgggtgcaggatggctggggaaagagggggttcctcctggagcctgtggtgagggatgctcagctgtgctcagtgggccaggaatgtcgtggaggaaggctaattaaaggggaaggttgtaattaccccagcaaatccttagctgccaagtcccctaattgcccgtggctttgatggtagccatccacaccaagcaggtattgtcttttttttttttgagtttttcttgttacccaggctggagtgcaatggcatgatcttggctcactgcagcctccacctcccaggctcaagcgattctcctgcctcagcctcccgagtagctgggattacaggcgcccaccaccacacccggctaatttttgtatttttagtagagacggggtttcaccatgttgggcaggctggtctcaaactcctgacctcaggtgctttgtcctcccaaagtgctgggattgcaggcgtgagctgctgcgcccggcccaggtattgtcttagctcaagggctgtactttggcaggattgcagtgtggttacatgcttgggttctggagtccagctggctagtttcataacttgtgaatcatttttgaccctctgtttcctcatctgtagagtggtaagagtcagcagactagtcatggccccctggggaaaattcactgagatcccacgagtagtggttgtcttttgcatagcgcctaacacatactaaataaatacttcgattgttattagctattgttaccattaggcattagtcagttctaattttcaatagtgttgttgcatagaaagctagcttttggctgggcgcggtggctcatgactgtaatcctagcaccttgggaggccaaggcgggtgaatcatgaggtcaggagttcaagaccagcctggccaacatggtggaaccccgtctctactaaagatacaaaaagttagctgggcgtggcggcaggcacctgtagtcccagctacttcggaggtggagtcaggagaatcctttgaaacccgggaggcggaggttgcagtgagccaagatggtgccactgcactccagcccaggcgacagtgcgagacttcgtctcaaaaagaaaaaaaaaactagctcttatttttttattatttatttatttttatttttatttttatttttgagatggagtcttgttccccaggctggagttcaatggtacgatctcggctcaccacaacctccgcctcccgggttcaaacgattctcctgcctcagcctcccgactagcatgtgccaccatgtccatctgattttgtatttttagtagagatggggtttttccatgttggtcaggctggtctcgaactcccgaactcaggtgatctgcccgtcttggcctccgtaagtgctgggattacagacgtgagccactgtgcctggccagctagctcttattttaaatgatgcctgtcctcctcttatgggggttaacattttcgatttttgcaaaataaatgtgataagagatttatttttgttgttgttgttctgtttgcttttttaaaacttacaagggggcaaaattcaaaaatggtcagtaaaatgttagggaagattttactggtccttgaaatccaaaaaggaaacactggcctagggagaatgggagagctggagttgttctttgtgcctcgaaggtgtttcagccccagttccctttctttcagcccttctctcccaacacagcaaacaatagaggcagcccctacaacattcaaaaagccctctcctgaagaggagctgggagcctttgaattattcattggcccagctgagctagcagctggggcctggctcctgtgactccgtcttctctgtccccttcagtgcctcgcctaagactgagatccctggggaatctggggctgactagtgcttcctggggccaagatgactgtgccatccattgtaagcccccgtttctgcatgggttaggtctggcctgtgcttatcagccattcctggtttttcacaaagccaggctctggcagcgctctcacatttcagcaaggcagctttatgccatcctagccctctgccttagccaggtgtaaagggaaatttatcctcttacaggctactttttctgtcctcccatgccccaagcctagataaaggggagataagagagagcagcactcagggccggtttcacatatgcagctgggggcatggccagcctgtttcattagcttaagcctgcctctccccaggtacatacatagctcttggctgagtctttgcacatggcaggcctggtctgccttgccctcccaggcgcaacttctcatgtgggcatcaccctgctagttcctacccagtgccaggatttcctgtaagtttcttatgccgtttgtttccatagacacaggcaagatccacttcctggcagggactcttttctcaggactgaatggctgcagatagcctccgcgttgtattttccaccggccctggtgctgggctatttctacaagccaacctggaaggagcaccttctaactgatctttgggttggatagacagccacccgatttcttcattgagtaacattttatgtgccaatgctgcccgcacctctgactccgattctacttcttggtccctgtcttctgtgggaaaggtgtagggggatgggctctcaaactctgccaccctacaaagcattgcacacgatgatctggcatttccacaaagattgagttgcaagctgatttaccatagcattgtgtatgaaataggtagtgaaacaggtggaaataacccaaacatttaacagtgaggaattaaattaattataatgcagtggcacgatgaaatgttattcacttagtaaaagttgtcataagattatgtttatatgtagatgtggaatgaggttcatgaggaaaaggagcaggctgcaaagcagagtgtgtcctgcgatgaatgcataccattaccccgcgccgggcactgtgcaccttcggaggtatttatcatcagccccattttttagacgaagaaactgagaggctcagagttagtcacttgctcaaggtctcacagcagctaaatggtgttttagctggggtttgaatccaggcccaccatgctaaaccatgtaaaacactatgagaagataacacagaagggtatgttaaaatgtttagtgtaggccaggcacggtggctcacgcttgtaatcccagaactttgggaggccgatgcaggtgcatcacttgaggtcgggagtttgagaccagcctgactaacatggagaaaccccatctctactagaagtacaaaaattagctgggcgtggtggtgtgcgcctttagtcccagctacttgggaggctgaggcaggagaatcgcttgaacctgggaggcaaaggttgcagtgagccgagattgcaccactgcactccagcctgggcaacaagagcgaaactctgtctcaaaaaaaaaaaaaaaaagtttagtgtatttctgggtggcaggattactggtcattttcattttcttctgtttatatttctattttttatgatgagtaggtattgcatactgaacaaaaggcttccataaagtctttttaaaaagatgtcagggctggagttagcttctctatagcagcagcccatgggtaggctgcctacagaaaccaggtgctaaagccaccccgtccctgtcccatcagcctagtgtgcttccctctctggaaagcctatcatgctctcctgaccctccttcatattcagaacagtggggaagaaagagggatgggggagagttcccagtaggggccatgccaaggggtcattgtctggcagcagtggacttccctctgtggctaagcgggagccacttgctctgtagcttggacccctctattttgcctccacaggccattgagaaactagtcgctcttctcaacacgctggacaggtggattgatgagactcctccagtggaccagccctctcggtttgggaataaggcatacaggacctggtatgccaaacttgatgaggtgaggctgccacaggacaggccagggactgggctggcagtgagggtggttctggcaccagttggggaagggcctgcattgtatagcgcttctaggcatatacaaatctcagtttgttaaaatgtcaatttcacttagcaaaattacaaatgagtttatactctgcttggtcatcttctgggaaacacgactgtgcacatacggccctctgcactacaaggctgtttattaagtcactgtattacagcaaactggaaatgttccaagtatccatctgtaggggattatttaaataaattagtccatcaatatcatggagtactgtgcagctataaaaaggaattttttttattttttattttatctttttttttttttagacggagtctcgctgtgttgcccaggctggagtgcagtggcgcagtcttggctcactgcaagctccacctcctgggttcacgccattctcctgcctcagccttccgagtagctgggactacaggcacccaccaccacgcccggctaattttttgtatttttcgtagagacggggtttcaccgtgttagccaggatggtcttgatctcctgaccttgtgatccgcccatctcggcctcccaaagtgctgggattacaggtgtgagccaccacgctcggccccaaaaaggaatttttttcatagctgggcacggtggctcatacatgtaatctcagaattcggggaggttaaggcgggaggatcacttgagcccaggagtttgtgagtaggttgggcaacatagcaagaccccgttactgcaaaaaataagaaatggtggtgcacacctttggtcccagctgcttgggtggctgaagcaggagaatgacttgagctctggagtttgaggctgcagtgagctatgatggagccattgcacacccacttggaatgctagctgcatactccatggtgtggatggactagtctattgaactgatcctctactgatgtttttatttttgaatcttacgaaggtgttacctattcaaagcaaacaaaaataaaaatgcaggatctcagaccctgtctagaaaagcagagtctacaggtctgggtagggactgggaacctggatttttactagctttccaggagatggctcatgccagttgtctacaactgagcttaaggaaatttgggtcctaattgctctggcccaatattttcacatagagcagaggggaggactcaggacccagtgaagtgctgttcccaagagacgcccgggcctgcctctggactcttaagatggtacatgatctttttttttttttttttcctgttgttcaggctggagtgcagtggcatgatctcagctccctgcagccttgacctcctgggctcaagcaatcgtcctgcctcagcctcccaagttgctgggactacagcatgcgccaccatgcttggctaatttttgtgtttttagtagagacggggtttcatcatgttggccaggctgatctcgaaatcctggcctcaggtgatccgcccaccttggcctcctaaagtgttggaattacaggtgtgagccactgctcccagccttaagttatatcttaaagctgacaaatcatagctttacagcttgatggatttttacatgtttttactcatggactcaccactcatgccaagttttttacccatggattcaccactcatgtcaagcaatagaacattctagctggagtgctccccttcccaattgatatcgcccagattattctgatttctattccataaattgatttttttccatgtttctgaacttcgtataactctctggcttcttttgctcaatgtcatgtctgagattcatccatgttttcatgtctagctataggtctttttctttgctgtgtagtattctattgtatgaatataccacaatttattcatttcactgttgatggacatttccattgcatttccaccttttggctactctaaacagtgctgttgtgaacattcttctgcacgtcttttgatggcacatgacaccagctcttgctgacctgagagtgtgaaggaaggtggcctgtgtgggaatcatagcactgaccttccagagtctctgtggggctccagtgagttaccacatgggagggttgaggcttttttccagattcctcctgttttgcccctagactcctgtgccctggaaaaatcagttgatgataagtcgcctgggtagtcttctgctgtggaagaataaatgctgtccctccccttccttctgtggcctgtcagaacaggaaccaagctggcctggcaaggcagtgtgggcccccagtcaggtgctgcccctgggcacctgcccactgggatgctgcttaatatgctgccaccactttgtgtctcttgtgttaccaggaagcagaaaacttggtggccacagtggtccctacccatctggcagctgctgtgcctgaggtggctgtttacctaaaggagtcagtggggaactccacgcgcattgactacggcacaggtatctgctgcttgtggggctctgtacttatctagcttcactgctttctgttttgggcttcaggtggtctctgggccctctgagcaagtgagagcaatcaagaattcgccaagcacctgcaacctattggggccagctggggttagggtggcttcaccggcagggagggcgtaggcatgcagggaggcccggatgctgcagctctgctgtggtccaccagggggagctgatgccccgtgcatggtgcttgcgcagcgctgctttctgttcttgtgaaaatggtctctgagctcctcatcatcaccaaaataattattaattgagcacttactgtgtgtcaaggcagcagcttactgaagctttgagaaatgggaacgcttcttggtggcctttgcagtgtcgtggcacaccctctcccttgaaccccttgtctcttagccacattctctgtgctattgggctgtttggatctgtggtccatgtaagccaagggacctggactttgaggagagggagtgtgtggacactttaaaagggaagtgtagacaggtgcagtggtgcgtgcctgtaatcctagcacttttggaggctgagggggaggattgcctgagctcaggagtttaagaccagcctaggcaacgtagcaagactccatctcttttttaaaaatttattttaagttatttttatttatatatttatttttttgagacagggtcttgctttgtcacccgggctgcagtgcagtgatgtgatcttggcccactgcagccttgacctcccgggcccaagtgatcctctcacctctgcatctccccactccccagtacctgggactacaggtgtgcaccaccagcctggcaatttatttatttatttgagacagagtctcactctgttgcccaggctggagtgcagtggcatgatcttggctcactgcaacctccacctcctgggttcaagcgattattctgctgggactataggcacacaccaccatacctggctaattttagtgtttttggtagagacagggtttcaccatgttggccaggctggtctcgaactcctgacctctggtgaggtcacttctccacccaccttggcctcccaaagtgctgggactgggattacaggcgtgagccactgcgcccagctgattgttttgtattttttgtagagatggggttttgccatgttgcctgggctggtcttgaactcctgagctcaagctgttctcccacctcagcctcccaaagtgctcagattacaggtgcaagccaccatgctgagaccccatctctcaaaaatataaaagggaggtgttctctaggtcagggcatggcctgtggagccaccatgctgagaccccatctctcaaaaatatagaagggaggcgttctctgtgtcagggcacggcctgtcgagccaccatgctgagaccccatctctcaaaaatagagaagggaggcgttctctaggtcagggcctggcctgtgcagctaaggaggacctctgctttggtgagggcccgccttccttccctgaggcaggcagatggggcaccgctcagccctccccttgtctggggaatgtgatccacaggagggagccccagccacagaggcaggccctggagaagggccctcttggaccgggtggggctttgactaagaccagcaggaaaagatcaaagagggaagactggccaggtcagcaggggttggtgccccagctgcatgtgaacccctgaacaatgggagcctgggccctgtctggtcataattggaaactgtggcaggggaaggaaactgagctcacaagcttccaggccctggaggggtcttcgtcctccagagacaggacagaagtattctctgacacattctcttctcacctccctccagataggttttgtgtgacattgtgaacaatgggattcaatcacagtccagtgagttgttcctacagtgcagaccattcctgtttgatatgactgggaaaggaaggaggatactttttcaccctgtaatctgatcatgtgttccctgcttagaagcctgcagtggctccctattgctcttagggtaaagtctgagctctttcctatggccaaaaggcccatgtgacctgtagcctcctgtcattacacgttctcccttgctctcactgccttcgacatactggcctccttagtgttcctcaaacagatcaaactttttcttgcctcaaggcctgtgcacatgctattccttctggctagaatgcatttcttgcttccctcactccctttgccttgccagctcacatctttcagatttcagattagatgttacttccttaggggaaaccttgaacccttacgtcagggtccttctgtgatatcctccagttagtaccctgtctttctccttcagagctggaatcatagtagtgactgtatatttataatgtctgttgtccctgatagatcataaactttctgagggcaaggacttacttgtcactgtctcctagtgcgtaacatggacagtgactgcttacatagtaggtgctcagtaaatatggtggaattgctgagtgagttaaacctacgtaatgaaatgtaaatgtccagcccgggtcttttacgagtggaattatagtactggtagttcttttttttttttttttttttttttttttgagacagtctcactttgtcacccaggctggagtgcagtggccttatcatggctcactgcagcctcaacctcctgggctcaggagatcctccatctcagcctcctgagtagttgggaccacaggcacatgccaccatgtctggctaatttttgtattttttgtagagacagggttttgccatgttggccaggctgatctcaaactcctgagctcaagcaagctgcctgcctcagcctcctgaagtgctgggattacaggcatgagccaccatgcacggccagtactggtattatagttcttgaaaggaaagggcctagcaagtctttctgaatggggaagaggtctcattgtctccatgttgaccaccctcctcagaggggcacttatcaatgattcggattctgggagactaaaacaatcccagtcctttacctggactactgtcaacgctggttgtttttctcctccagggcatgaggcagccttcgctgctttcctctgctgtctctgcaagattggggtgctccgggtggatgaccaaatagctattgtcttcaaggtgttcaatcggtgagagaaaggacaggagggttggaggagggggcgtgaggggccatctgtttcctcctcaaactgggaaatggggtgctctagggttctcctgagtagctcatggttctcttgtcctgtcctaatcaagctctggctgtggatggagtgtccaagccttttttccaacaggttcaaattaacctccaagtaaaagcaagtgaaagaattgtcacataggccgggcgcggtggctcacgcctgtaatcccaggactttgggaggcccaggcaggcggatcacaaggtcaggtgttcgacaccagcctggccaacatgatgaaaccccgtctctactaaaaatacaagaattagctgggcgtggtggcactcgcctgtaattccagctactcaggaggctgaggcagaagaattgcttgaacccaggaggcggaggttgcagtgagctgagatcgtgccactgtactccagcctgggtgacagagtgagactctgtcttaaaaaaaaaaagaattgtcacataatgtctgccagtattgacacagtgttgaccatatggaggaagaattctaagcactttatgtataactcattaattctaacaacaaccctatgaaatagcaactgttatttccattttacatatgaggaaactgaggcacagagatatccggtgtcttcactgggttcacgccagctgaacccaggtagtcagactctgacctgctgccccacaccacccaagccagtcgctgggcagcactgatgtggatcagttacccagagctcttaaaatccccattgcgggccccagtctagcagtgctgctgcagcaggcctgtgacggagcccaggagcagtgctcgatgcttcacaggtggttgatatgcagcctctgataatatagaaggttggaaccagaagaacctaggagataacctgctgggacttgtgttagctttcagacaggccaactgaggctggagaggctgaggccctgcccagggttttacaagttgtcaggagttgatggcaccaaaacccaccttcctaatcagtgattttttatttatttatttgtttattttttttgagacagggtcttgctctgtcgcccaggctggagtgcagtggagagatctcggctcactgcaagctctgcctcctgggttcatgccattctcctgcctcagcctccagagtagctgggaccacaggcgcccaccaccacacctggctgattttttggatttttagtagagacggggtttcaccgtgttggccaggatggtctcgatctcctgaccttgtgatccgcctgcctcggcctcccaaagtgctgggattacaggcgtgagccaccgtgcccgggcccttaatcagtgatttttatgcctttcctgagccaaaagatggctgagtgtttgttgggggaaataaagctacattattgaaattgagaccagttaacactcttcagtggttattttggggtctccttgtgctcccagtggccgaaagggtgagactgtctttttactttttgctaccttccctttccctgtcctcctgtgcaggtaccttgaggttatgcggaaactccagaaaacatacaggatggagccagccggcagccagggagtgtggggtctggatgacttccagtttctgcccttcatctggggcagttcgcagctgataggtactggagcgggaggtgcctatccctccacccccaaccaaggctgcgttctgtggccctcccctgcccctcctgcgctccctccttcccttcttcctgcccagggcagacagtgacagcttggaaagcagggcattagaccagctattgagggaggctgtttactgtcgaccttctgctgtgagagcccgtgtggtgggctggaggaggcggaggccaagcgccaccaagataatgggaagtgacatgggctggagcaagggcgcacgcctggtgcataatggactggtgtgaaatgcgccccagctcctggcagcagctgtggggttttatgttgaaaatgagggacccttttgatttggtgaccagtgtcatccactgttattatcgagctgtgtgcaaaggggcccgttagggagcagccgccaagtgctgggtggtgggcctgcttcctgtggggctcagagaggcctgctctggtgactccccaactcttgaagctagttttcaggatgggcgtaggtgatcatctctattttgatgaagaatgaactgcctacagactgatattcataaatgaccattagttgtggcctcgggtgcattgcctccccgaatcttctcagtgacactgcgaagggtctgccagcatgaagccggctctgctgactggcacctgcaccaggcaccatactgagtgctgtaggtgtggtaattgttgtcatggcccctaggaggaggtgctcttcttgtccccagtgtccaggtgaggaaactgaaccttggcaggctgaagtcatgcgtccaacgccatgtagctagagcttagcacattagaatacacaaacccagagttacttattgctccttcaaggtgaggtgttgagggcaccacgggcaggactgaggcccctgggggggtgtgactgctgggccgggttgcccaggtagtcgtggggcctggttctgaacgctggggcccattccttttcccagaccacccatacctggagcccagacactttgtggatgagaaggccgtgaatgagaaccacaaggactacatgttcctggagtgtatcctgtttattaccgaggtgaggaggaggggtgagagagaagcccatggctgcctccaggctcagatgaaccaaggctggtggccttacagtggatcagaagagccagagctgctgcccaaaatggcagggccggccggagcgggttattgaaaaggaagcaccactgggcctcttccgaaagagccgctgctgactgtcaggtcctccgcccagttctccttcagtttctcctgaacaccacaggagtcttgagatgagggtctaagacttggtcactaactggccttggtgactgctgcagcaggtctgaaagggtcggggcgggcggaggtttgtgggggagggtcagcatctttcggtggggccccacaagggtctgtagaaccatgtgctgtggatgtgtaaaatgaaaccaccagaggagatggagcgaacttctggtgcagacagcttttctgtcgaagggacacgtctctgtcagtgcctgaggacgtgggcccgagcaaagtgctggagtgggagtgcgcaggcctggcctgtggtggcagtcactggatagccagccccacggctgggttctggaactggaagttattgtctcaccaaggcaggattccttgcagtgggccctggaccacttgtgcgagatctcctagtgtgtttgttaaaacgcacattcctgggccctccatcccagcttattgcatcagaatcttaggggacaagagccaggaacctgcatctaaacacacgtgccaggcgactgcacaggaaagctggggaccctctgctctctggacctctcttgagggaggtgttaggacttctcatcctctctgccatccccatgccccagtttccaaagggcgccctcgctcagctatctggagagggtttgagagttctatccctcctcagtccctttcccgacaccagcacggatgtctgctgcctcagtgaggttcctagcaggcctgtggatgctggccacgggggctgctctccgtccgggctgtgtattctgagcccccgacgaggtggagaaagctgggttataaccagcagccttggctccaggctcttcctggtcaacattcggctcaggcttctgccaaactccagaggccagaggggaatgacacattttttccaagtcagcaaatggagccgggactgacggctgggcggccaccacttcattcccggagatctgctgccctcagcagtgtggcaggcccaaggtcgggaggacttgggggcagcctggctcactgccttgaaagccagtcacgcgctgctctctgtggagtggaatgtgggggtctgcggagccctgggggacctcaggataagctggaggagcagggtgggaagaagggtgcagatgccacactgagttcttgggtgtggctgaaaggctgagctgtttgggctcccccggcggctggccaggcctctgggtccctgtcggtattctaactaggaggcatgccaggcctggcctccaggattttgggaattgattccatggtaaaattttgtctttagttggttggttgattttgttggtataaacaccccaaaagcttttccaaagtttgggacccagttcctccagtagaggaaatctcaaagtagccactaggtggcaggagaggcacactgaacttggagagggtttggtgacatttatttgaggcagcagaaggaacagggaggggagggcgtgcctagagttgttggctgttccgcaccttctccacaggtccgggttttcactttgggtctaggctcttgggcatggtgttcaacagtagaccctaggaggagtgtgcccaggagccggggtggctgcagcaagggcccatcttgccacgtggccgctggttgcagcacacgttgtgttggttctccagagcgcccaccctcttccacctcggagcagtgagcagcattttgcagtccctagttggtgagtggcctggcctagctcactggggacctggaggcttgcatggagttctgtacgccttgcttgggaaggaggcagtgtttcctctggagaccctggattcaccatggtgctcttttaactgggagattaactaaaacaccgagaacttgggagtggaatcaggcagccctttcagggtctcatgccaagactgccctgatacccgtgggcatcctaggtgagggaccccaccttgcagggcctctacagcctctgtaaatgcagccctggcgcctttaagagcccagggcaggcaggaaaagaatttcagtttcaatctggcttctaaatttggagttttgggaagggagggatcagatttcagctggaagggaaggagctgacaggaaggcgctgtgcagagcctccccacccccgcccatccccccagttactgacagaggagccatttacaaaaggccgattctctggggagtggagaggcaggaacgcagcgtctgtgagtaatttcctgctcaatatggctgctctgactcacacgattcccctggggtcactgcgggctgcagctcgctcgctcattctggttctttctcttctccctttgtggctagaatgagctaattttttctttgtcttccagccccgattcctttttcccccactcgtctgttttcctttgccagagttacaggcaaaggactgtaacctccctgaaggacttagggagaccctggggtactgaaggcctgggggcagcctgcagcccctccaaagaaactacctctctggcctttctgtgtgtaggggcccagggccactggagctccaggacatgggcctagccctggctctgccagaggccttttgaggatctgttctttggccctggtaggcgaggctggccaggaggcaggggctcttgtcttccagtgcccatctgcctgcctttgcctcggagcccttgccgggcaggcccctggcagacaaagccgacaaagccgacagggtgcctcctggttgcttgctcagagggccctgtccagagagtgaaactggttacacagctccatgctccctgagctttcctgggcctggaagtgtgcacagggctggagcctgcagactggggaaggggtggggtagggtggggaggtgggggaggggctgggggtggagtgtggttgagcagggcagttgaaacaaagctccccagaggtgaggcccctgtaggctcggggtgcctggctgccctcctggaggagagagcctggggtgattctgagtgaagcgagtggtccaagacaaggcccccagggaccagagtgggctttgtctctgttgggtgcctcgggctcttgcctggctgtggtggagcctgggagagaagaggaggggagggaggagcctgttgtccttgctcctgaacatgggtgtttggatgggctttttgggaacctgggccaggggagggaaatgagggggataaaatgacaggttttttttgacttaaatcttaaaagttttgtcacagttgcccttactagagaagtaagaggcctgccaggagtgggtcaccaggtggcagcccatggctcaagagtgggggctcctgagggctcttgtggtgaactgatgcccctttttggagagcgtttctggcttatcttttctccttcaaaaaataacccagtctcccctgacacccgcatgtttctagaaccttccaagtctctgtttctttgccagattcagcctctttgcagagtcttccttctgcagcatgggtctggggtacagagccctgttcccctgtaaatgctgcctatgagctggggggctgtgtcgaggggaattatgaactgcttggttaataaatacaaatgtgctggacttgcggtgtcagggggatatgctcaggcacacaggcgtccctctgtggtttctgacgtcatgggaacttcatgctggctgcagaatctttctcttccgtcctggagggtcagactctttggcaagagggaggaccaggaatggagccgtccttgtgcctgcctctttcagctgctgtggcggccaccccttccccacctcctggccaggccaggctggctgctgcttcaggcacccctgcctcccatcggccctctcttccctgcctgcatggcaggcagagggctgtcggatacctgggtttggtcatacccaccttggtcctcttgcaaattgaccctttcctcatctcttctagctctgctggtggcaggtgcagaccacgtgtcctgtgggggggcctgggggagagggggtgggcctggaggggtggggcctagctgctgctgctatttatctgaacccaagtgaatccctgtgctggagaggcgctctgaggctcctggggagtcggtgggaacgacaccagaagctcaggtggagatcttatcttcctgaggctgctggatttggtgggcgataggaatcaggccccctttttttggctgtgggagaaagaggggtgactgcgggtaggtgggcaaggaatgttatattttcctagcaggccttgagggccaaaggggaaccttgtctctggcacttgcatgtgcctgtttgtatgtttgcccctcaggcagatgctatagcttggtccccaagtgtctgcgcgtgcattgtgtgtgtgtgcgtttgtgtgtgtgtgtgtgtgcatgcatgggtgtgactttgctgcaggggaggagggatgagctcccagccagaacctgtctcttcagcttgtggcttctctttttcagatgaagactggcccatttgcagagcactccaaccagctgtggaacatcagcgccgtcccttcctggtccaaagtgaaccagggtctcatccgcatgtataaggccgaggtgagtgggggctggccagtgtgcccgtccctgctgccgcacttggtcctgggctggggacaaagcaaaagatgtggaacctggggctcctgcttcctcctaccccactgttttgctctgaatcttaggccagcccctctgacacttggggcctcggaatctcccatctggggcatgggcagtcagagaagcaccagccaccccagccccgaaaagctgcagtccagctctgtcctgatgagcttggaggctgaggcaaggacctgctgcatggggagtgggggcgatgggggcctcccttctcctttatcaagtggccaaaggctcctcaaagctcgggcagtcggagtctggctctcccatggcatacctgggaagggtcttaccctttggaggcatctccaaagtgctgccttcaaatgttagtgtgtatgatcactgagtggtgggaggtctgagggtaggccgagaattggcatttttatggaccgcttcagggattttgatgcaaatggttttccctgctctcaaatcagatgctgaggagaggagagctgaggcttcctggagctccccctgctggcaggcagccgagggtgtctcctgccctcttggcactgttctcccagccaaggaggtggccttttctctcttccaagtggggaggagacattttatttctactctgtcccttctgctagctcctcccacttcctgggaagactaattctagaactgcttgaccttggccagggaagggctggatgtgaagttccacacctggagtgatgggtccttaaagtcccttctttctgttctcaggctggcccttgtgactagttcatggcctcagacactgtactgtgggcaccatctcttgactcctggccggccttctcttctgggaaggggctgctccaggtcttcattggacccagagcttcctggatcccatcagcagaggcgggacaacggggaagggcgccagaggccagcggggtgggggagcacagatgcttccagttggcttggctccctgcacttggtcctgaaggggttaatgaggcttgaactgaacagaccgggccctcactcccttccgccccctccccctttggtccccttcctctggacctcacatcctgtgtttaggttccagcccacatacctctctaatctgagaggcctgagagcccgttggctggagctgcctaggttccttccggctgcagctggccacccccggctctccactccgactctgccctgggtcactgccctctggtgtcctgatgttcctgaccccacccccgcctgtcccacagtgggggctgctggggaactctcactctgctgtgccccgcctccagggtgtctgagcatgtgagaggtgcacatcgcccaccagccacctcccaaccccaacccttgtgtgccaaagagaggactctggctgccttctctgcttggtacctgaagtactgtcttctctacaagcctcttaattcaagtgactctaaacttctctcgactcaggctctaaggcccaaaggatagggcaagagaccctgtccccttctctcacctgcccttccagagacaaaagaactccaggctgccagaggatgagggaggagcatattcggattgaaaatggtgatggtgtggcaggaacacagggactgtccactctgcacaggctgtcggggtctccgtgggggctgagcacagggtggcaaacacaaagaggacactgaaaatgaccaactcaggatgggggagctctctagtaatctgaaaaagggagattctagccctagttgaggccggcgctgtgtggggaaggggacaggctcctgtatagggtgacgctggaactccctgactttaagatcaccaagtcaggccgggcgtggtggctcacgcctgtaatcccagcactttgggaggccgaggtgggcggatcacgaggtcaggagatcgagaccatcctggctaacacagtgaaaccccgtctctactaaaaatataaaaaaattagccgggcgtggtggcgggtgcctgtagtcccagctactcgggaggcagaggcaggagaatggcgtgagtccgggcggtggagcttgcagtgagctgagatggtgccactgcactccagcctgggcgacagagcgagactctctcaaaaaaaaaaaaaaaaaagatcaccaagtctttgcctgtaatcccagcaatttgggaggctgaggtgggtggatcacttgaggccaggagttcgagaccaacctgggcaacatgaggaaaccccgtctctactaaaaatataaaaattagctgggtgtggtggctcatgcctgtggtcccagctacttgggaggctgagacgggagaatcgcttgaacctggtaggcggaggttgcagtgaattgagatcacaccactgcactccagcctgggcaacagtgtgagactccgtctcaaagaaaaaaatcactggttgggtgcggtggctcatgcctataatcccagcactttgggaggccaaggcaggtagatcacctgaggtcaggagttcatgaccagcctggccaacacggtgaaacactgtgtctactaaaaatacaaaaattagcctggcatcgtggtgcgcacctgtaattccagctactcaggaggctgaggcaggacagtcacttgaatttgggaggtggaggttgcagtgagccgagatcatgccactgcactccagcctgggcaacagcgagactccatctcaggaaaaaaaaaaaaaaagatcaccaagtctttgcagtgttcaacactcattgacaacttactagcaactagcccttagtccttggtcccgaagggcccatgggctggcatgttgcctacacagaggtccaaggagagggcttgttttctcaggccagttcttagcccctaaggaggccctccaaggcctgccagtcttgcagtccaggggtgggtaggaaggctgggtctccagtcagaactggttgattgaggggagtcagcctcctgggctgccacagaagtctgaccagcctggcagtaggtggcctcaggatttgggtctaactctgctctgtcccagcctttctgaccgaagaaccaagtgctctcaggggccttgtgtggttgcggggcggcgggggggagggtctgtctttcctctgggccatggctgtgtgggtgctgccttcagaaggaccttgtcaggacccagggagtcccttccccagcttgaatcacctctggctggaaggtcagggggcagtctgaagccgctgctccgcccaggtacatgggagggccttgctgggagaaaggctgggctggaggctcctcctgccctggagccttaggcttccttggcccagctcctgtggctctgagggggctggctctggggtcctgtgggcagaatgggaagaacccctgcctccaccccttctcgccttgcaacttcttctatgggagctagagggaggttgacctttgaccccttctggaattccagggcccttggggggtgggggggctcttatgaccacttctgggatgacataagcaccatggcagctgccttggcctctggcctggatctgcggctgctccccctcccgcccagggaccacctcccgctccctgctcccgcattctgtgtctcaggcccaggatcctggctgtggccagggctctgctccccaccccaccatgagcttggtttccatccttctttccctcccctcctggcgcctctttggcccactcgtcaccctggtgcttctccctcttaggttccacagctgatttttgaggagagggaacctgggccagtcatagcacccgtttgtctctaagttagttggaggttaagatcacagccacagagtgaggctcttactctctctgaggccataagtcttgttccaccccagccaggaggtgcctaacatactctgttttctgtggccaaaggtgtgggaggaggccctggtcagtcttggcagatccaaccctcgcatgcccagaacggctcctgtgagagctagtgtccaggtgtggcaggcatgggggtgctgttgcgggagctgcagctggaagctggggttggctgcctgtgggccaggccagcttctgtgataggccctgtcacttgctctccagctctgctcctctgctaggagcccgggctgggctgggctcagggagtcgggcctcccccctgctcagccattcccctgttcagcgctctttttcccctgccccccacacaggctgctgggaattgcccaggggtggggggaactcagtgtcagctggttcttattgtctcgctctgaagtgccaagatgcctttttcagtccagagaactgaaagctggagaaaacaggctttgggacccggcctcagcctcttaggcttacgttcaaatgtccccacgtctcttctctagaactgggacctgggctgggggtccccagtgatcaggagggttctttccacctcaggttcccaacttccctctctgggccaagtgatggcacctggctgcctctcttctcggtttctaccttgtaggtttgggctgccttttctctctttctctctctcgtgggtctcgttgtggagtgggtgtctttggatagaaggagtgaggaactgggggaggaaggcctgggggatcccctggcggggctacttcctgggcccgggatggacacctgggagctgctgcggttgttggggtcctggcaggggtgtggtgtggccctcaccactctgctcacctgctccttcctcacagtgcctggagaagttccctgtgatccagcacttcaagttcgggagcctgctgcccatccatcctgtcacgtcgggctaggaggggccaagccgaagagccacccaggccacagttcctgtgcctgccttccccaccccagcagtggcccctccccatcccctccctctgttcgtcccgtttgatgagaggctgtttactggggtggggtggcgagatgggcttgagggggctcagagcataaggcttcagggcccaagttgggagaagtgaccaaagtgtagccagttttctgagttcccgtgtgctagactggccagaagagagggtctggggcctggtcactcggccactctctcctgtttctggcctcttctcccttcactcccgtccagtctggttttgagagcaggggctgttctgcagcaccgcagggaagggaggagagatacctgctgcttccattgcttttcccttcctggagtcgatgcctttctaagggttggagctgctccttgcaggggcgggtcagtttcccaggccatgccggggtggccatctatgctagggctggaagctgaggctggccgccagctgtgggctggggtggggtgggtggggtcgggtggtggagaggccttagctgtcctggctggtgcccctcccaggctccttttcaccctgccccctgggcctgaggccccctgtgtccaagcctccccctggctcttcagttctctagcccttggctttgctgggtttcctgactgtagccacatctctcccgctccctaagggtaacctagccaatggaagctgccctttgggtaggtgctgggctcctgggagggcccagatgatggggtgaggcatgtctttccagaactttccctggcagggaggggatggcagaaactcagggaggggcttggggcccattgtatctggagagcctggattcctcttggcagtcttaggcccggccacttctgctacctttgcgctgctgtgagcctcaccctgggcccctgggccctgcttctctgctcccctgggtgatgggtgggcccagaaggtggcagtcccacaccttgtcctcccacctccctgaactgtccattgcttttatagggtgaggtaagagacagcctcccaagcccaggctttggcactcagaatgggcccagtgggggctgggcaggcccattgagggccaccgccgaggtttctcctagggctgttcctgggcctggctcttacaggctcgtcccccaggcctgcccttctccactgccccctcctgtgtctgggtccacacacccttcaggaagggggagcactgagaagcacagcacaggggctcagcctgggatccggtgatggtctgggcagaggctgggtcaggagtcccaaaggtcagtgacagtttctcagaagaggcccagcgtccacctctctcccagggccagacaccccttcctggctcccccatccccctatgggctcccagccccttgcaccctcattgctgttcagattaaagcctctgttttgcacctgtcacttgtgtgaggtatgtcttttcatgtcacatgtttaacccatttctgcatgactgacctccatcaggtccccttctctcaggccacagtgtctgagacgagctgtttcaatttgggttgagcctttcctgggtttaaatcctagctgtctgcagtcccagctgcaaggttgtaagttactgaagcccctgagccccagcttcctcaattcacaaaatggggacagtcacagggtgactgccagcagtggacagcagatgtgaagtcctcagctcagggcctggcacatagcatatcccgggtggtcactgcagctgtgcttggtgaagggggcccctctggactcccaacttagccccaagctggccagggagcctttggatgggctttgacagtggaacatgcacctgtggtttgtgagggggtggccctctattctccctcctctgcccctcctgtccctgctgggctggagttgagggtctctggggctgctgtgccccagacttccttaagacactcttgctcagagaacaagggtccttgacctttctcttggccttagaggccttgcatggactggaaagcctcagcccctcatcaccttgcgctgcctcaggcacacccgagttcaaactgagcagctgctgcttactcaccaggaagtagagggccctcatggttgacttctctctgagcctcagcttcctgatctgaaaaatgggcataatgacgttcctatcattggtcttgaggattccttcatttcacaaatagtggctgcatgttcctcatgactgcagtgcacccagatatgacagtgttaggtagccggtggattatggagaaaataacgtcaattagagaaggcgttgatgggggcagggcagggggttacttgctctaaaaggtcctgtgagctgagaccctgaggacaagaaagagccgctgtggagagctcaggcctgggcctggagggctagggttgggtataggggccagactttcaggccggggccttgcgggctctgctgagtttggacagtgttctatgggaaggtgctggaaggttttgttggggagaaggggagataggaccatttgggaggttgtagttgtgattgggcacagggatagtggcctgggtgagggttcagagtgggatggtgggaagtggtccaatttaggctgcatttggtgtcgctaacaggaagggagttatgacagggagccgagcagccaagaaccccaattcttggcttgtgtggcttggtgccatttcctggggtggggggccctgagggagaggaattgctgtgggggcgcggaactgcctgttagcttctaagaggaggtgctgaggatgagggcgctggggtgggctgaagaggatggaggtggcgggcatggtgacgaggcgtagtgccaaatgggtggaacatgcagatgagggagaggagagggccggcttctgcacagaggagggtggagtgtgggcaggggacccaaagctgcaaatacaaggagcattggccctgggtgggctttcgtggggtgggggaggggggagcagggatgagaacgcagaccgcaccctgtgaggtctgcttgtcatggcacaggcccccaccctaggaggaagatgtggagggatggtctgctgcttgaggtggatactgaccagacatcactcgcttctcttctgagtttcactgtggtgggagtggggacgggagagtgggcagggtggtggccaagggactgccttgaaggtgggctctggtcagactggcaaggggctgcctcctgctgcatgctgggaaggtccaggagagcgggaggttgaagggagcgaggtcctgagaaggtaccggtggccttcacggggcaggtggctgaggcaggatgctcgtttctccctgtgggaggaaggcagaccctgcgccggtttggcggcgggttgggctgggtttatttttacagggaaatgtaaggcatgagggg

SEQ ID NO: 15667 - DNA, 22354 bp, Human
tggcactgtctactgccccagctctgctatcacttactctaggtgaactgtgaaataagaaggaaaaaagtgagggttttcagcccacacacatactcacgctcaaagggccccctttaccctgatcttctggttaaagacagtctcccagagttctaattgtctgtgtgcaccaggaagtgcccaccctcagctcaaggccacaagaaaaaaaaaaacgggaaaaccaggaaactcacttgcatgtaggtctctttcttcttcaggcgttggttctcttccacaaactgcttttttctctttacttttcagagttctttggtaattgttttttgtgttttgtcctgagtttttatttgtaatcagcaggagataggcactttaatgggcttatgctatcctggccacaatagaagttctcaagtggtttttaaataaaacatttaaaatggctgtgagttgcatctccatcatcagttggtccattgtggaccagtggtccacaatccagtggtccaatgattgtgataatcaaagcattagaaatctgttctgatataatgtcaacactcagtttctatgaaagcagattattttattggttgagatactcctaatagctttgaatatcttctgggtatcattactctccttactttttacattacatttacacatttctctctgttcatcttcagtatgcattctgaaaccaacaggacatcagagctggactgtggttttctttaattattcaagctaaattaccagaaatgcccttttaagatgaaatatttagtcgcttcaaaacaagtcaggttggaggaagagggcaggtttacttagctcatgtttttcatccttacaagcagtattgatgtttcatgctagcaaactgtggtagaagccttcgagtcctaaccaaaaacaattctttcttcaaaactcccgtaacactttatcaaaactcccataacactttattaaaagattaaaaatgtaaatcctaaggatagggtaacaagcactcttaagcactattggttttagtataaatttctagatgttcactgaaactttgtgtgtgtctgtgtttacatggcaatttgatgaactaagctaggaatatgatttttctggctcaaaaggtatgcaaaagattataggtataaacacgtgagagatatatatatatacatatatatatataatgcataccctttgaggcagaaatcacacttctaggtgtagttcatcagattggctgcttattttagccaaaaaatgggggtgggggccttcatatgcattaatggagtacagataattaaattacggtacagttatagtttctataaaatggaatgctacctagccattaatacgatacatattattaaagtggaaagctctataatattaaatggaaattgaggctactaaatataatacatcttcatatacgctaatggaggacagataattaaattatggcacagttatagattctataaaatggagtactacctagccattaatatgatacatattatttattaaaatggaaagctctgtaatagtggaaattgaagctaccaaatataattggtataatctctttttataaaagctataggtatacttatattgatatatggaggaaaataatttggaaggatagatatcaaaatagttatagtgatcattctcacagagccaagattaagaattaaaaaaatgtttttttgtttcctattaagtattgccaggtatttttttaaaatcatgacttatttaatttgagcaagagtaggagggacctatatcatgttggagaaaagatttctacattctaaagggtaaaagaactagaatctatgagaagaaggggcagggtgttacagatcacagttccttatatacaagtaaacttttaaactgtgactttttaacactaacatttaacagacctgacagtacaaaatgggttgcctgtaggtatgagttccacgtcactaaaaatgttcagacgtaagctccaaagccatttggtaagtttatcatggaagtaattgaagcatcagtttttttgacgttttgccttgggactctcttggtagatgattttaactgtgtgaaaagatgaatgaggggacttagaaaagcctttctgattctcatttccaaattcaaagagaattatatttcaacctgcttatcactaagaagataccagcatgttaaaattcacatgaagtatgaccttctttaaatacgctacgatgcagcaccctcaaaagtaaagtacagaaactgacagtagtggtatctgtctacagtttatcattggtgaataaatgaagggaagaaggaattgagtctggacttgccgcatatggaaccatgaactatacacatagaatgttgtttggggtcacaaagtagtagattaggccagtgattcctaaaccctgctgaacttcagaatccatcttcagagcttatagatatagacatattacatattttaatagactcttgggtcctgatcccacagatttagattaactagctctggaatagggcccagaaatcactatctttaaaagaattctcaagttgtgttgatgatcagccaagttcagacacgaccagaataaaatatatatacgtatacatacctacatatcaggacagttacaagaaaggagaaagcaaaataaagtattttgataaacacatcaagttcttttgagttactgatattttaaaaagctgtctcggtgagaagcccattaacattctacagctaagtgatgctacagccagtatttctgatgtttcattcagtccattaagcagagctgcttaaaagaactagttttatttatttatacatttataatcaggttcatgaatacagtcaacactatggaaattcttgtcaataaaaaagtgtttgtccacagactacacacagaaataaaattattagacctgcatcagtcaccgtctgagctggtcatgcccttaaaggaaatttcaaggaagatgggctgaagttggtgagatatctgctgatgtttaagatgtaagcaaggtggtatcttactcatgatcaggttaacaataacacatacattgaacagtttgagaattttgcatctttagctttatgtccaaatgatgaaaagggggtaaggaagaaatgatgaaaagggggaaatgatgaaaagggggaaaatgaaggcaacctgcaaaactgataatgaaaatagaacatgaaagtaactgtcatcacccactaacaaagcacctcatcttcctaaataacagagtcagccctctaagtcagtctgtcataagtgccagatttgttttctgaggccacttttggcacccgaattcctgaggtctagcttcaaatgagcatttcctccactgccagagtcctgcaggaggctgtagagatggatcccacagctggtccctgcactgacaggcatgctgtcgccggctcaggcattgtctagggcatgtcctgcttagaatgctcttcccctagaacctgcacggtagggagcagattcccagaaacccttcccatctttgttcacagccactttcccaacaaggcctgggatcatcttatttaaaactgtggcacctgtgctccccacccaccacctgatccacatctttttttccattgcacttaacacttttattgtaaacccagaattgacttgttatgtttattgttgatgtctgcgccctctgctaattacagagctttatttgctttgtccattgatgtaagtgtctagaatagtggctagcacttagtatataaatatgtgttgagtggatggataagtacatgatgtattgattgttcgattgttcattactagctatttatgccacatcaggcagttttcagtatagccttcagtattcacgtagttaaaaccatcccaaatatttgtgtttgaacaacgttgtctgtgaaatggaactgcctaggtcatgagtgcattttggagttctgctgttgagtcagagcatgctggcagtagtggctccgcttgtagaagtgaaacctcctgcttatgttttggccccatgagatctcataagatttcccccaacatttttggctttactcctgatgcacactttcatatctcttaaagatcagcctgttggacgttattcttagaacagtgctaagcactcagcaattaacctagtcaatgatatgtgttgactgtgggtgtgacccaccatgtctgttgtgatttttaacttcagagtatcttaggaattatccagtccagctcattttatacttcaagaaactcaggaaaccaagattaggttaatcttctaaattcacagtactagctagaggcagccccttctgggacaggagtcctagtctgtttggtttcttttttttttaaacccaccatattgctaaaacagatagcaacaccagcttcctcatgcagtgcagtcatctactgtcaacacaggtcttggcttctttcccttcagcgtctcacccatctttcttaaggaggatccagatttctccaaatgttaccttcatatgggaccctattctgtcaccccaatccagagccttcttagaatgcctttcccacaggggccagtatattctctcgagtgcccgctgtttgggaatgcttgcttttctgctttcctaggcccccatcaccatggatgttcagcacagggactctggagaagcacctggttagtgtctggtggctgctttgttgtttttgactcccatcttttttgcctgtctcttcctccagcttcaccctcaactcggtttgccctcaggagttctttacctcctttgatcagtttctccggctccttcttcaccctttgtggcttctcaaggccacatcactagagttaggaggggaaagaagcaagcaccctccttttatctagtacttcatttttttcagcattatctcatttgccctttacagcaaccctgtgttaagtgggaacagatactcttactccctttttactatcaaagaaatgaaatacagatatgtaaaggaaatgatctcattggcagaactggaagcagagcctccaaatctgggtgtagaatcttttctactgtcccaaattttaacagagagacaaaatttatcaccgtctggtattctgaaatgtacataatttttctcaacatcgtactcagtttaaaaatcttctgaggatattaatgtggatttctctagtgtctttagaaacttgattttagaaaaggccactgacaagttagtgatataataaacaggtcctctgatactgactgcattttcatctacatttaccagttattaaatgctgttatatgtggaactgtgtttgcaatattttatttactgttttgagaattaggttgatggtaagatttattcaaattcttgattttaataatgtatcaatacaacttaataatttgatttatttgcaagttttgaaaatccacatattctagtagatcctgaacttaactaaaagtgtaagaaatatttcacatataaaacatgatacaggctgggtgcggtggctcacgcctgtaatcccagcactttgggaggctgaggcgggcggatcacgaggtcaggagatcgagaccatcctagctaacacgatgaaaccctgtctctactaaatatacaaaaaattagtcgggcgtggtggtgggcgcctgtagtcccaggtactcaggagactgaggcaagagaatggcgtgaacccgggaggcggagcttgcagtgagcaaagatcatgccactgcactccagcctgggagacagagcgagactccgtctcaaaaaaaaaatatatatatatatatatttatatatttatatttatatatttatatagatatttatatatttatatatatttatatatatatttatatatatatttatatattatatatattgtatttaaacattctttaaaatatttatcatttatctcaactaatagaaagtgatcttatcactttttattattcatagacagactgaaatttgttttaacttaaattcaaccaatgttttacttaattttattaatgtttttaagttactccactgtcaagcaaagcattttaaagtacactgtgatgtatatactttcataagaaaaacgaaatgtaattacattttgcaagtaacacaaattggaagctgacattgtcctgacatggctggcagtgtctgctccctgccaagcttctctgtatagccaatcaagagagtttatatgcaaagtagcaaatacatggtgttttgtaatgcagctttattctcactgccacttgccctcctagaggccatgggatgcacaaattgtttgtatgtaagagtcctagaagatgttaaaaacccttgtgtcttatgttcagagctgtcagcatgatctaaggcccgaaatcgtaaggtacagtagtgtacagtaaatttatataaagtcctttgatataaattgaagttgtccaaattcatttcctataaaatgataatatccaaattctaggtttgcctttgatgttgttccttccactcatttttaagttgttttcatgtttcacattgccaaatggcacactacctggagtatgccctcttgttgagaccattcttagtttgatatagtgtcaaagaaaaaaagtgagaatgttgggaatttggtttgctttacaagttaggatgagtggagagaaccctcttgacaggatgaagaaatctgtggaagtatcatagcgaacaataaccacctgcctattatccactttcctgaatgataaaaattgtctatgcatcctgcctcaaaggcttgaccatggggtggttttctcttctgacagattagctgtttccagtcacatttgttatcacttttgtgcgatcttgctgtttagctcctttaaatcagaaatacattctgcttatgggaagacacacacacacaaacacacacacacacagatttatactaaaatcacaaaaaccttttaaaatgtcttgtgaaaatatattagctatctttcttagaacaaacataaagaagaatagtaaataaatgtgcagtccagcaccagtgttgacatctgttgtgaaatgtgctacatggagtaaccattgtagagacaatcatcttaggcaccaaaatgacttaggagcttctttctttgttctttcttatcacttactatttttattagtttagctttttccaaacgtgtttactcagagatacctattttagttaggaagaaaaagagaaataacaccaattaaagctaattgaggctgaattcttgtcagtcttaaaagaatcctaattgtttctctttgaactgactaatccataaaagttttctgaagggatggggtgtggttgtatttgatagcttccatttggatgatttctactaccttttttcttgtttgagaactattagaacgaacatgatcattttttcaagctggagtgcggtggcacgatctcagctcactgcaacctctgcctcccaggttcaagcgattctcctgtctcagcctcccgagtagctggaactacaggcacctgccaccacacccagctgatttttgtatgaacatgatcaattttatacacatagaacatagtaaaatgctgataattataagttgtttgtttactcattgtagctatttactgtgtgatcaactgtgaaattttgtgcaaccctctctcagaatggaaaaaaaagaggatttagtctgagtttctgagaataattttccaagtatatctggaaaggtaaattgattttaaaggatatataattgattaattaaaacatcatttcataaaactcattttatcatccactgtgagagcagcttcaaatgccctcagatctaagtatcaagccaagtggtacaaatcattttcatgcaactgaagataccatttatgttggaatagcccccaaaaacgaaaatacacgtgacctgtttaactttgtgctaactgttacaatgtatgtgtgttttgtttattctctcataggtatgagaaagtgccagtcatcttggttgggaacaaagtggacctggaaagtgagagagaagtatcgtccagcgaaggcagagcccttgctgaagagtggggctgcccctttatggaaacttccgctaagagtaaaacaatggtggacgaactctttgcagaaattgtgaggcagatgaactatgctgctcagcctgacaaagatgacccatgctgttctgcatgtaacatacaatagcatccaaatatggctgtcctggatgggatttgcccaatgtcgtaggtgatagaaaactcgcctactccactgcagaacttgcagaatgcgtggtgttaatctacagagaactgcagcccttattcagaattgagcagtgattgtcagttgatatctctgagtaacatttgggttcagtaactacagttttcaccatttgtcctcagtctcctttatgcatctgcaactttaaggcatagtccatcgatctacagggtgatctcatttgaaagctatgatggcattgtcgctgagttgacagaagcaactattgtacaaattaaaaataaccataagggagaaaccagaagaattcctctgaccacttacaattaaaatattttgtcttctttaaaaaaataagtaaaggagaaatattttcctacaagagtactgaatttcaggaaatgggatagagcttctaaccagtgtattccgtcaagtaagataataacagctgacctgccaacagcattacagggagattctttgctcagctaacacatttctgtttttcaaaattgatgcttaattgtagctgttattctaatttgtgacatggaactaactcatgcttcaatccttgatagagcaaaactcagaacaggttatgtaaaaatatagtctggctttagaatttgttaattcacctgctttgccacagaaaatggaggctttcacaagggtttgatcagaattaaaaccccaaacccgccctctgttaggggtggtctttataactttactgaacaagagggaagcaactgtgatgggaagagattacctagccttactaacaagaagcattctaatagataaactagtaccatcatgtaaggaagatgaagccatgttgcatccacatgttcccgtttgcagaaacctcacaggacagtacgaatatctggcatttttaagttcattaaagcagcaaattccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctttagctcttgtgataagattttcttttttttacttttatacaaaggcagcatctttgaatttttttttcttttgatgttgcaacttttgggttcttttaaactgtgatagtgatggtaactgatgcctttcattttgttcaacttacacaaaacaagccagcatctgatcaaaagtattacataaaatattttcttaaactattgaaaggtgctttgatgattttctcctttggtttgtagaattaggactgaacttttgactcaaattgctacagttgccatcacctttctgtggtaatactactgatatttgcttttctatataaagaaatgttgcctaaggctgtctggtatttcttttcaagggttttccagtatgaatgttaatgttgtcagtgtatgtatgaatatgaaagtgctttgttttgtttgttgctgttttttgtttatgtgtgtgtttttaatttttttgttcttatcagcagtcttgtgttagcactgggtaagctttaattgtcccttagccaatcaaacattaaggactatggaggtctttttttttttatttaacatgtcattgttcatctattaaatcttgatcagggtttcaagaatgactgcagtgggttttggaaacagacttatcattattgatttgaggtttcccagagatatagttcacagttaattgttgcgctctaatacaactgaccatttaaaattgaacaagtttattgttttgtaacaatgtcagttgttaaaccttgacatttcaattaaaacatgaattgtagttataactcaatgcaaattcaacagttgtatttggagttaaattattttaacaaataaatttatttaatgaaactctggatttgctttgttttgtacatgctcatgagagaaatgtattatatacaaaaacaattaaaaattgccatataatgaatttagtactcttcatacaaaaatattttagctgatttgagagttcatcatataaaaaggcaggtaggtagataattttcatagtctttaaaaataaaaataacatgtaagagactgtaaaatcagttattataaatataaacttatctctacaaatgattttatattttgaatggtagctggttaatttaaagcctgatgctaaggttaacagaattgttcaaataattaacattaattagcaatatcactaaaatgattcagaggccttctagtgatggcttgaagccgtctttctgttttcaggtcatgtggatccgaaggtgccagaagctgaaggttgccgccaggctgtagggcctgcttgttctatatggggccctatgaaagttgacagatgctgttaattgtatacagccttcagctgctctgataaggagcccattcatttcctaagccaatttaaactatgccttttggttatgttgccttcaaactctgttgaaatcctctggcagcattccaccagttgagaagcttcattgttttagattataagaataatttgaatgaatataacagaggcactgtagatagaatcccagatatttaaaggaaaacatgcctatattttaggaatatcttctgaagaacttcataattttatttgaagtgtttgtaaattttttaataaattatttaaatgtatcaatagtggatagttggaagaacgtctttgaggctaaaaagtagtactctgaaattctctcaagttatattatttgtctgttagaggtccacgaatgaaaatatatgtagctaaaggagtaaggtgctgcccaatttggaacccaactgacctctaggatctatgaagcagagaatattaccacaaacttctgaaagaagctgttgacctcgtttcttaatttaaaatatgttgccacataaatactaataaaacatagttgctcttcatctcttaaatggatcattccaactggttttacatcgttgaatattatctagtatttttaataaatattttcataaatagtttttgtggtttttttgtttgtttttgagacagtctcgctctgtcacccaggctggagtgcagtggtgtgatctttgctcactgcaagctccctcccgggttcacaccactctcctgcctcagcctcccaagtagctgggaccacaggtgcccatcaccatgcctggctaattttttgtattttttagtagagacggggtttcaccatgttagccaggatggtctcgatctcctgaccttgtgatcctcccaccttggcctcccaaagtgctgggatcacaggcgtgagccaccatgcctggcctataaatagtttttagataatattcaacatccccaacatcgaggtattgagttttaaaagatttgctgctattctaggtaagacgctgtgttatttctttctatattttcttagtagtcttcatgttagcctctaaggattcctccaagatttctcagcagagaaaaaggtagaggactagctgcttgaaagagtaaatacgaagacctatttagtatgtatgagttgggaataaaactgaaggaaagattcttggtttagcttatggggattttttagtataagatcctcccattttaaaaacttcagtatcaatgattcatatttacagttttacactattttgagtgtgatgtgcttttatacctttaaaaacatcaggattagtgaagggaagaaaaggtcaccccaagaggatcatgaggtcaggagattgagaccatcctggctaacacggtgaaaccctgtctctactaaaaatacaaaaaattagccaggcgtggtggcacacacctgtaatcccagctactcgggaggctgagggaggagaatcacctgaacctgggaggcagaggttgccatgagccgagatcgcaccactgcactccagcgtgggtgacagagggagactccttcttaaaaaaaaaaaaaaaaagtcaccccaactttcagttccccaaaacagccatgttaacaatggatgtaaatcattcccagcatcttcctatgcacatatacatatgcaagtacgtgaacataggtagaaggataaataactcgatgttacttttgagaaactggctctaagtactaaaaatgaatcactgaaagtcacacagctaataaagtggcagagttgagtttctaactctgccacttaatttctaattcttctaacaagctcctaactctaaatgaccttttccccactgttaatcctttcacttaaattgaatccactcattccatgctcattcagctattattttttgagaggttacacttgcatctggcactgccacaatacagagatggtcatctacacataaaccctgatgtcaaagacatcctagtcctgtcttcttgccattcctttttctcttaaggcagatacagtttagtttactagcaagaaataatttgtaccttccctactttcacatgtcagcatcccagtaaacccaggctgagccgaaattccagacacagccccagagactgctgctggctctgttcacttttcaagatcggtgcatcagcctgagctagtccctcccgggatcttgaggtgtctgtgggacacagtagacggggatggcaatacagcagggcttcaaggctctactgttacaggctgggtctacttctcaggaagaattcagagtaaaaataggattagtgaggggcagtggggatacagaggcaggttggggacagcagggcaaagggttctatgtatcagatactacactgaagaataaatgctgggtccatgcctatagttaaataccaggtgtttttaggtttcagtgagtttttttagtttaaaatgttggtttgttcacagcacagctctgtagtgtgttctgaagaggtcttataccatgagagggtttgctgaaaacgatgatagagtcaagcaagtttgggaaaccccacataacacatctcacatcttggaaaaaactcaaattccactcatgtctcaaaaataactagaccccaggacactttctttcaattatacatagtagcactctctggagcacaatttggaaaatgctgctattagatatttggcctccaaatgctgatgtgggaactctgtccaggtgaggggacctggatcggttgtgagcgtgagaattcctctgacccctgtagtctctagagggatggcagagaaagggagagggttgggtgcaatagctcatgcctgtaatcccagcactgtgggaggccaaggtgagtggatcatttgaggtcagaagttcaagaccagcctggccaacatggtgaaaccctgtctctacttaaagtacaaaaattagccaagcgtggtggtacatgcctgtagtcccagctactctagagggtgaggcagaagaattgcttgaacctgggaggcagaggttgtagtgagccgagatcaggccactgccctccagcctgggtggcagagggagaccccatcctaaaaaaaaaaaagaaaagaaaagagagagggagaagaggagaggaggcaatctacagttgatggacattggagtcattcccagtttgagtctatcatgaataaagctgctatgaacatctgtgtacatgacttttggtggatagacacaatactcactcctaggtcactatctaggaggggaattgctgaactacaagacttgattgtcaactttggtaaacattgatagttttatcaagtggttgtaccagtttacataaacaagcaacgtgtgagtactccagttgcaccatgtcacaggatggattgcctgggaagagggctgtgatacagagcttagtgtgcaggatgcttattaccaaatgtccttgggattaactcctgtggaagggagtagaggaagtaagattggccagagggagaagttgtgtgatgcagggccaacaacccccagacagagggagttagaatggggcccttagaattgtcctgagttgggctcagatggtttagtcctctgtaccctctgcctgtcagtcactgtgaccttgaacaagatgcagaggcaatccctgaaggatcagagagtgaaggttgtcagcattctcagcagcagggcagcagttacttgactgaaaggaggtccaggtggtgcctcatggcatctaccaactccaccttccacacacatacctggcactgtcaggctttgtcatttttcatttcattattctggtgggagcgtggtggtatggcattgtggatttcacttcatgtttctctaaggccaatatatttatatgcttattggtcattggttaccctcttttgtgaaatggctatttatgttttttgcccattgagtaaatgttttgtttactgtttcatgaagtgactcaaaaaagatttatttaatcttttacttacatatttgtaggagttctttacattttctggacacgtgtttataagtacagtgtactatcccagtctgaagcttgccttttcacactcttgttgatatctcctgataaacagaagtcctcacttttaatgaagtcaatgcaccaatcttttatttgatggttaactgtttttgtgttcttttaaagaaatctttgcctactttagggttgttcttgacctccagcccctcaggggtatgctgagttgaccttatgaatatgataataggaaaataaccattgtaatcatacagtttattgaacagtgatacaccaaccatcatcatcagtctttgtttcatattattgatgaaatatttaaacattaatagagctggctcttggccagtgtttctgcaaatgtgttccatcaagtactaatgttgaataggaaaaagatttccatggtcgaataagtttgagaaacacctgcttaaacaaagttaaataggctcttgtggttttcaatatcctaatgtggattatgtaacattgtgagatataaatacattatgttctgcaaactatttaaccataggatgctagcttttcttagaacatgtcacaggactagtatttcatagtttggtaaatacttcgcaaggcaaagggtatgatgtccaacaaaaaacagcttaataaaaaactgaatctgagagttcatagtgaaattaaaaaataataataaggatgagccatttataggatactagctaatagatatggaaaacagaaccaagaagtcatcccttccaatcctccacatcaaagtagattcagggaaggatcagcaatcagcaatgctgaggccattgggtggaagggttagagggaaacatatattcacaaattacttcttacttgccaagggaaagaggtagcctttcagtgataagaactggcggacaccacatgaaccaggtgatcaaaccaagcactaccaacaaagggacaaaagtctatcatgggcccctctatgacacaaaaggaagcacccaatgtcacctatgtggtatcttcacctggatcgaatcatggagaaacaatcagacaaatccacatcatgagacacgccacaaaaataggtttggatgcttccaaactgtcaatgtcttgaaagacaaaaataatgggatggggggttaaggggctgtgctagatataaggagactaaagagattttttttaaagaaaataatgcatcctaacatttttccaacctccatctttcaaatgtgcaacatagctccatcaaattctactgtgtatagagactctcaaaagaaggaaaatgtggccctccccttaacaggatgcatcagaatccatgtggcggccaggcgtggtggctcacgcctgtaatcccagcactttgggaggctgaggcgggtggatcacgaggtcaggagatcgaggccatcctggctaacaacatggtgaaatcctgtctctactaaaaatacaaaaaattagccgggtgtggtggtgggcgcctatagtctcagctactcaggaggctgaggcaggagaatggcgtgaacccagaaggcggagcctgcagtgagccaagatggcaccactacactccagtatgggtgacagagtgagactccgtctcaaaaaaacaaacaaacaaacaaaaaatacatgtggctcactgtagaaaaagccagtctttcccctgccctggaaatctgggaacctccttccattgcagattgagctctactcctttcccactgagaatccctggattaagctaggtgttccttgtaacataagtgagactctcaatactcactgcccagagagcccgactgctgatcttttgctgcctttatggttgaccaaggcactgctgtcctggggcaacagcaagagcaaaccagtaattgcagagtttatgccatgaaagctgaatggaagaggtggggctagacatgtatgggccccttaaaccaattcagctgtgtctactcttccttccctgctccttccctcttttcattccttcttttgcctcatgtgccacgaggacctttctgtagccccgtgtcagtggattttctccacatcctaaacatagacaattgctaattaagtcattcacattatttccgtttgagaatgattttggcctgttgattgtttttctagcaataaacatctttctggaagaggaattagctcacttgagcagctggtttcaacaactccctgcattttccttcagcacccagggacatgtgatttgtaactaaaacaaaataaaaatgcacaaactcttctcattcactcataccaatagtattcgctgtgtaattttttcaaatgaccgacttctttccaaatatacacaacaaaactggtcagcattaaaactgcgaggacagtggttgtcactgtttgccattagatctgtcaactcctttgtggagcctctcaaagctgcccatggccatagccttgggcctggggttggagtggagaagagctggcagaaatggctgcggactggaacccggctggagaaccagggcaggtacttcttgggaaggaccaagggagagtccttaaagggtaacctgacagcgtcctcagggaggaaatgtgatcctaagtggaaaaccataaataatgactcctctgctcacgactcaaaggaattccaaatagtagcaacagaatacatctttccttttcatcttatctgaagagttgctaatgtttctttaagatgactgtgtcctctttttcttcatacaatgacttgtcacttcagtcctgaacaaatattgtctgatatattagcatatcagtggcttagaaaaatataaaggtaaaatgtactagagctgaacaatatagatcccctagtcactcacttttaattacatttggatggattattcattgccatggaaactctctacccttaccaaaatttttaggcaaggatctcctccaagtttcacagttctgtgtcttaaagacatttcttgttctatttatgagtttagaagctatgcggcaatttcccattgggatagcatgcaactgtagctgctgtcagttgctcaagacagttaatataaaagatattgcaccagagattgtgagtgaagtagtgggtgtaccaacacattccatgattccagcactggttttgaccgccaccttataattttttcacccaaggtccagctctaccaagtacaatatgcttttaaggctattaaccagggtggccttacatcagtagctgtcagaaagaaagattgtgcagtaattgtcacacacaagatagtacctgacaaattattggattccaggactcacttattcaagatgaccaaaaacactggccgtgtgatcacaggagtgacagctgacagcagatcccgggaacagagggcgcaatataaggcagctaattgcaaatacaagtatggctattagattcctgtggacatgctgtgtaaaaggaattgctgatattactcgggtctatacacagaatgctgaaatgaggcctcttggttgttgtatgattttaattagtatatttgaagaactaggccctcgggtgtacaagtgtgatgctgcaggttactactgtgggtttaaagccactgcagcaggagttaaacaagccgagtcaaccagcttccttgaagtgaagaagaaatttgcctggacatttgaacacagtggcaaccgcaattacatgcctttctactgtgctatcaatgatctaaaatcttcagagacagaaattcgagtagttacagttgaaattcctgaattcaggattcttacatgagcagagactgactgcaccttgttgtttcagcagagactaaacattgtccttagtttaccaaatccgtgatgtcacttcctctgtgtttggtaacaacaaaccaactttatggaggtctctggattgaaaaaggaggctctcccgctcctcctaccactgaagaggttaggactctgtattagtaaaaacaatgctttttgggaaaaatgtaaaaactaaaaaacgatcgtttgctttctattgctacagattctttctatatgaaactacttcctttattgtctttggttcagttgattcattaaatggctctttccaatatggtagccattggccacatccatgtatggctatttaaatgtatattattaaacttaaataaaattaaaatacagttattcagtagcactagccacatttcaagtcacattagccacattctaagagttcaatagccataggtaggtagtggctacacattagtgtgatatacagcatttccatcattgcagaacattctattaaacagtattacaaataaaagtttgcttatatcagaactactcaattttatttgttcaaaaacaataagggactagaaacatatatgcagagctagctttatgtgtaaacaaccctacacttagaagaaatcaaagctcggttcagtgctctgttgtagtcctgaaatttttaataattttgaacaaggctctgagttcatgcacaaggctcttcaaattaagcagccagtcttgcactatataagatgaagcttggctgttgaattcttagttttcacttcccctgcaattggttcttttccagctgcctttttttttagagcaaggaagaacagttgacacatgagataaaattcaggtgcctggaatcctttagaccacctcaacagtcttatcagggatccagctttaaataacacctcttaggaatgataaaagcctaaaacaatgttttggcaattccaatactaagaaaaagtttagcttctcttagtaacaggtgttttctaccatgaaatctgagttgcccacaatggaatccctttctcttatacagccttgccagagctctttttttttttttttttttttttttttttttcagacagagtctcgctctgtcgccagactggagtgcagtggcacaatctcgactcactgcaatctccacctcccgggttcaagcaattcccctgcctcagcctccgagtagctgggactacaggcgcgcaccaccacacctggctaattttttttattttagtagagatggggtttcaccacgttggccaggatggtctcgatctcctgaccttgcaatccgactgcctcggcctcccaaagtgctgggattacaggcatgagccaccgtgcctggcctgccagagctcatttttaagatttagcctgacttgttttattcttcatccactcattcctttattcttataacccttcattcaacaaatatgaagcatctattatgtatgagacactgttacaggtctgaataaaaaattatgtggcacatacctactgttgctatctggtaaattatgtgctgcaattaacccaacattaataacagaaacaggaggacagtaaaatcaaaggcagcctgagtatcatcaaggatttattagctactctccatgtttccatggtcacattaaaacaacaaaacagaaagaatgaacaattcctactgattcatgtactatgttataaagaggaaaatttcccaaacaaattttggttagtttttttttttaaatataccaaccagatgaagaaaaaatagcacagataataataatattagtgataattttgcaattaatactaaagtcactttcacttgtattaggaactcattgcatgatgtacctttctgaaaaatttgattcccaattatgtttgaattaaactaacatttgcattggtgctgccttcctgggctcatatggttcaggtatgt

SEQ ID NO: 15668 - DNA, 8971 bp, Human
aggggggcgtggatgacttgaggtcaggagttcgagaccagccaggccaacagggtgaaaccccatctctactaaaatacaaaaaaaaaaaaaaaaaaaaaaaaaaaagccgggcttgatggctcatgcctgtgatcccagctattcgggaggctgaggcaggagaccaggagggggaggttgcagtgagccgagatcgcaccactgcactccagcctgggcaacagagtgagactcactcttcaaataaaataaaataaaataaaataaaataaaataaacaaccaaaaaaccctaggtctccacaaccccttatcataacccagatattcctttctatagataataactcttgtaaccaactgccaatcaggatatgtttaaatctacctgtgacttggaagcccctcccctttgagttgtcccgcccttccagaatagacattgaacagacatttccccaaaggagacaaatggccaataagcacatcaaatcaatgtcaatcttgcatgtattgacttatgtattatgtcttcctgaaatgtataaaggctgactatgccccgaccatcttgggcacatgttgtaggacctcctgaggctgtcaccaccatgtccttaacattggcaaaataaactttctaaattgacttgagacttgtctcagatacttggttcacataggtttcttttaggggcgatgaaaatgttccataaaccactctacctaaaattaggtagtgatgatggctgctcaactgtgaatataccaaaaaacactgaattgtacactataaaaggatgagttttatggtatgttattaaaagttgtttaaaagtgagggacccctccagttattgatatggaatgatcttcaggaaaagagcataatatgctacatttttgtacaccaaaggggaggtaggtacgaatatgcatacatattgcttttttctagaagccgcctaggagtgaaaccaaaattcttcacttcttttcggccctacctcgagctccctttagaaaacctttccttccagctcacagtatccaccatgtccaccttcgcctcccggcactgagccttagaggggcggtgctccataaacatttgctacatgaatgaacgaatcaactatcggattttggggtgggtcgggacagctcggttccagcgagggctccgcccacccgcgggctccgcagaggagcagaggttgggcggccgcctcggttaactccgctgcagcccaaagcacgggaatcgcgggacagacaaacgagcggagggaagatacctagaagccaggaaaccgcgagctgcagtccaacttggccggaagctgcggagaggctcagccaccggaagtcagtggagggttcggccggacgctctagaatcccggaggaccgggatctctgtggttggccgtgacgggcaccctctaccggggatgacacattcccagagctcctgggaccaagcaaatggcggacacaattccctgggcggaaggggacttcgggagccagtagccaaggtaacagtcccagacctgggcatctcaggccgggcagttccccgagctcacgggactagctgtgattggccggatgaggttgagagcttcatggggacgcgcgcgctacgtgcaggggcgttgccttccattcacttggcgcccgactgccagtgcgcatgcgtttgaaggcggtgcagggcggggagcacacccctgcgaagtgccgggcaccctttgggcggctcccgccggcgagctggacagcggcgcgcgccaggcgtggctttctcggccggtgggctaggattggacgcagtaggtagaaggggcaggaccctccgcagcagtagctcagcgattggccaggagctggagggagcgtggccttgggaggcggggcggagggggacggacagggcagctcaagacgcggaggtggtggctgcggcctttgaacaagtaagtgagccaccctcggagacccccgcgctggggacgggaggccggcgagcctcgggacctctgaaagccttgaggaggcgcgggggtgagtgcggccctgaggaaacccaggtgccccgcccctccctttcttcctggcccgcgcctcgcctacccctcccccgaccctggcgggcccccggctctgggcccggacccctggggtagctagtctgccacgaaccagccgcgcgcttctgcccttgtcggtttaggaaactgggaagttccctggtcctgctccccagcccgcagaggggacactgaggcccacggtaggtggtcctctcctcacccgagtctccacacagacaccatggccgagcctctgaaggaggaagacggcgaggacggctctgcggagccccccgggcccgtgaaggccgaacccgcccacaccgctgcctctgtagcggccaagaacctggccctgcttaaagcccgctccttcgatgtgacctttgacgtgggcgacgagtacgagatcatcgagaccataggcaacggggcctatggagtggtgtcctccgcccgccgccgcctcaccggtgagcttcctgagccgtcgcctcccagatgtggcagcgtcgcagggagtgggaaaccggcctgtcccagacagccgggaaggaaagcggggtgcgagttctggctccagtcaacacacactgaccagggccttctgcctgccaggctccggggaggctcggttctctgaaactccggcctggtggttttgccatcctgcctgcctacttcctccttaggaaaatgatagtcccagttagaccagaatggagagccagtccttcgtgtctaagagagaaatgtgttctggagccagacactggcataaggaactggtggtgggatgggtgaggtctgagatggagagggtgtaggcataagaggctgagctacaccactgggcatccgtgcaacctccaacaagttactaagccatatttccttctctttaacgttgacctattgggacctgccccgcaggggagttgtgaaggtaacatttaataatgtaggtaacatgcttagcacagggcttggcacatagtaggtacccaatacttggtagctgttgtcatttgcatcctagaagggaggtgttgataggggctgagtcgactctgcagtttctccaaggtatcctctggtatgtcccttttccctgctcctcaggccagcaggtggccatcaagaagatccctaatgctttcgatgtggtgaccaatgccaagcggaccctcagggagctgaagatcctcaagcactttaaacacgacaacatcatcgccatcaaggacatcctgaggcccaccgtgccctatggcgaattcaaatctgtgtaagaagcgggatgggagagggagccagacttgggacttttctgaaggctgcaaccatgttgccgaagttctggaaaggcagctgaatctaatctgaagcaggctgggaaaattcccgcagttctaggaccagttctttagagttttgccagggacaactgttattcctcaagaagtgtacagatgattttacagttttatagaatcttagtatataggatgtcaaatgtaggacattcctactatgaccacaccctcctattcccatagcagacttcactaatcaatcacagaacactttcctacagacagtggacaagcctggtcaattttcatcatagttcttcaagctgccactaccaaacaatggagatagccccaaaaggaaacctattggccagccctggtgtagtccaaccccatcttttatctgatggggaaactaggtctggagacaaaagtgatttaaccaagttcatggaaaagtcgtagagaatctaaaacgtgatgctcttcttccataccatgccgtcagcccctatggggtcccagggtaaggctgttacctgtctggaatcggaagggtgtggtgaggatggggcttgtccctggagtgtgatcaggccaacccatgcttctctccttccttccccttccagctacgtggtcctggacctgatggaaagcgacctgcaccagatcatccactcctcacagcccctcacactggaacacgtgcgctacttcctgtaccaactgctgcggggcctgaagtacatgcactcggctcaggtcatccaccgtgacctgaagccctccaacctattggtgaatgagaactgtgagctcaagattggtgactttggtatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagaggtgccttgtgggcaggtcgggtgggcagaggggagacttggacttggacaaggcttcaggcttttaccttctcccctgcccaacttccccgcagatggccccagcgcacccctggaggctcctgagcctcggaagccggtgacagcccaggagcgccagcgggagcgggaggagaagcggcggaggcggcaagaacgagccaaggagcgggagaaacggcggcaggagcgggagcgaaaggaacggggggctggggcctctgggggcccctccactgaccccttggctggactagtgctcagtgacaatgacagaagcctgttggaacgctggactcgaatggcccggcccgcagccccagccctcacctctgtgccggcccctgccccagcgccaacgccaaccccaaccccagtccaacctaccagtcctcctcctggccctgtagcccagcccactggcccgcaaccacaatctgcgggctctacctctggccctgtaccccagcctgcctgcccaccccctggccctgcaccccaccccactggccctcctgggcccatccctgtccccgcgccaccccagattgccacctccaccagcctcctggctgcccagtcacttgtgccaccccctgggctgcctggctccagcaccccaggagttttgccttacttcccacctggcctgccgcccccagacgccgggggagcccctcagtcttccatgtcagagtcacctgatgtcaaccttgtgacccagcagctatctaagtcacaggtgagagggaggcccaggccatggggacacctgggtctgggccaaaggaaaatgggttcaggaagcggtcagtgttccacaaaaactgagcagcagatggggctttatctctgaacgtgtcctcttgctcacagaaggagcataatggcaatgaagaggttgttaggagacaagttaaatatggcctgcaaagtgcctagcccagagatggggccagccagcactcactgactgccgagactggtgttagcactcccagatatccaggcggagtagtcagcagcattgggacagggtggcctacagacctcagtctgtctgcattgtaacctgtcattccctgcaggtggaggaccccctgccccctgtgttctcaggcacaccaaagggcagtggggctggctacggtgttggctttgacctggaggaattcttaaaccagtctttcgacatgggcgtggctgatgggccacaggatgggtaaggtggctggactgagctcctagactgggactgtggggagaggttcctggtgcaggagacatgcacctgtgggatgggtgagggtccagcctaggctaatagcacccctccctttccttcccctgcagccaggcagattcagcctctctctcagcctccctgcttgctgactggctcgaaggccatggcatgaaccctgccgatattgagtccctgcagcgtgagatccagatggactccccaatgctgctggctgacctgcctgacctccaggacccctgaggcccccagcctgtgccttgctgccacagtagacctagttccaggatccatgggagcattctcaaaggctttagccctggacccagcaggtgaggctcggcttggattattctgcaggttcatctcagacccacctttcagccttaagcagccacctgagccaccaccgagccatggcaggatcgggagaccccaactccccctgaacaatccttttcagtattatatttttattattattatgttattattacactgtctttttgccatcaaaatgaggcctgtgaaatacaaggttcccttctgcacctgactccaggtgtaatttttggagttcggggtaggacaccatcagcaggggagcaaggaggagccaggtgcctacatttgggggataaacaaatatgtttgtgtgtatgaagccagttcattcaggttctgaaggtttattgagaccttcagtccctacccactcccagccctgcagagattgtcctctgctccctcatgtggctaaacctctcaacacccagagggtatggggaagacctcatatgcatgcctaccttggctgtggctgtttcagggtggtgtgcggtagctgtgttcttggcatagagcttcaggggctgggatgggccatcaggggaagctgagtatgatagtgaggtgggctggggttccacggtactcaccacaggggagtaagttggtgggagggatgctgaagatgggacatggtttgagagcagcccagaggagtgctgggctgtggcctagaatacaccatgggccctgttcacactgcactgctcagcttagcacactagggtggcccagacaggggtccacagtgaggaagcaggacaagatggaccacaaaggcctgcagctgggagagtggctcctggctgtcagctgttgggacagggtggaggcaactcattctcatggagcccagccaggtccaggctagaaccatgtgcctctcggaagaggcctggggaactgctggcagtgtaacttcaggtgtaggggagccgggtctggcttaggaatggatgccctgggtgtgtgacagggatgtggcatggctgagagccacaaggcccccttgtaaggagttggtgctcgggaatcagcagaagcatgcatcaggggcagcagagggagcactcatggagaccatgggtgtccaggggaggaaaggtgcctgagggggccagcccttcaggcccggcggattttcatctcagtgcgtttgagggagtagtagaagcccttccactgggcccagttgatgccattggcataagagaggtgggagccacctaggtagaagccattgaggttggcaaagtggcagctgcggaaccagaaggctcctgaggagagagctgcgcagttctgcacaaagaggtcctggtcccggtcgaaggtagagaacttctggccactgtggtaggacagggagtcacctggcagaggagagaagggttggggctgctgaggcagggaactgagccccgagctggccgggagagggtgacaatgacgactgtgagagatatcacgtggcagcctggcgggatgggggcaccctccctgagccagatgttgggttgatgtgcttctgcaatgaagagaaacagctgctccaccacagagttgcctggagcagggccaggatggctgctccccagggctgaggcccaagctggtttgagctggtttggagccagctgtggcccttccagatccagaagggttgaaggaggggcctgaaggaggttggggctgactgggcagggccagccctgccttctttcccctcacagcccctcccaaagctaacagcgggttatacctgccccgccatcctcaaagcctgccacaaagagggtgtagccatcctcctctgcgctgaccgcgttcggggagatggagaagtcagcgtacttggcataggccgtgttgttctcaaagtcctccaagtccactcgcagctcatacttctgcttcagtgtcaggaggtgcatgttctgcagccctggggaggaggggcagctggtcaacaaggacctggccctggggcagcccctcagcccacctggtccctgccttacccagccagtactctccatcagcacggccgaagcccagcttgtagtcattccagccgcggaagaaacttactgagccattgaatctcttctggaaaacctggagcagagaagatgagactggatcatcaagggtccaatgggcaaggttctggtcctgccctgcccacctcaa

SEQ ID NO: 15669 - DNA, 4935 bp, Human
cccagattcgaggttagtcaggagtcacatggtggattagcatctgaaatagagttacccttgtccccacagctgctgtggttttacaacagcagatcagaaaaaaggtccccttcaaacctcgtattgaaatttagatccccaatgcggcaattttgggagataggccctggtgggaggggtttcagtcatgggggtggatccctcatgaatgaattaatgtcctcccattagttcacaagagagctggttgttaaaaggagcctgggccagtgtgatggttcgcatctctaatcccaacactttaggatgccaagacaggaggattgcttgatgccaagacaggaggattgcttgaggccaagtattcaagaccagcctgggcaacacagacattgcaacatccctgtctttaccaaaaaggaaaaaattagccagccatggtggcatgcacctatgggcctagttactcaagaggctgacgtgggaagatagcttgagcccaggagttcaaggttacagtgtccagcctgggtgacagaataagaccacgtctcaaaaaacaaagaaacaaacaaaccagcctgggacctcctccctgctttgcttcctcttcagcatgtgtgatctctttgcacatgccgattcccctttcacattccaccttgagctgaagcagcctgagaccctcaccagaggcccaatcttgaactttccagccaccagaattgcaagctaaataaacctcttttcttcataaactacccagtctccagtattctgttagagtaacactaaacctctgcctcacttgttcaacctttcattaaatatatttgtgttgaacacctttttgacacccagttctgtacatcttttgacctgatatgatcttttggagtaaagaatagaggaattggggtgacatcagcaagatggcagaataggaagcccccacccttgtttccttcacagtgacaccaaattaacaacaatatatagaccaaaatacctttatgagaactctagaaaccagtgaggaagttgcagtaccccaaggcaagatcaagccaagaacagtgcattgaaatcagtaagaagagccatttcactttatctgcaattgtccctgtcccaagctagcacagctcggcttttctcatggcttctcccttaggttagagggaggggagagaagagtgcccagcgttccagcttctcagaaggctgcccagaaaactagtttctgtcttacttgactcagggcactaatggaaccagaatagtttggatgcctggaggatgctgaaagcaagggagaatggggtggcttactgtgccaccagaaggcctgaagtgcggcacacagaggatggcatgactcagggtaactgggaggtgctcaactcataggtcttcccttggcagggaggtagaagagtgggctgtttggctggctgtccagcttttcagagagctgctccaaggactggtgaatgtctcatctgatctaggggagctgacagggaaccagcatactttggatggggcctctgaaaacaaaggagaggagagtggcttgctgctgtggcaccagggaacctgcagttctagagacagacaccagagggagccaaagattatgatcttctgaaaaagaaactggcaaacctctctaactggaaaattacaggcaaagctcagaggaattgcgtcctcctaaaaagatttcagaggcccccagaatctctaggtgtggctgattggtgaacagaattcccccgtacaaacccaatccataaagactgagagagaaggctattttttttcaaatgcgtacaactcaacaaaaaaaatatcacaagccacacaataaagcagggaaatataaccaaatcaaaggaacaaaataaatctctagaaactgcctccgaagagatggagatctataaactatcggattaataattcaaaataattgtcttaaagaaacacagtggcttcttttccgacaaaacaccaaatggcggatgacgccggtgcagcgggggggcccggaggccctggtggccctgagatggggaaccgcggtggcttccgcggaggtttcggcagtggcatccggggccagggtcgcggccgtggacggggccggggccaaggccgcggagctcgcggaggcaaggccgaggataaggagtggatgcccgtcaccaagttgggccgcttggtcaaggacatgaagatcaagtccctggaggagatctatctcttctccctgcccaattaaggaatcagagatcattgatttcttcctgggggcctctctcaaggatgaggttttgaagattatgccagtgcagaagcagacccgtgccggccagcgcaccaggttcaaggcatttgttgctatcggggactacaacggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcaccaaggccacctttgatgccatttctaagacctacagctacctaacccccgacctctggaaggagactgtatttaccaagtctccctatcaggaattcactgaccacctcgtcaagacccacaccagagtctccgtgcagcggactcaggctccagctgtggctacaacatagggtttttatacaagaaaaataaagtgaattaagcgtgaaaacaaaacaaaaaaaagaaacacagtgaccttcaagaggacacagataattaaatgaaatttttaaaaatgcaacaacaagatgagaaaatcaacaaagagatagaatgataaaaaaaagaaagaagcggaaatttttgagctgaagaatatagcaactgaattgaaaaattcactaaaagagttcaaaagcagacctgatcaaacaaaacagtggactaaacaacaggtcatttgaatctttgagtcagggagcaaaaagaagaaaaaatgaagaaaagtgaggatagcctaagagattaatgggacatcatcaagcagatcaacatacacattaaaggcattccagaaagagaagaaagagaacttatttaaagaaataatggctgaaaacgtcccaaatctgacaaaggaagtggacatccaaattcaacaatctcaaaacaaatattagtaaattagtaagattattagtaagatgaactcaaagaggcccatacagagagacatgttataatcaaactattgtctttaaaagagcaagggcagtgactcatgatgtacaagggagctcccattatagtataagtagatttctccacagaaattgtataggcaagaaaggggtgggatgatatgttcaacatgttcagagaagaaaagctatcaaccaagaatactatgactggcaagactgtccttcaaaactgaaggagaaatacgcatctaacagcagagcacccaaatgtatgaagcaacattgacagaattaattgagagacagaaagtggcatggtggttgcaagggactgggcggaggaatgaatggggagttactgtttaatgggtacagagtttcagttttgtaagacgaaaaaaattctggagatgaatgattgtgatggtggcacaataatgtgaatgtacttaatgccattgaactgtatgcttaaaaatggttaaaatggtaaattctgttacatttgttttaccataagttaaaaaaaaattttaaattaatagacatggtaaaagcaagaaaatatcacacataatcaggacaaaaatccatcaatataataagattcataagtgacataaatgatgcaattaacagatgtgatatagaaaatagatatcataaatatggttcacgtgctcaagaatgtagaagatgaggagataaatagaaaatatttttaaagaaacattagatggaattaacagcagagtaggtatttgtattagttcattctcacattgctataaagaactacctaagactgggtaatttataaagaaaagaagtttaggccaagtgcagtggttcacgcctgtgatcctaacactttgggaggctgaggtgagtggatcacctgaggtcaggagttcgagaccagtctggccaacatggtgaaactccatctctaccaaaaatacaaaaattagccgggcatggtggcagatgcctgtaatcccagctactcgggaggctgaggcaggagaatcacttgaacccagaggcggaggttgcagtgagctgagatcgctccagtccactccagcctgggcgacaagagcaaaactccatctcaaaaaaaaaaaagaaaagaaaagtggtttaattgactcacagttccacagactgtataggaagcatgtctggggaggcctcaggaaacttacaatcatggcagaaggtgaagggaaagcaggcactcctacatggtgggagcagaaggaagagcacgaagcaggaggtgccacacactttgaaacaaccagatctcatgagaactcactatcacgcgaacagcaagggggagtctgcccccatgacccaatcacttccccccaggcccctcctccaacattggggattacaattcaacatgagatttgggcaaggacaaaaatgtaaaccatattattctgtccctggcccctcccaaatctcatgtccttctcatatttcaaaatacaatcatgcc

SEQ ID NO: 15670 - DNA, 33578 bp, Human
aaagagtagaagcagggaaaccatcaggatgcccggcctgttttttctttttcatttttttcccctcagctgtggtaatttagccaattcaaagaccttgttctccataatttcaactttccttcagatttgaccaagtcaagtagagctggtcaaacccaatgggaaaaagaccaaaacaacaacagaaacaaacaaagaaacagttaagcaaaagaaatgatcgcacaatttgtattattgagcgctctaatggtaaggagaaattaagaccagctggttgttaatcttaactttagtcaccaaggagagtttccaagacaaaactccaattcaggtgcttacctaggaatagggtccaggctcaagactgctctttaccattttagaaggagaaaaaaaactcagactcaccttccctgctggaagccagatgaaattccagaaaggagttgcctcccctccatcgtcatggaggcaggaaaacgcaccttctttgttgggagtaagtaaaactgcagacaaagaggtgtacagcaaaataaactttagatctcaaccaaattttgggacatcagggattctctggagtggggtgctcccaggcctcagcaaattgtcctgtttgagcaataaaaatagcccaagctggtaccaagcactgatagatttgtcaaaggtcagggccacctccactgagtcacttcctttggctgccagcttgtaaaccaaaaccagctctcaatcaatttggaagtttattttgccaaggttaaggacatgcttgggagggaggtctgtgcctttatctaaagatgattttgagggcttcaatatttaaaagggaggagcgggctggaggggaaagagggagaacatggtcattactgaatccacacattgcacaaatagaaaaaggaacaggcaggggaatagtcaattatgtatttgcctcctgctgtgtaaatcagcacttcagtaagataaggtgaggacagagcagctacctgtggggacatttaaccttttatctgtagctatctgcttagggacatagagaaaggcagtttcttgcatgactcagctttttgcttaattttttccttttggcatagtgaattgagctcccacggtttttgttgttttgtacataagtggagagttcatttgggccagggccccgagttattttcttttcacaaatataccctttagagttcagaggaaaggctgggattagagccttctgtgagcactattcatgggattacatgagggagtggctgtgaaaagagggccccggactaagccctgggcacctgaacaagtgagaggtcaggaaggggagaaaaatccagcaaaggaaccccagaggacccggccagtgagctaaaaagaaaagtgcagaagagtgcagggaaatggtaaagaaaagaaagctttccacaagacaggaccgatcagctgagccaactgctgctgagtacagtgatgagagctgaagtctctcgcccgaaaggcaataaggcgggagggggaaacctgagggcagcgggttctctcttgggagcgggaacacggaaccatgggcagcgaggcaaatgcagcctggggagaagctctgagtaacggacgtgcgaggatgatgcttgtgcaagaaggaaatgaccgctgtcccggctccgcgggagacgaaccccggcttcccgccctcagggactagctctccagggaactgggacggtcagtgccggtcgaggcagctcctcgctgaaggaaggagcaggggacagggaagcggaatggggagcgctaggcctccaactacgtccatctggccatgtttgaagagccacaaaatggaggagggaacccctcagagcgtgccagagcggagactgctctccgtcgcagtcggggcgcttccggcagggcgcccactcccagccgagcgccctccgcctgctcctccaggattcctcttcgccctttctggggccgccccggggcgctctcagcaggatggccaacaccttccctccatccctacaccccgccgccccctggcccgtggccgcgctcggctcccgcactgctcactccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaaggtacgcacgcgtgcggcggggtgtggggaaactggcccccgccgcgcacttgtggactggagcttcggctgggttttgtttttgcttttacatttcggattactccagcactgggagtatgatctccagcgatacagataaagccaaagttcccgcagactttcccggtcctctagcactcagaagggcatatgttacctagcttctgtggttccttttctgccttttctattcttgtccatttttctgttacatttgtggttcttttccttatgatgtgtaggaactctttgtatattctggatttaagtaatttgtcagtttactgtattgtggatactttctttgggtttctttcttttctttttttttaagccaaatttagcagtgggagagttgcataccaacttgaataacagtaatattaataagttctgaataacccattaccatcagaccagcctctgggtctatttcttgtcttttagctttgtttatggtttctttgttagacagagttttgtttttaagttatagttgcagtcaaatttttcttcataactttgtgtattattaggtcagttctcctcaaattttaatgcactaacagtcacctggggatcttgttaaaatgcagattatggttcagtatgtcgggggtgggatctgagattccaagtttctaacaaggtccccagtgatatcatatgcctcttttggaagcacgctttgtgtagcaaagtttttattgttttgatttgtgtgtgtggtttttttgtttgtttgcttgttttgttttgcttttaagacggagtctcactgtgtctcccaggctggagtgcagtggtgcgatctcggctcactgcaacctccatctcttgggttcaagcgattctcttgcctcagcctcctcagtagctgggattacaggcgtgcgccaccacgcccggctcatttttgtatttttagtagagatggagtttcaccatgttgaccaagctggtcctgaactcctggcctcaagtgatccgcctgcctgggcctcccaaagtgctgggattacaggtgtgagccacccccccggcctgtggtagcaaagttttaagtagtgttttagggtgtaagtatattcctgtatgtttgctgataatattgttactttttttttttttaaacggacagggtctccctttgttacccaggctgaagtgcagtgactcaatcataactcactgcagcctccaactcctaggctcaagcagtcctcctgccccaacctcccagatactaggactacaggcatgaggctatcatcttgtttttgtttttgtttttgttttttttcttgaggcggagtctcgctctttctcccaggccggactgcagtggtgctcttttggctcactgcaagctccacctcccgggttcacaccattctcctgcctcagcctcccaagtagctgggactacaggcgcccgccaccgtgcccggctaattttttgtatttttagtagagacggggtttcactgtgttagccaggatggtctccatctcctgaccttgtgatccgcccgcctcagcctcccaaagtgctgggattatagacgtgagccaccgtgcctggcctatcatcttgtttttactttttatctgcattacatgtgtagcaaggctttgctctgggtttgtgatttttcccttccccacaatcccctcaatcaaagattattttaataagtcgtaatagtggtagtactagtagcaactatgaaatttcttttagagtacttttggtggaaaggggctgtgatattaaataaacaagatggggtaattaagattccaaaaagtctgtgtcatttaatcatacttgaagaactaaatgtttgtgtgagtatgtgtgtatataggatgactcaagaaatacaataagttccctgtcctcaagagttttaaacttgactgggaaacagaacatacacagatgaaatgtgagtgatagttataaaccagtgtgttaaggatgaatattaagatgcaggtcaaaagcatgattgctgtaatatataaagtgtgttcagagcagacctttattgctcaaggaaatcttcctgaaagaggtaatatttaagcctggcttttaaagggtgtggattactaaagaaggatttactaatggtattcgactagtgttactactccctgaaataatctttgatttttttaaaagaaatatattagagaattagcaagcccttaccaggggcgtgaagggtgcaaaaggagtctgaatggcaaacagctagtctgataatgccagttgttgtcactacaggtgtacctggtgtgagtgttctgacattcagggccaagtgtatcatacttactctgcaagattaactgtgattctcttataacagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggtctggtgccaccttatgtctatatacctttttagggaggcttattttctcatattaattggaaattaaggatagtggctaattaaatacatttacttggtgatttgcctttgtttacaccaccagtgtactgagaattcatacataccatacatatttttaaatgggctgctgaggagatttgtgtggctatgttttgaagcacctggggaatgaacctgtgggagtgtaaagatgtgtgagtcagcaggcccaggagtttggagtcaggcatccatgttctaatatggtttcagttgctggctctggcttcggatgaaccatttgattctgtctgaccagtttcttcattcaaataaagactatgagagtaatgctagcttgggtatatagcaaatgccaggagattaatttctcactttgcaggatccagatagagagatgtatgttgaaatggctcacttgcccaataattccagggcagagaggacaatctaagggcagaagtgggagaaaagcgatagaaagctggaggagtgggaaaggctgctggaacccattgtcagtgacctgaagatgaggacagctaaggagttagccttagaagagaaagtgagatgagctcttatgctaattatgaggatatgcagcattgagagctgcagaaataattgggagtacctagcctgttcttcccactgaacatcattttggtagctattaaagttaaatattagatgatactgttctactttttactttatttaggaaatgctgtgattataaagccttctgaactgagtgaaaatacagccaagatcttggcaaagcttctccctcagtatttagaccaggtaagaatttcttgactcatctccaacatatgtgtttactgtggaaaacacacattttattttcttgctattgcatgttattgctggccggggacccaattgcagtctctttaagccttcaacagttggcttagcaaaagaagttcggttccaaaatacacggagtgtattttgtgtggagtcacccagctcttggggttacacaatatatgtaggcccatggcttcatgccaaacagattctgtgtttgtctgggatttggggttaatttttgagctaacatgattttaggtgttttcatttaatggattatttaatgagggactggtactgtgctgggtgctgacatatttctgttactaacaatctcttttgttctaacaaaatgtacttttctgtgattatataagagtactttttttttttttttgagatggaatcttgctctgtcacccaggctgtagtgctgtggtgtgatctcggctcactgcaacctttgcctcctgggtgcaagcgattcttctgcctcagcctcccaagtagctgggattacagacgtgtgccaccatgcccagctagtttttgtatttttggtagcgatggggtttcaccgtgttggtcaggctggtctcgagctcctgacctcaggtgatccgcccagcttggcctccgaaagtgctgggattacaggtgtgagccaccatgcccatgtgtctggaattggtgggttctcggtctcactgacttcaagaatgaagccgcggacccttgcagtgagtgttacagttcttaaagatggtgtgtccggagtttgtttcttctgatgttcggacatgttcggagtttcttccttctggtgggttcgtggtcttgctggcttcaggagtgaagctgcagaccttcgtggtgagtgttacagctcttaaggcggcgcatctggagttgttagttcctcctgtctggagttgttcattcctcccggtgggttcgtggtctcgctggcctcaggagtgaagctgcagaccttcgcagtgagtgttacagctcataacggcagtgcggacccagagtgagcagcagcagcaagatttattgcaaagactgaaagaacaaagcttccacagtgtcaaaggggacccgagcaggttgccgctgctggcttgggcagcctgcttttattcccttatctggccccacccgcatcctgctgattggtccattttacagagagctgattggtccgttttgacagggtgctgattggtgcgtttacaatccctgagctagacacagaatgctgattggtgcatttacaatcctctagctagacataaaagttctccaagtccccactagattagctagacacagagcactgattggtgcatttacaaaccttgagctagacatagagtgctgactggtgcttttacaatcctctagctagacataaaagttctccaaatccccaccagattagctagatacagagtgctgattggtgcatccacaaaccccaagctagacacagagtgctgattggtgcatatacaatcctccggctagacataaaagttctctaagtccccacccgactcaggagcccagctggctttgcctagtggatcccacgccggggctgtgggtggagctgcccatcagtccagcgctgcgcgcctgcacccctcagcccttgggcggtcgatgggactgggcgctgtggagcagggggcggcgcccatcagggaggctcgggcagcatgggaacccaccaggggcggggtgggggccttgggcatggcgggctgcaggtcccgagccctgccctgcggggaggtggctgaggcccggcgagaattcgagtgtggcgctggtgggctggcattgctgggggacccggggcaccctcctcagcagctggcccaggtgctaagcccctcattgcccagggctggcggcgccggccagctgctccgagtgtggggcccattgagcctgcgcccacccagaactcgctctggcttgtgagcgccacgcgcagccccggttcctgcctgcgcctctccctccacaccttcccacaagcagaaggagccggctccagccttggccagcccagagaggggctcccacagtgcagctgtgggctgaagggctcctcaagcgtggcgagagtgggtgccaaggccaaggaggtgctgagagcgagcaagggttgcccgcacgctctcacctctcacccagcctataagagtacttctgctttcaaaaaagacatgtctgtggcatgaaaacatgccacacatacacaaaaagtgccctcctgaactagagggcagatcctcacactgacttaacatgctggcatttaagaatatcaagaactgaataaagaaaatgatctgcccaactgcgggtagttcatctgtctgagtcagaggttcttatgccttcctggggaggaagttatgatgccgcgaagaaattggcactgctgagttctacatgcagttgctacagggaggagtcttcatttagctttaagcgaaatacagcttaaaaatatcttacctgtattctgtacatcaacttgtgatggattgaggccagttctggttcttggaatgatatttttctctttgttagagccattttgttctaatagctgtgatgatccaatcaagaaagatgaaatggaagacagtgagatgtcaaggattgaataggacgtagaaccagaagatagaggttgaaggtaccgctttgcccctgaccaggggtaaattcttcaataactgactctgtccggataaggaggataataatgctctaccagcttcagttaccgtgttaggggatcaataatatatgctatgtagattaagccatagaaaagttaaagcttgaaacatttgttgggcagctgaaccatgaagtgaatgaaattaattcgccttcaagtggaaacatgagatccacaagccagcttttacttcacacttccaccttggagtcttgaatacctctctgtcttccttgcttgccatctgttctcttacttttgatgctgttattgtccaagatgttctctcttagaatagctggtaatgatagcacaatgcatagatgggctcagtccacagaagctacgtgaattctcccagtaacagatgaggaaattgaggctcagagatgttcagtagcttgcctaaggttgcataagctagtgagtggcagagcccagattcaaaccagatacacttcaaaagcaagcgctctcagctactgtgccggatataccattcattcagaatagcgtgggctaagcccactctgtgttgtgagacagagaacattcagactaagacatgcatgacctgtcctgtgggagccactcttcaccagaggcacttctgcacacacccacgtctcatgcattttccctggtcaaattcaaccatttgttctccttagtgtctttgttgctgagctcatgtaaaaaaacactggagtctccagattggttctatgtgggttcatgcttcccagatgccatcggactgtgtgttctcctcttgtccttggtcagttccctctcccatccctcacagggactggtcttgacactctctgggttttactgaatgttacatgtttatgttgaagagattgctgatgttagacgttaggatttatttggcagtgcaagagtttgtgtttctctttctttgaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcaggtgagtctggctctctgattttctgaggttttcccagcacaatggagacttttcctgacaatgttactctttgtacttgaaccccataccttatggctccaagatacattattaagctttggtggttgatgtcctcaagagtaacaggagtctttcactgtctcttggcgccactgtcaaaaatggtgagctgtaagtcctgacatcatgtggttgtccttaggaattttaaaaaagttatatctgttctcaagattacagctagatctagcaagaaattttaacgttcttctggccagtgatctgtgaagtacataatccaaagtattgtgtgtgcctaataaaatctttaaatgcccatttgagagggtattatgctgatatcttaactgagatcctttgtgggcaaaacaagtgttcctcattttttaactgtgaataacatcttgcatctgaaaattagaaaataagaggtttcaggttctctctgctaaatccggtttagctactaagaagtgccaaatcatagaactgactctgtgctctgggtggtgtggctttctctgcccttcagagattccaggtcagggttccaggttggcttcctaagtagaaatccatttgtcaaaaccagacaccctcagttagtgaatgtttagggcatgggtttctgcccatgcataggaaaggtcttcccaagtggggcagggctccacaaagaggaggatggccttggaggctggctgacatcctgctttatacctgaacatcttgcaggcagagccaaaagccacaaccaggagagtctgtaccgaactctggtcatccaggactttcctttggctggactggaagaggggaaaggacattgggaggctgtttctcctcttttcctgcagcaggcaatggcttcactgtttaccaagtactgtttgccgtgagctggcctgagaacttccctgctatgtaaaatattccacctcatttggaaaatactttctaagttccaaacaactgatttagaaatgagtttttaacttttttataaaaattgccagataaatatatgaatctattttagttgcaagacattcaaacaacacaatgtaacaaatgaatatttgactgaattatatagctgttctggatgttttcccctcagacgcataacctggggaaaatacatgaattgtggccaaacctgcattgcacccgactatattctctgtgaagcatccctccaaaatcaaattgtatggaagattaaggaaacagtgaaggtttgtattaaaaacatctgattccactgattttaataagataaggagtcaaattaactattcgcaggcagcatccccatttgtttctcccttcaggaaaatttcaaaatcatatgtgactcagtgaacttattgactaatatgaaaatgctatgtgtaccatagaatatatgctgggagcaaggttgcattggtgttaaatctacttaaactgtctagttgatttgttgatgattagttgtggcatatactttttttaaaaaagttaaataatcgtgtgtccgtggttttgagggaatgttgccaaccctttaggtataatcagagagactctttggcatattggccattgctgctgaaggttatcagtttttgtgtatgtagagggcctagggtggccagtagtttggaggagtgacttaattaaataactacttacagtataccctttatataattaacaatctttcagcgtgtttaaagtaaatatttgcagtgagggaaccaaggaagactgcatgtagagtcctaagccaagacttgaagaaatataggatttaagttggtagaaaggaatgggggctgggcacggtggcttatgcctgtaatcccagcactttggggggcctaggggggcagatcacttgaggtcagaagttcaagaccagcctggccaatatggtgaaaccctgtctctactaaaaatacaaaaaaatcagccggggatggtggtgcatgtctgtaattccagctactcaggaggctaaggcacgagatttgcttgaaccctggcaagaatcgcttgaacccgggaggcaaaggttgcagtgagccaagatcacgccactgcactccagcctgggcgacagagcaagactctgtctttaaaaaaaaaaaaaaaagaagaatgggatgaccaaatgaccagtgtgactgagttcagcagtgggtgaggatcattaacccctcagatgaaagaaattattggagcagtcactgtttactcgacagatgttaattgagcactaaaaggaaggatcaaaaacaccaaagagtaatgcatgtgatctgaaaatgaaaattgttggccagacatggtggctcacgcctgtaatcccagcactttgggaggccaagacaggttgatcacttgaggtgaggagttagagaccagtttggccaacatggcaaaacccatctctactaaaattacaaaaattagccgggcatggtggcacgcacctataattctagctacttgggaggctgaggcacaagaattgcttgaacccgggaggtggagcttgcagtgagccaagatcatgctactgcactccagcctgggtaacggaatgagattttatctcaaaagaaaaaaagatatgaaaattgtcgccgttgtggtggttcactcctgtaatccgagcactttgggaggctaaggtgggaagatcgcttgagcccaggagttcaaaaccagcctggtcaacataatgagaccctgtgtctacaaaagaaaaaaaggttagctgggtatggtggcacatgcctgtagtcccagctactcaggaggctgaagccagaaggatcacttgagcccaggagttcaaggctgcaatgagccattattgcatcactgtgctccagcctgagtgacagcataagactctgtctcaaaaaaacaaaaaaagagaaaattggctgggcacagtggctcactcctgtaatcccagcactttggaaggccaaggcagacagatcacttgaggccaggaattcaagaccagctgggcaacgtagcaaaatcttgtcgctacaagaaatacaaaaattcaggtgtagcggcgtgtacgtgtggtcccagctacttggcaggctgaggtaggaggatcgcttgatcctcctgggaggcggaggctgcagtgagccaagaatgtgccactggactccagcctgggtgacagagtgagaccctgtctcaaaaaaaaaaaaaaaagagaaaattatgtaccaggaagttcaggacaatagttcactatgtgttccaggcagagtaacttgggggatgaggtgctagggtcttgacatggaaattggactatcatttttagtcataggactaaaaatggatccagatgagcacatgaagggagagttgcccagattcagggtatgtgggaagagagagtggttaaagatacttgtgagattgaaaatatttgggaattggagaatgcttagttgagtgtggtgatgaattcaatttcaaaggaataagggcctctgcctccctttgaggcatttatactcttaacacagtggttctcaagctacatgttaccctagtgagccatttaaaaacaagtttgcaagccttaccctccaaagattcagctcgtctgaggcctccaggtgattctatgatgcattcagcattgaaaactactgttggtgactctcgagtcagagcccaggcacatgcattttagcaagctgcaccagtgattccgaccacccagacttgagaattgctcttggtagaggttggatgaacaatgttcattttgatttgggatgaaattgggaactctcacaaggctttgaagtgatgcagcaattcagtaattttgtttgttttactaagtaaatattgattgtatgattattgacgttcttttaccttggtaatttaccaaagctgtattttgatccttcgggtggtttcaccatcatgtgtaagtggtggaaataccagttcaaagaagaccaaaacaacaaagtggagcaaagattggcaaatggtttctgtaaagggctagatggtaaatatttcaggctttgcagatgttagggtctctgctgtaactaccgaacttactgtagggggaaagcaggcacagccaatgtgctaacaaataggcaactctgatgcagagcaagacttctttccccagcctgctcccactgtcagccccaggaggtgaaggcctgtgggtggactctaagagatccataagaacctttggaactatggacaatgacagatctctgtgtgtgtgcatgctttattttctggtcctcgacctgccaaaaagctgaaacttgctactatcatactactgttaaattacttgaggggtggggtgttagattctgtgaggatataaaaccagattgattttggggcatggctggattttgtacttactgaaattgaattgtgggtctttgtgacatttatatactcctgttgttttaaataggaattttatggagaaaatataaaagagtctcctgattatgaaaggatcatcaatcttcgtcattttaagaggatactaagtttgcttgaaggacaaaagatagcttttggtggggagactgatgaggccacacgctacataggtaatggaaattctccttttcctatgggaagatggcaatttggcagtttttgctgacactacttattaacactagataaactattaaatatatagcatttaattgttaaagtactaaatcctgctttctggtatactgtacctgtagcttttgttataaactatttaaaatgtctgtgtttctgtgtattgaatgatgccaccagcgttgctccagttgttcatatttacacataactccttttttcctcctaacaatcctgagaagcagaatagaacttgatgtaattatctgtagtttgtggatgggaaaacagcacaaagaaggaaatagcttggccactattccacaattaaccagtgacggtaccattccagaaataatgttttggtccatcatgcttgaccttattatttgtgtaccttctttgtgctttttcttctttgccttgaatatgtattactttgaatgttaagcacatttttctacagtaacatataaggtgacagaaaaattagacacattttgctggcaaagaagctgcaccacctagctttacttatcccctttatcagataagatgctataagtcaccaaaaaaaaaaaaatcaactttaaaaaaaaaaacttaaaaatgaaataataagcagaattgattctcttataattagcagtcccgaggttctcctgagctagataattcagtggccccgtggtaccatcaaaaaaccctgattctttgtactaggatgcaaaagaaaacaatccttgtgccttctatctctcttggtggcagcccagattgaattggggaatacatctgtagaaaaaagagaaaacagactctacttgtttcacctctctgttctcccatcctcagcatgtccacattgcctatttctaggctaatgaatggtaagaggaaggggctatcctgattagcttatagactaattaggactttcccctgacttcgagctgggatcatcttacctgagcatggctatgcagaggaagtagacactcagcccaaattgtttctctgacctgaggaagatgtgggcaatggatttggagtggcagtttatataccccctggaagtggtgctgcaagaagctgtccccagccacattgccaagataacctattagaaactgggggtaaaggaaaagtgccaacttgttattgtcagatgacttctcttttggttgacgagccagtttcttacttacagcatcttttggagtactgctagttggtgacttacattggcagcagatgctgggacactttgtctagcctccccagcatctgtttcaccctcctttcttgtgcctcttccccatggtagatggaacagtgaactaaggtttagggaattttgaccatttaagtctgttttcttaatctgtctaacagagttataataaaggttaatgagatcatatatatgaaagcactcgagttaagaaaaatagtattgatttgattcacagaggagctgtctttgctcctagaaagacctgtccattcgagaccagcctgacccaacatggagaaacctcatctctactaaaaatacaaaactagccgggcgtggtggtgcatgcctgtaatcccagctactcgggaggctgagacaggagaatcacttgaactccagaggcggaggttgcagtgagccgagatggcaccattgcactccagcctgggcaacaagggcgaaactccatctcaaaaaaaaaacctgtccacagaaaaatgttaagtataatctacagttaaatacatgcatggctgtgaacagggttcaatgtgaaaaagatatatttgagtgtgtatcgttcccttggtttgcacaagtatccgcagggttgtgattcacaggctttggagacattgagtatgtgcacagttcatccacgtgctcaggatttttcaatagatatgacttgggtgggagagggaaaggcatggataagtgacccaatgaaagagatgtaatatgagagttgtgcatttttgtctaataagcattttcattttgtttattttctttttagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataaggtaagctttagagagaacagctagttagcataagcaactgtcaagagtcatgttccttctttgctgtaaaacaatgcaaaaaacaatgtgaaacaatgatggtttcttttgtgtcatgtcagagtccatccactaagtgaggttgtgttccgaggttgctgtcttggttaatgagactctggggttatcacagcatccattcccctcctccctcgggttagatctgagtctgcagggttgagtgtcacaaggtttttgattcacaaacatctcctgtataattggaagacttatatgtgccagcattaaatgcttttctgatgttaatcccagggcattgctgaataacagcctgcacaaaatggcattcacacccactgtgtgggacaaagaccccgacactgtcacataaatggttgtgatatgatggattttagtttctaacatgacgctagcttcttgttagagtggtggaactgcatcacctggttgagcagttctgccactttctgcatggctcactcattcatgtcactaggtgaccagccgctactaagagaccatggcccaaatgttttctggagagcttctgatggtaatgtatagatagtcatgtgacagcttttggagcttgtgagactattgagatacagatagctacaggtatttgaagtgagaccaaatgtgtggggctcagtaaagactgggttattaacaaaacaatggtttgacatttaaaaccatggataatgtgggcaggaaggaaccctgaagccgaaagtaggctggccagggtataagtcaggtgtggagcacttcccagcagtgggtcacccgaggtcactatagtccagacttgacgtttgccatgaacaattgtcaagggcttgctggcacccaagggtaaatgacgtttactagtcaagtgttcttgtgcttttctgagccttaggccaaacaaccatttatttcttaaaaaataggatgctaaatctaaagtcttaaatatttttacatttcataaagactaaataatacctattaatcatgtgttataatttaaagcagagataagaaagaaataataacagtttttaaagctggaatatagtctaagctgtccccttttaaagagtcttttgctgctgtgttggggagtacaactccaggttgtggctgagtaggcccagaggtttggagctgcctccttttgtgcactagatgtgtgtctgagaagttgggtatcagtcactttgctaaattaaccagttgagattgtttgtctatctggcatggtgtccccaaactcgagaattttcactgacacaaagccagaatgtgcatgctttgagcacataactgagcacacagccctctgtgtggtggggccatgagtgttccctaaggggcaacttcactgacctggacacctttggtctgtcctcagctcatcaaacggatgattgatgagacatccagtggaggtgtcacaggcaatgacgtcattatgcacttcacgctcaactctttcccatttggaggagtgggtgagtcttattttctcctgcttgtagtagatatttcaaaagcaccaccatttcatgagtggattgtatgggctgctgaaatagccagctgttgcgtaccctgattgtcctctcctgagggagacctttcctggtcacccagttgactggttttcctgcttccccacccacccctccagcatagggcaaatgtcttgtcactctctttctgtcagcagcactgactgaccacagctttgttcacttcgttgattttgttatcctgccacatttaggagatttgggaaccaagaatcaggtctcaaattaattaagaagatctctcttcgtgtgtgtgtgtgtgtgtgtgtgtgtgtgtgtggtgtgtgtgtttaatgaagtagcaaatgaaaggttcggaataccagggacagaaggtagaggggttttctaatgtgcctttgttttctgctcagttcttacctgcattgttccccagccctttgttgggaggagcagcctctccttgaattgttttgtgatttgagtaaaacgggactccccctgttctagagaggatgggcagaaagaaattcattccaagtgaagctttgtggacatagcctgatccttgcttttccctttagaacatgacctgcctgcctctcccacatgtgagatgactgactcagctttttatttctcctttgggacctaggctaggtgggcttttctactctctactagagctattacaaaatagccgatatgtaaacattctcataacaaaaacccaaccagaaaagccactgtcttaaagccctgttctatcctctccctttgtaataccgtcctaagtcagttgctccatgggatgcgatggcccagtttggcaggaccatctgttcctggttaaggaaaccttgtcctatgaccaaggagccttgacctatatagccacaggtccttgtctaggaggtaaacatattgccagcacccagcacagtgactgacatgagtgagggacaggcgggaagaggccaattggtaggtattgccagatccaaattggaaatggtggtggcttgtagagggtggtagcaggggagatagtggaaagggaagggggtatttttgggatcaagcagcaggattggctgatggagtgaatgttggaggagggggtgaatgagagaggatgactcctgggattttggctggagtaagtaatagttttgtagcccaaatgcttaaaagattggactctgttgtctctgttcctcagctcaccacataggatcctggcatccactgtgctagtgcagtaatcaactcggtaattgttccatatggtgtctccactgccctctaattgcaaatctaagtgacttgggttcagtccctgtcctacttgacaagatagcctgtggcatcattgactataccatcttatttaaaacaaaacaaggctgggcgcagtggctcatgcctgtaatcccagcactttgggaggccgaggtgggtggatcacttgaggtcaggagttccagaccagcctggccaacatggtgaaaccccatctctactaaaaatacaaatgttagctgggtgtggtggtgcgtgcctgtagtcccagctaccagggaggctgaggcaggagaattgcttgaaccagggaggtggaggttgcagtgagctgagattgcgccactgcactcaaacctggcaaacagagcgagactccgatctcaaaataaataaataaataaataaataaataaataaataaaaataataaaataaaacaagcaacctattatatacccacaaaaattaaaaatacaaaaagaagatgcaaaagaaaaaaacaggtttactctcttagcaaatttcaggcatataatacattattatagtggccatgctgtaaaaaaataaaaataaaaaataaaaacaagccttgacccccaaatgtaaaaggaatacaggctttttaagaaaacttggaaaagatagaagagcccaaagaataaacatttatattacccataaccccactatgtaaagataactggtatatgtcttgcacacatatgcacacacatatacacggtcatctgaatattctattcaaaaaggtatcatactatatattgttctgtaccctgtatgtgacagaatagtgtgacacttttccatgtcaatattcttgcatgtcataattttagtagctgcatacttttccatcatatgaatgtggcatatttatgtaaccaattcccagtattagatttttgtgatttcaatttttttggtattacgattcttatataatgtatctttatgcaatctctgattatttctttaggaaaaatgtctacaagtgtaattactctgttaaaagggcttatacaattttccaaattgaaaaaaatgcttttttcttctaattctcaaagtaatatagacacagtggcaaaaagtctaaacagttaaactttttaatattttggcatatagtttagatttttcttttttttttctttttatcgagactgagactccctgtcacctaagctggagtgcagtggtgtgatctcagctcattgcaacctccaactcctgggttctagcaattctcctggctcagcctcccaagtagctggaactacaggtgtgtgccaccaggcccagctaatttttgtatttttagtagagacacggttttgccatgttagccagcctggtctcaaactcctgggctcaagagatccacttgccttggcctcccaaagtgctgggattacaggtgtgagccatcgcacccagcctaggtttttctttagaaatgcttctctttaagacttttgatagatatttcaagtgtctttgcagatttctgccactttatattcccatgatcagtatatgagtgtttacttccttatatccccaattctggattattccattattaaatttctagacagaaaagggtctcatttcaatttgtactcctttgattattagtgagtttgaattttttttaccactctcatgaattttctatttatgtcctttgatatttttgctgtgttcacatcttccttattattggtatataaatagccttttttataagtaagaaaatcctcagtcctatctgtaatacatatccctttccagattttaatttttcttttaattttatctatgatttgaagcgtttatttatttagagacagagtctcactctgtcacccagggtggagtgcaatggcgcgacctcggttcattgcaacctctgactcctggcttcaagcaattctcctgccccaacctcccaagtagctgggattacaggcacccgacaccactcctacctaatttttgtagttttagtagagatggggtctcaccatgttggccaggctggtcctcaactcctgatctcaggtgatccacctgccttagcctcccaaagtgctgggattacaggcatgagccaccacatctggcctaagcctgtgtggctttttgttttttggtttccgatttggaaagtaggcttagaaaagctttccctatttcattattatataaatatcatctgtaggctgggtgcggttgcacacacctgtaatcccagcacttggggaggccaaggcacctggctaacatggtgaaaccccgtctctactaaaaatacaaaaaattagctgggtgtggcggcaccacctgtaatcccagctacttaggaggctgaggcagtagaatcacttgaaccctggaggcggaggttgcagtgagcagagagtgcaccactgtacctccagcttgggcaacagagcgagactctgtctcaaaaaaataagaataaaataaataaataattaaatattatctgtagtttccttccctccctccctccttttcttcttttcttttcttttttcttttcttttctttccatttaaccatggagttggccaagcatggtggctcacacctataatcccagcactttgggaggccgaggcaggtagatcacccgaggtcagaatcttgagaccagcctggccaacatggtgaaaactcatctccacaaaaaatacaaaaaaaaaaattagctgggcattgtggcatgcacatgtagtcccagctacttgggaggctgaggcagaagaatcgcttgaacctgggaggcggaggctgcagtgagccaagatcatgccactgcactccagcctgggcaacagagcgagactccatctcaaaaaaacaaacaaacaaaaaaaacaccctggagttcactttagaatgccatacgctgcatgatgtaataatttaccttttttttcccaaagagtaaactatgctggcaccattttttgaaataatcatccttataccatcagtactcaataaaaacacgtttgggtcattcttagggttttctcattggttgcattatctttctggtttgttttttccgtgggccagtaccacagtttcaattacagtagttgtacagttagctttataagtgacatttagtaagtgcttattgtatgccaggtactgcggttgaatccacgccttttcttttcttttttttcttgtttgagatagggtctcactctgtcacccaagccagagtacagtggtgcaatcacggctcattgcagcctcaacctcttaggctcaaacaatcttcctgcctcagcctcctgaatagctgggattacaagggtgcaccaccatgcctggctaattaaaaaaattttttttgtatagaggcggggtctcactgtgttgcccaggctggtcttgaattcctgggctcaagcaatcctcccacctcagcctcccaacgtgctgggattacaggtgtgagccaccgtgcccggtcaaatgcacgcattttagagacagacaactaataagtagtaaagccaagaaatgagccaaagttgtctggctccaaaacccacatattcaaccaatccagtagtttgctctttaggacacagtactatttcaatacctaaaagtaaaagctcctcattattactgtttttcgatgttttcttgcttgttcttatctaaatttatttttccagatgatctttggaatcactacctcctcctacttaaaacaaacaaacaaaaccttccgaaatcccctaggatttttattaaaattgatttaaacttaaattattttgggaagaatttatatctttaaaatgtggagtcttaatgggaatatgttatatcatctcttcatttatatagcccttttatatctttcaacaaaactttgtaatttccttcatgtcagttttttgctttttatttattttttgagacagggtctcactctgttgaccaggctggaatgcagtgtggcacaatcatagctcactgcaactttgaactcctgggctcaagcaatcctcctgcatcagcctcccaaatttttcccagtttcttactaccttggttatgtctttggctcgcccctcccttattctttttttttttttttttgagacggagtctcgctctgtcgcccaggctggagtgcagtggcgcgatctcagctcactgcaacctccgcctcccaggttcaagcaattctcctacctcagcctcccaggtagctgggactacaggcgtgcgccaccacgtccaactaatttttgtatttttagtagagacgggatttaacgatgttggccaggatggtcttgatctcttgaccttgtgatccacccgccttggcctcccaaagtgctgggattacaggcgtgagccaccgcacccggccccctccctcattctttaccctccctcagagttagggtttctcatggtcttgtccttgggtctcttctcacaccaggcctgcttcatgaatgattccttcctgcagcctggccttggtaaactgctccctggcctctggtcacctgtgtcttatatcacacatgccattccctctgcccagctcacactgctccgctttgtgcctgtcagtctgttgtacacacaatgaattagagaaatgaaactgtcacagagcatggctttgtggagggcagagatttacacttgcttattatcatccagctgtgcaaccttgttgccctgtcttactttccacaggctttgagaaagcaagtgggtgtgtggggccatggatgaatgaagccacatgggatggtgggaagagagcacatatagcatttagagtctgatccaggttcgggttctggctttgccacttagcagccgtgtgaccctgggcaggttaactgaccctgtaagctccctttccctctctggaaatgaggctgctgataattcaccaagtgggattgtggtgagaattatcttaagagaatgatttaactcttagcacagtccctggcataaatgagagccacagctctagaagaggtgcaagtccttgtcttgctcatggaaagcatcctgtttgacagggaaattgacttttccagggaagttggtaaggacttcctgaaaagagatacttcagctggcagagatgttcagtggggttcccaggcagcagggagtgcatgtgagctttcccggtcgttgttagacagaagtagcttgcatcatctacagtgaagcttgttttgtctgttccctttatttcaggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggtgagtccctataacccatgagtgccattcagtctggtcctggcctgatggctgccagatgcatattctagcaggactctacattaacttgtagagtctaagacagggtcagtgaaccacagcctgctggccagctacccgtttttgtcactgaagttattggaacacagccacacccacttgtttaatcatccacagctgctttcatgggacagtgacagagctgagtagttgcaacagaggctgaatggccctcagagcctaaattattacagaaaagtttgctgatctctggtctaagagattaaaacagcgtagaacttgattgcagaattctgagctgtctgatcaaagggttagccctttgatccttttggtattggactttccttgtcacttacagctttgttcttgaatgtgcatgaaatcagcttaccacagaggtgaaggcgagaactctggtacaacagctttggtgagggatattttattaggcttgagtttttttcctccaaagttcactacctgataaagtttatctttggtgattagtcattatagggatgggcttgcaaagaggccctcatgatagctgccttctcaaagcagtttgcgtattttgagatgaaagaggaaatccgtaattaaagttaagatggaatgaggaaggcaattgtgtctgtggtgccctcagccgttcaactgaggatataacattgaaaatattgaccatatcagtgaagaatgggcttggaaaaggcaatggtaatagttgtgtttatgttttgtttaaaatttgaaagggggctggcgcagtggctcacacctgtaatcctagcacttcgggaggctgaggcaggggaatcacgaggtcaggagttcaagaccagcctgaccaatatggtgaaaccctgtctctactaaaaatacaaaaattagccaggcatggtggcacgcacctgtagtcccagctactcgggaggctgagggaggagaatcacttgaacccgggaggtggaggttgcagtgagccaagatcatgccactgcactccagcctgggcaatagagcgagactccatctcaacaacaacaacaacaaaaatttgaaaggggtttggctcatcttacagtatcccagccttagtggaattggagataccagttgcatttgaaatcatttgggttttctcagaaataccaagctgtgctgaggagaaaggccctgttgatttttctggtagttcacagactgcgttggtccagtaagcagagatgaacaccagatttcaaaacccagccctgtctgttaagagtgaggtaggaactttttgttttctttctatatgtaaggtgggccaagttggggtatgttttcaagggttttttggtttgttttttttttgtttttgtttttgtttttatttttgtttttttttgctacagttggaggcttaagggttattgaaaaaagaatgggccgggcgcagtggctcacgcctgtaatcctagcactttgggaggccaaggcaggtggattgcctgagttccggagttcgagaacagcctggccaacatggtgaaaccccatctctactaaaaatacaaacgttagctgggtgtggtggtacgtgactgtagtcccagctactagggaggctgaggcaggagaattgctttaacccgggaggcagaggttgcagtgagccaagattgtgccactgcactccaccctgggtgacagagcgagactccgtctccaaaaaaaaagaaagaaaaaagaatgtttaacttacttatctctagacattttggacctgggcccagagtatcagggtgttaaaactccacttatccacaattttaaaagggtgaagtgacttgctaggaatctaagagaagtgtgcagaggcaatggcttagctgcgtccaggtgaagcatacatcatttcttggaaaagggcagctgagtgtgagcctcatttctcttccccttctactcagctctcctgggggaggtgccagctgactaattcagacttgtcaccatctaggcactgaactctttatgtcataatttaagaatatgttttttaaatcactaagtagttttgatttgttttcatttttaaaaaaaggtttgactttggaattcatggcagcaaatgtcgtgaaatcaaggtgtagtatacaatttaggggctactttctttgccttcctgaggctggaggtgtggtcggaagcttacttgggtctctggtcaatatctgtctcttttgttcttttcccaagacctcggttcctcagtttgataatgcatcttggtaggatagaatattttagcctcatggaaaatacggaggcccaggctgagtctgcattctccaatcttaccaaacccccaagaagcctccctcaggtgcagtgcagtgtgccaggcaggttcgagttcccaaagggtttggcaggcatgtttctctgtgagggtctagagaagcagcaatatataaaagaagcagcaatatataaaacctttagcagaaacaaaaaaatgtggtttgattcctggctcaatgaacttgggcaaggccttttctgagctctttcttgggcctcagcttgctcatctacagggtgagggagtaggtgtcagtgattccccaggccactttcaacccttccgctcaattctcattactaatagttgttaatatttctttggattcaatctggaactaggtagagatttggttttcttttccactttgctgcttttctgctcctttctgagcttttaatcctctttttatcaaattaccttttatttaaaataaatgactttgaatctgtactgtatatttacctgaatagtctatttattgtaattacatttttctgaaatggcttttatgtacttaatagtttccttattttgttacactcttggattttattttattaattaccttactagaattagaagggatttagagcagaagtattgtacacaaagtaaagttccaataaagcttataagctacagaaggcattgtgggagatgtgggttttaaaaggtcgagaaacataagaggttaatgttgataaatttcattaggcctttgacaactaaatatgacatttgaaccttgagattgcagcagcccttcctcagtcttcaataggaaggattaaattcagtactacttttgaattttagaaacaaaattgtataccagtttttgaattccatgtagagacttcagcttcctactgaaaatgctaggataataagttagtactctcatcttctgtctctactctgacattagctagttgacagtggacagaatatagccttcattatcacgttgtcttactcttattgttattgttgttttttgaggaagggcataatcctttggcctaaaccgtgcttcctaggcttcctagggatatgtagtccttttttgtacaatgcatgtagagtctcttcagacaggaggtgtctgagtcccagtgctgagcttgtgttgcaaggctggttgtgggtaggtttttaaagcagctgagtaaactgaatccttttttcctctctccaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcatagatggtatttgtcaactttttttttctcattttaaaattcttagctgagaagattttctcaaactttatgttctgctgtgtgtgttgggggtggtggttggtagctatagtaaataggtttttccagtggcatcctcctacccccagttgctgatctagaacaagtgtttctgtaagcatatttgtagaacactaatcccgcaagattttacacaaaaaaatggtcctgccaccagtcctgtataccactggcttgtaaagcacatcagcaaactaaaggacccaggtcatttggaacctctgaagtgctagtgtgtgcagctcccagacttccttgaccgcggagccgtttaccttaatacctgttaaccatggaccacacttgggcaaacagtggcatagagtctggaattgcttccatgatgactttgctgtgctctgttcctacttgttttgtgcccttatttatatcatgtcactactagaagaaaaagttcagtaagaacaagtatttctcaaagtctgtgataagtgaaaatgctgatggaatgaaagaactgtagaaaaggggaagaagggtgtatggacagccactgccctggtcagggtctcacagcacctgcatctgccaggagcacacgggttgtctggacagggcccactggtccccttctcagagcttcacagaggctttatgacagacttgagcagcaggctgtgcccaggaaatgtgtaatctttaatataacagtggtttttgtgattttatctgcagtgtcccatttgaagccatttacattattaataatagtgacaatccctggactctgactcgtgcagttggctgatgtcttctgtagagcagtccaagtcacagaagaaaactccagcttgaccagaacagaattgtcaagtctgttcagacccctctgagtgtcaccacaaggaatcagccaaagttctttttttgaggagtggttcaaagtgtccacctgcactagaccccattggtgtttttgcagggcagaccgtggtgtgtttgcatactggggacagccactcctggctttctatttccaagcttctttgctagtgcctggtggctaggatcctgaccgtgagccccaccatcagtgtggctgacgccgcccccagagcagccccacggcggatgaccagctgtttcactgatagtctgctggtaggagctgaaagggcgtgggcctcctctggagtcctgaagaagtccacgtggcactcagaccttgaatacgttgtcaaggtaatgccaggggaactgcctgtagccactgcggaagcaaacaggagcaaactcagcaggtcaggggtcagagggagagctttggccttggaatcgggaaacctaggttaaccacctggctgtgtttgttacacctcacaagggacgatgcctatacagtagaaaaataactgctttatctactttacaagcaagatcagaggaggagatatgcaggaaagcatcttaaactgtgaatttcacgtgcagataatgcttactactaggatctcatgaggagtgttcttgtcaacgcttggccctgtgatgatctgtggcttcaaaagcacgtgggaaacacaattaatcatgtcttaccgtattctctcatgacaacttacgctcccagagttttagctggctcactactgccctgatcaaggattagcccaggatggatgaggtcatggagacatcatctgtgtgagctttgggccatgtgcacacacgcctggcactcaggaccagccctggggcagagctggggccatcacttcatgacatggacactgggcacaaaccagagagatgtttgtctgcctgatggggtggagagaggtagatagcaggtgcccccccaaagccaatgagtcaagccaggctggctgacaagccaggctccccacaagttaaaagttggccttccgtcttgagcagagttcagtgggggagatcatgggctcttgaatctgacgggttgatgcgcagatcttatgtctggcctttacaagttgtgggatgagggaggaaatacctaagttctttcagcctcacttcctcatctgaaaatgggcatacatctagttgcctctcaaggccaaagacttggtgtggggcctggtacttgcatgcctgctagacaatagatgttgttgtcttcctggtgcttaggacatcattttcataataatgggaagaaaaatagcttgggcttgtacaatttccaattgcatgaggcacagagggcagacaagagcaacatgccactgacatttatatgtgtaccaaagtagaagcagcggtgacagtattacctgaagataggactgctttctcaggcccaggtctggttgcagtgctctctgctctctgctgctgctgccggcctgaatgtttcttagcctaaaggagaaagaactcaattgggtcaacctgccagctcaacagttcaccccttcactgctagcctcgcattc

SEQ ID NO: 15671 - DNA, 68529 bp, Human; identical to SEQ ID NO: 12140
  misc_feature (1)...(68529): n = A,T,C or G

SEQ ID NO: 15672 - DNA, 9649 bp, Human
tggaagctcagagagggcagtgactcaccagcatttcatgctgggatggaggcaggtttagagcttgaatctgagtccagcgcccacgctttctctcctgcaaggatgaaaggctacaggggttgagaaaaccctcccttctgccctgaaggcagagctgtggcacggctcaggcttgcttcctcatcccctgagtgtgaggctttgctgccaacacacaggggcttgtcccacctggggcaggaggaggcagagtctatggcactgcttctctgaatctgattgattcagccccacaatctcaggccctccagacaccaaaatgaacaagatccagccccagcttcaggggtgtctccacctgctgaaggtggtctctgctgaacttttctaggttctgaatcccacctcaccccaacccttctgcatcctagctcataggatgtacgaatgactcccgtgcctggactagtggctttacataggtaatggtggctcctcagagcacagagaggtgcagtggagtcccagagcccctgagccgagaatcaagcccagatctgcctggctctgaagcctgggctgcgccaagcctatcacatatcccagccctcaactgtccaagaacaagaccgcacccagttgggaggggtgaggaaaggaggctctagggaggccacagcacctgcactgggcctaagagggtgtcccaggagggatgagaaggagcagagcagccaagccagggtgcagaggcagggaagagtggggcgagagaagggtggaaggaaggttcagcccagtccgcaggccggagagtttggattttgatctgatggtagtagggagacacaaaaggtgtttgcgcagtgtgaggtcatctgtgcttggggagcctatgctggctgtgcactggggagtggaagggaggcaaggagcccagtcaagaggccattagaaggtccagaggtggctcatagttttgatagatttcatcctgctcaagtttgaggcagagtgaaagctattgggagggaaatacaccagaggacacggagggcccatgagtgctgaagaaggctgcagctgggttgggcgtcgatgacataaacctgagagagagcaggaggatgtgcagggccatgtgaagtagggtctgcatttgggggctctgtacatagtaggtactcagtaactgttcattggatgaatggatgaataactccttgtctctgggtcagctctggtcttaccctctcctgtttctcacacctcttctctttgcccaccctgtcctgtggccctggggagacctcagctggcccagtagaggcagtgctggcccatggttctgccggagggcgcctccatgtttgcgggtgcaccgcacgccttctccctctctgtccccctccccctccctgtccttatctttcccttctgtctccatggcgactcaccacctcggcttgcctgcatcccagcctctgccagggattctgagccgggctccatccctccctcctcggagccctgctacccgcagccgtgtctcctccccctggggtgagtccagcagcagcctcctctttcctgactgtcacatttcttttccagctctgaccgggagtcagctcctcggggataccatcccccgacctcaccttccacctaccgcagcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggcaagtcttcagtcctaagatcgggaaggagagtggggtgggaagggccctccttgggctgggggatgggccgggggtggggaggatgaggggtccctggaaatccagggtgaagatagaagtctggattatgttctaaatcttttttttttttttttttctccaaggagagaaaacagagcttcatgggaaacagcggcaacagttggtaagtagcagggccttccaggctgggatgggtgcagtgaggccaggcaggtcagttgaaatggccggtcctggaacacagagcccggcagcccagccgggagggctgtccgcctgaggctggatccgccaggctgtggagggagggacaggaagaagcaggtgggtgctgcagggaggcagatgccagctcagagcagagagcggaaggaatcttctaagatccagagccatctgcccaactgcagcacaggctgatggcttctcctcactgtccctgtagcatggggttgtggagggtatcatccctgggggcctggctgaagtcagcacctcatggagggagccccgctgtagaacgccgggagaggctcttcccaagcatttgcaccaggcactgtgcagacagctgcacacgcctcctctcggatggccaccccaacggccccatgaggggtattgctatcctctccattgggacagttaggaaattgaggcccagagaggggaaggaacttgcttgcatttgcatggctgggatgtggtggagtccattccactcagattttctccctctcagactctctcaccattgctctgctgcccccactctgaggcccccaggtcctaggacacatgtcagtgaggaacgggcagagcttggcctctctgggagcagctccgcctgtccatggaggcactgatggaaattgggttggcacaaagggacctccactcccaagccatcagtcttccaccacaaccctggccggtaccccctgcccccaatagacatcctgcttttcaatggcctgttttgccccacaggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggtctggggactgggcctaatcagtcagacccaagaggagggggtggctttggccctattctagaacatcaggacacagagctccaggctgaacacattccagggtcaggagctggtcctggatgctcaggggcccctctcttctcctggcccaggagacgtgtcctgtgagggcggagccgctgctgctggttcgcatcaatgcctctgggggcctcatccttaggatgggggccatcaaccgctgcctgaagcaccctctggccagggacaccccagtctgcctcctcgctgtcctgggggagcagcactcagggaagtccttcctcctcaaccatttgcttcagggcttgccgggcctggtgagggcggggcggggcaggagggaggcggggagcaaggatgggggttcctgcctgggggaagctgggtctggtattccggtctgtggggacaaggaaccgaccaactgatgctctcccttctctcccctgcaggagtctggtgagggcggccggccaagaggaggagaggcatccctgcagggctgcaggtggggcgccaatggcctcgccaggggcatatggatgtggagccaccccttcttgctggggaaagaagggaagaaggtgaggggggaagtggcagaaggaggtcagggatgggaaggggaatcaagaagggcgtctctggggtgaggatagaagatggggatgggacggggcagggttgggaagaatgtgggagaacaaggcaggcctggccccttgggtctttccctaccccctgcataggtggcggtgttcctggtggacacaggggatgccatgagccctgagctgagcagggaaacaaggatcaagctctgtgctctcaccacgatgctgagctcctaccaggtgatggggggcgctgatgttggcatccccaccccacacacccttctccagctcagcttcctcaaggccagagcatctcacaggctttggtgtctggggtcctgataggttctggggctgccttagaagggggaaggtgctcctagttggtgaaggtgggaacgtgggttattcctaaaagtgggctgatggtcccaggggcagctgaagacctgatggatcacattaccctccaggcttgtctccggccttgaggccagcccagccctgcagccttcgaggcccccatactggcctctcccatactctgaggcccacaggctgcctgcgagctccctactcaccagggccttccccagtgaagtcacccggcctctgtaatctctcatacatgttgttctctctgattccagatcctcagcacctcccaggagctgaaggatacagacctggactatctggaggtaaagagacctctgatgttggggcatcccccacccccaccctccccactagggctggacccaaaggaactaggtgccctcctggtctggcctagggttttatgacacttgaacagggttgaagggggagggtggagagtaaagcaagagatgtgtggtctggggagaggcaggagaaccccaggctgcaaaagggggagcctagctcctacagcaggcgtagggaggtggggagacaggcttggggtgcaccatagtcctcaaagtggcccagccctgacgctttctgtgtcccacccccagatgtttgtccacgtggccgaggtgatgggcaagcattatgggatggtgccaatccaggtgagacacctatctctggattcattggccccaggccccgccacccccatttgctggtgtcaggaccccttctctttcagcatctggacctcttagttcgtgactcatcccaccccaacaaggcagggcaggggcatgtaggcaacatcttccaggtgagtggtgcaaggggatggggtggaggggccatggacagggcagaggtggggaaggcatgggaggctggacctcctagctcagagcactcctctcgctgcctcacagagattgtctggcagataccccaaggtgcaggagctgctgcaagggaagcgagcccgttgctgcctcttgcctgccccagggaggcggcggatgaaccaaggccatgcaagccctggtggtgagtgtctctgagagctgaacctctcttgcgctgctcccagctcccctccggcaaccgagccccttgaagcacccacctctcctggcctctgacaccccttctcctcccaaagcccgcagtctctcagcatgcacatctctccctcagacacagatgatgacttccgccaccttctgggggcctacgtctcagatgtgctgagtgcggccccccagcacgctaagagccgctgccaggggtactggaacgaggggcgcgccgtggccaggggggacagacgcctactcacggggcagcagctagctcaggaaatcaaggtgtgaaaactccctggagacccaggcgactcggctgggcccctgctctccctgaccccagcgatggtatctccgcagaacctctcaggatggatggggaggacagggcccggtttcacctctccggatgaggtatgagcgctgggggatccagcattctggcagggagacaggggaggcagggaggtgggggctgtgccgaggcctccggggtgggggtctgtgtgccctgggagtggagatgaggaaacaagcagcgcccctggctgagaaggaaggaaggaggcagcctgggttttcccgtggacagatggctgctcagctgcacgacctgaggaaggtggaagctgccaagagggagttcgaggagtatgtgaggcagcaggtgagccccggggctgcacgggaggcaggtgtgggccgggcagggtccagatcagggagaggatacctgggactcctggtcagggcaccttcttttcccctccctgtcataggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcctggcagggggcgtggtgggtgctggcatggcagcagctgcactggctgcagaggctgggatggtggctgctggagctgccgtgggggccacaggggccgctgtggttgggggtggcgtgggtgctgggttggctgccacagtgggctgcatggagaaggaggaggatgagaggcttctggaaggggaccgagagccccttctccaggaagagtaacagccccaggaggtattgaaggacaggagagatgtcaggtggggatgaagaagaggggcaggtcgggggagggtgatgccagggattccaaggcaccgccatgtactgcactgccctggtcgaatgctcggtgtctgggtggcagctgagctgggactcaaggtggctcttggaacctgggaggcagcatctgggggcagtggatagaacacccggcctgtttctggttgcagatggttgccgatctgcccttgtcacagataggctacatcccagggtttctggctgcaagtgagactccaccctccccacctggctcatttccccgatgaccctggattgtaggaaagttaagcaggcaccatcctggaagtctacccctaggtggtcgagagacctgttctttcacagatgtgagaagccccaggatgattgaccatggtgttcaggagcggggagcactgatgaggtgctggggatgacaggaaggaaggaacactgggcagaaccagagagatgggacatggtagactgtggcccagaccccagagcagagaaacttgttcccatgacccttcccaaatctgctccagcaggactaaggtggctttcccactcctggcccacagccccagagagcctgtctgtgcatcctgaaccactctttgctgggcctccgcaagggcctctcttgggtctgtgtcctttttcaagcctgtttagatgggggagtgcccatgccctctgtgaagtgcccaaatgcgaaagaataacaccttttcttgcattctgagctaagccagacagcctttatactagattctatcaaaatcttgcaaaggaaaacaaaatgaacaacttctacccttaaacacatcctttctcccctgggcttgtaagaagatgcagcttgatgcagctcctcaaacaccaggccccctgggaactgggggtgcgggagttctccctctgggggacagaaaatctgactactaggaagacttctaggctatgaaactgacttctaggctatgaaacttacagggtatgggtgggcacattatcctttattttatgaaaaataaaatgtgtgtatgtgaatgtcagcttcccagtatattattgaaacagaatttaaccctcagatgacttcatggtgggagcaggtgaaccaatgagatccattgctggaatgcacagatgggaagagggagattggaattcaagagatccaaggaagtgaacgtcagaggtccccattcagtggctgcaagaggcctcaggccaaggccaagtggatatgggcacctttgcaggctcttccactaggacttggggttccgctcctcttgtctcctctctgagaaactgcttcccatgatcctgtcaacaggcagtcaacaagcacctgtcccagcaagaggacagaatggatacataagcagagagaacttggtcaagccttgaaggaaggagaagcccaggaccacttctgcagggctcagccagccaggagttcacccaactgattctcctcccagccctgctccccagctccccagctccccatctcagaaccacagcagtagtcactgcatccaatcctggcattttataggtgcacacccagagagagaaagtctcagataagcctgtgcagctgctgatgacagaagcaggggaaccccgaagtcctggttcccaagctggtgcacttcctgaagttattttgttaaggtcgactgtgctgaaattgagatgctccttttcagatgcttcttctggctgatcaggtccagctccagggaagtgtgtggtgggcagaggcagcaacgtggtctagaacagatggctcagcagtgaagctatagttaacaggctggggacaaaatacagaatgtagagaaatcccaaagccagggtggggttgagtggggtaaagacaaatgagagtgactctctcttttagggtctgagccaagggtgggaacagggtcttaactttgtgtagtgtttgtggagaaggactttctggaagcatctttctgagcccttccactgtcatctggtggacacatgagctatgaaaccttccagactttggaggctcaggatgagggggcccagagactcagagagggagggtgttacatggctagaatcccacccggcagcactggaaggaacaacagttcagtgtctacctctccccactctttgcacagatgggaagaagttggcccagtgagggatgtctctgcagagacaagatgagtaatattaagtggtgtttgtcttgtgccttgtagctttcaaaacatttcctcaaacattatctcccttaagccttgaaatcatctcaagcagtatgtagaacacacattttcacagaggaggacgctgaagctgagagaaataatgtgtctcagtggaaacaactagtcagaggtaggccaggacttgaccccaagagttctggtgccaaatccctggctcagtggagccttcaagcctctccagactccaagacgaccaggcttctgggttccaaacctgattagttggcttcctggacttccaacattgattctgtaattcacaagagcccaggtgtgactcattgaccgaggtctcagcagcatgctgacgtctggctggtttcccttctgtgacccactgcaggttccaagattggtaggttccaagattgggttagaggtttggtgacttgccgtgtggttcctgtttctgaggcctccctcatgttgcagatggcagtactgcaagacaagaggaacctgcgacctgaaggcccttgactgcttggatcaggaataagccctcaactccactggctctcatcaaaccacgccgcgagcaaggaataaacttttactgcatgaaggggatgcgacatctaggtcgacttagtacaccatcacccaccctactctaacacacacagaaatgggttctttgaaatggagtgatgctgtatcagacaggtaaagtatcaccagttgggggctgggcagtaaggaaaagcattttatgtcacagcagaacgtttgctaaaattgttgcctacggcaacttggaagac

SEQ ID NO: 15673 - DNA, 15073 bp, Human
gaagacaatgataaaccttgaaagaaaaaagtacccacaatctcacttgatgatgagtaattttgatttatttttatttttgcatactcgtgttctcaaacttttcatcagtgaaaattatattacttaaaggattgaaaaatcatttccaaaagcctctaaaattctagagcttgattcacaaagagccactcgaccaacttcacacacagcaagtcactggcagggcaaaagcttggttccccttctcagcaggggacagaatccctggacacactgggaagatattctgggtgttgctgtcccttgtcccttggccaagaggtggtctgggcatagaagacaagagtgggccgggcgcggtggctcacgcctgtaatcccaacagtgggtggatcaggaggaggtcaggagtttgagaccagcctggccaacatgttgaaaccccatctctactaaaaatacaaaatattagccgggcatggtggcgggcgcctgtaatcccagctacttgggaggctgaggcaggagaattgcttgaacccaggaggcagaggttgcagtgagccgagattgcaccactgtactccagctccgccaacagtgagagaccctgtctcaaaaaaaaaaaaaaaaaaaaagagtgggtggcgggaaggtggctgaaggtaggagggggaacctaaatgggacatgggaggcatggttggcacgagctcagcctgaccagggcccagagaggtagactgattcagtcaaaagtcgtagtacttttcctgctgagattggtggcccttttgctgggctttctcaagcaagaaatatcctcttctgtttcagaattattctgaatcattaacccaagtcctcccaactgcactgatcctgtcccagagaggccctgggctgcatcacctaactgatcactaaccacaaccagttctgctctctcctggttcctgaaatccaggagcagatggtggtggggaggaggagtttggagacagccctctaccagaagccaagaagaaaggggagtgaggagggatagaggaagttatcttggtcctgcgcccacagtccccagggtcctccttcctgtgaagcccaacggtctccagccagatttcctgtccccttagccccaccaagaaccagaggctgcccattgggtggctgttggatgcaggttactgttggagtgggggatggccacctgaggccaattgggtcatctttactccaggtctccctttcatcctcctgtcttccctgggggcactctattccctgcaattccttgggctaccagttcctgacttttgttcctttcaaaggaaccctggataaacagtgtaaccagaatttcagaggggttagttgtgtgtatcccctggggacaagcaccggtataggcacacaatggtgagctgagaaatcttgggctggtagtgctaaattcaaaggctggggacaggctggggccagtggctcatgcctgtaatcccagcactttgggaggctgaggcaggtggatcacttgaggtcaggagttcaagaccagcctggccaacatggtgaaaccctgtatctactaaaaatacaaaaattagcttcttgcctaaggaaaaatacaaaaattacttcttgcctaaggaaataattgatgatgtggctagaggctagggcgtggtggcgggcacctgtaatcccagctactcgggaggctgaggcagaagaatcgcttgaaccattgcacatcagcctgggcaacagagcaagataacgtctcaaaaaaaaaaaaaaaaaaaaaaaggctggggacaatgctggcccctcctttcctgccccttccccccatttcaggggcccctctgtgtgtaccttccaaccccagtgggggaggagaaagagttcagtctccaggatcagaccttcctctacctcaccccacccccagcttagaggacataaaagcgcagattgagctaagaggagctgacaatatcaggtgagctgtggaggtggggtccttggaagctggatgacagcagctggcaaggggataagagagcagtgagcccctccctcaaggaggtctggctttatccatagacagggccctctgaggtggggctgaggtacaaagggggattgagcagcccaggagaagagagatgggggttcccttcttctcttctctcagatgcatggtggacttaggaccttgctgggctgggggtctcactgcagagatgaagctgcttctggccctagcagggctcctggccattctggccacgccccagccctctgaaggtgctgctccaggtaacagttcccaaggtgggagaagatggtgtgttggggtggttgtgttccagagaccccttttctcagagcaggccttcctagctctggggcctgatagggggttggggcccattcctgactttgtgatccctgctctgggcagctgtcctgggggaggtggacacctcgttggtgctgagctccatggaggaggccaagcagctggtggacaaggcctacaaggagcggcgggaaaggtggggcacgaggcactgcccagctctgggcaaggatgtcccaggcctttcagagaagcagcaggcagcagggagcttgaaggtgggagagggggactatggggacccatgtggactccctttctgtctgtctgtccctgtgtttctggatgggagaacagcttaaaagccatccttcccaaagccttgcctctgtctggacacccaggtccatatcctttttataaaaggaagccttcctcccacccgtgggcctgcctgcatggtcctgcatgtctgcccctgggctggggctctgctgggtgggtctgtatcccttctctggccctcactcctcctttctccaagcagcatcaagcagcggcttcgcagcggctcagccagccccatggaactcctatcctacttcaagcagccggtggcagccaccaggacggcggtgagggccgctgactacctgcacgtggctctagacctgctggagaggaagctgcggtccctgtggcgaaggccattcaatgtcactggtactgttgcccatcacaccccaggtccctgctccactagtgactcctcctagggaccccagccgtctctcagtgatcccctcaacttcttcctccagggagtctcaggagtctccagggctcctcagcctcaggttgcctgggataggaagtgaggcggctcagctcccccattgttctttcccccggcagatgtgctgacgcccgcccagctgaatgtgttgtccaagtcaagcggctgcgcctaccaggacgtgggggtgacttgcccggagcaggacaaataccgcaccatcaccgggatgtgcaacaacaggtgcggctggctgggggtggctgcaggaaccgggctcagagaggcgtcccggacgccacaagcctcccggtgtcagcgccctgtcctcccctgcagacgcagccccacgctgggggcctccaaccgtgcctttgtgcgctggctgccggcggagtatgaggacggcttctctcttccctacggctggacgcccggggtcaagcgcaacggcttcccggtggctctggtgagcgccggcgggcagagggggcgaggcccggccacgcggtgcgcggacccaggcgccagctgatctccgtgtcccgcaggctcgcgcggtctccaacgagatcgtgcgcttccccactgatcagctgactccggaccaggagcgctcactcatgttcatgcaatggggccagctgttggaccacgacctcgacttcacccctgagccggccgcccgggcctccttcgtcactggcgtcaactgcgagaccagctgcgttcagcagccgccctgcttcccgctcaaggtggccctgcttcccgcccactgcctgggttgggagaggggagattgtttctggaaggggccatctcccttctgtgcccaggtttcctttcccagacgctgaggaaggctggccctgcctcccttgtgtccacagcactggctgctcagctatgacctgtctccttcctgcgcctgggctcagccagctggcagccagggccgtccatttgctcactgcctctggcaggccaagggagagagggttgttcctccttggctgacaggagtcctgttggtggaatcactggctctttgttaggttgggagagggttctgggaggagaccttctcagtgccccccaagcctccatgctcagtcctgtttccgccccactgagagggcagccccaacccccatcacacagaaagagagagcctgggggtctggtgggtgccgtgggacagggctgggagtgggcagggtggtcgaggcactgctgagtagggaaggaggaggagagaaaggagagagcgcctgagagagggagagacagacaggagaatgtcagggccagagggagagcaggcacagcagagagaaggggagagagacgggcgacgctttagtgaggagggatccgaggcctggcggtgcccagacccaggggttgcccaggttcccagttcagtgttctgctcattaaccctgcacctcagaggctgttgctgatggcgccctaggcagcgatccctttcgggcctccggaggcctctctgcaggttgagggtaccagaggtcctgagggcagggggagatccagttctgcctgggcaccttccttgccctcggtgagccagtctagcctctctctgtgcctcagatcccgcccaatgacccccgcatcaagaaccaagccgactgcatcccgttcttccgctcctgcccggcttgccccgggagcaacatcaccatccgcaaccagatcaacgcgctcacttccttcgtggacgccagcatggtgtacggcagcgaggagcccctggccaggaacctgcgcaacatgtccaaccagctggggctgctggccgtcaaccagcgcttccaagacaacggccgggccctgctgccctttgacaacctgcacgatgacccctgtctcctcaccaaccgctcagcgcgcatcccctgcttcctggcaggtcagctttggggtggggaccagaggtggcataggagatgttccctgttggagccacagtgagtctgtttgtgagcagcttgtgggtttgtacttagagagactgtcctcaccagccattactatcaacttcatgatattaatccagttgccttggtaacaagtcagatggagccagaaaagcagaaaagcaaacaacctctccaaccctaagatggagacccaggcatggctgaggagcctctgtccatcagtccattgctttctctgtcccttttttcccttctggactctggaagacaagagagtcaaatccctcaggggcagggaactaaaggacagagaacgctgtggtgccctcaccctctagagcgacactatccaatgtggtagccactagctgcatgtggctattttaattttagttattttaaattaaataaacccagtttctcagcggtgctaaccacatttcaaatgctcaattgccttacagtctagtggctccccctattgggtggcacagatgtaaaatattttcatcatctcggaaggttgagttggaccacactgctccaaaatatcccctcctgcgcatcttaattacccataataagagatgatgggattttaaatgtaaacaattggcagttttggagacacaattggggcagtgatggcagccatgaccagacattttccagtgttttttttttttctaagacggaatctcactctgtcacccaggcttgagtacagtggcacagtctcggctcactgcaacctctgccaactgggtttaagtgattcttctgcctcagcctcctgagtagctgggactacaggcgcctgccaccacacttggctaattttttgtatttttagtagagatggtgttttaccatgttggccaggctggtctcaaactcctgacctcatgatctgcccaccttaacctcccaaagtgctgggattacaggtgtgagccaccgcacgcagccattttccagtgtttttaaatgtaaacccaatagtggacctcaggccctttcctctggcctccctctgcctcctcctgatggttcctgctggtctctccctggctgggaccctgggaggaggatccaggtcggactttctgcaagagatgcccgacctcttctgggctagttaggcaagggcagccctccttagccagactcagctgcccacagcctggctttgatgagccccatgtcccaagcctgggtcattatgacctctagctgttcatggatggagatgctgctctcagagaatttcctttccaccagcttctagagctggcaaggactgaccctagtgtcctgaccctagccctctggcccctgcagagaagggttctgggaggactaggggaaccaggggggatctgcttagttttcttgaacagtctcaggtgtggactccacatatctcatgtcctagccctctcccctggggcaggctgcaccattggcatgtagtaaagggcagggctgacaactctgttcaaatggtagtggctttctggagtcctgtgttgagaaggattctgaggttgcatccaattttagcaggaaagagtgctgtgatcgttagctgcatcagacatgggcatggatgtaggctgtgccaacacgcatgcttcttcccagacactccttggaatcaagagaatcaatgaaccaagcagtgttcataagtctcatactttgtaccaggcactctgttaagccccatgtatccatatgtgtgctaggagggagggtaaaatataaaaaggcacaagccttggtcctgtgctcaaggagctcccagtttcaggtacaggaaagtggcatgtcatgtgttggaagtgatacctattgaatgagcatccccaaccagcagcggccctgagctgaggcagaagctatcattgtggactggggcatcagggaaggcctcctagaggagtgtaaattggggatagtttgaaaagatggatggggaggaggggtgagtaggaggcatttcaggccttggctggggagggggtttcagtggagcaaatcttttctgggatggaggccttaagaatgacagtggcttttgcctccccaaggggacacccgttccagtgagatgcccgagctcacctccatgcacaccctcttacttcgggagcacaaccggctggccacagagctcaagagcctgaaccctaggtgggatggggagaggctctaccaggaagcccggaagatcgtgggggccatggtccaggtaggccgtcttgaacaccgggcacacgggatccagatgtgtccctgcaacatcctagctgtgtgaccttgggcaagttcctaacgctcctgagccttgccttcttcatccatgaggctgtaaggattataatacatatatgaaaacacctttcagatagtaagtgcttgacaaagcctccttcccttccctctccttcttcgcaggtttgctccctgcagtcttctttcctgtgggtctgttattggtgttgggagggttgaatgtttggtttagcgcccaagtagctgttcagtaaattcttcttccctccatctcactgtcactcttagctcctttacccactcacctcttctttttaaaattaaaaaaattatagggctgggcgcggtggctcatgcctgtaatcccagcactttgggaggcggaggcgggtggatcacgaggtcaggagatcaagaccatgctggctaacacggtgaaaccccatctctactaaaaatacaaaaattagccgggcgtggtggcgggcacctgtagtcccagctacttgggaggctgaggcaggagaatggcgtgaacctgggaggcagagcttgcagtgagctgagatggcgctgctgcactccagcctgggtgacagagcgagactccatctcaaaataaataaataaataaaataaaatttaaaaattattattattattttatttttattttttgatacagggtcttaccctgttgcccaggctggagtgcagtggtgcgatcttggctcactgcaacctccacctttcaggctcaagccattctcccatctcagccttctgagtagctgggatttcaagcacgggccaccacgcccggctaatttttgtattttttgtagagacggggtttcgccacgttacccagtgtggtctcaaactcctgggctcaagtaatccgccctcctcgacctcccaaatccctgggattacaggcacgagtcactgtgttcagcccactcacctcttctttttggctctgtcataatccacccaatgtccttagcctcatttacccctggggcaatgttcctggttccgtctctcaacatctggtgcttcattgcccccaccctctccctcagaggcagaggcagacatacacacactcacacacacacacacacacacacacacactcctagattctggaggagagagttttcggtgctaagggtgagtttttgatttgcactaagaactcaagtgaaattcatttacactccaaaataacttctagactctagaatgtagagtgagactattccatgtcttcacttttcacagggaaaatcatgccagaatggcccttcgttccttcctgcctccctgctttccacaaacctaaactgagccttactgtgggcaggcacttggtgggcactgtgaagaatttcaacaacttcaatttcccttgctctcaaggactttataagatagttgcagaaatgagacattaataacttgaggacaaggaagttatcacaatgactaaaaaagtgatttgctatttagtcctctaaggcagagggcaatataattatccttaatgtacatttgaggaactcaggctcagagaggttaataattggtccaaggtcacccagccagcaagcagtagaactctatttatgcctctcagtgccactctgttaggcccaggtccggtattgtgggaggctattccctgaccatagagggatggaaggggtccccgaagccaagagcaggcagagactctggccctcctgtgctgccaggcggcatttgctgtggaggagtgggtggagaggccattccaaatgacttgtctttagatcatcacttaccgggactacctgcccctggtgctggggccaacggccatgaggaagtacctgcccacgtaccgttcctacaatgactcagtggacccacgcatcgccaacgtcttcaccaatgccttccgctacggccacaccctcatccaacccttcatgttccgcctggacaatcggtaccagcccatggaacccaacccccgtgtccccctcagcagggtcttttttgcctcctggagggtcgtgctggaaggtaagcaggacctaggccaggagcgagtgggctgacagctaaaggtggggtagggatcaccttggctctagggagctagggtggggagcagtctgctttcctcccatcttggagatctggtctgactctctagcctcagttcctctgactctgcttccatatctgataataaacagtggggtggggatggccctcagagggaactggctacttcctatgtgttgtggctcgctgtgacccaggaagccagggcctgggagcatcccaatcttgcaagtctgaatggcataatctcctgagacctatatgtccctggggtcatgtagtgaccggtgaggacctgctcactggggccaccaccttggcaccaggcactgcttgtgcccagccctcttctcgaatcctcctgaccctacctggacttgtccctgactccaatctgagctctgatactgagccagatacttcccctgacctggctcctctggtccccaggtggcattgaccccatcctccggggcctcatggccacccctgccaagctgaatcgtcagaaccaaattgcagtggatgagatccgggagcgattgtttgagcaggtcatgaggattgggctggacctgcctgctctgaacatgcagcgcagcagggaccacggcctcccaggtgaggggctgcaggagtctcccctgatgctcacctcccctgagctgcctcctaggtagcccatcaccccccttcccactctagggtccctgccctctccaaagcatattagaggcactttgctctcaggaagtagcctgaggccaggcccctgccttttcccggacccacctgataaatttccagctcctctcaacctcctttgcatgctgtaattctcatattaggggcatcgtcatcataatgataacccacagtctgaaaatctgtctctgtcatcattccattttgcttcattgtacgttaactctgggggaagagattattattgccttcattttactgatgaggaaactgaggcttgatgagattcagaacctggccaggttctctagccaagtcagtggcaaagctgaaatttgaagccagattagcctaacctcaaagcctgtgcctatgttatggggtagcccatgtggctgaggcttctagacacatttcacctctcatgggtcagagacagacacatcgggctgctctggagggggacaaggagatgtccctattcttggacccagcaggaactgtggcagtttagggtttgccttatggtaggagggcaagagaaagacagagagggtcccagagaggcccagttgtgccccttggtctaagccaaaggtacagggttccttgaggtgaggtccttccctccctctatgaccttggttgtgttgggaaggtgggttttctgggctgctggcgatatgtgaatcttccctgctgtctccagtgacctccccaccttgaagcagagagacctgcccatagccacctgtcccctcccccatgcaggatacaatgcctggaggcgcttctgtgggctcccgcagcctgaaactgtgggccagctgggcacggtgctgaggaacctgaaattggcgaggaaactgatggagcagtatggcacgcccaacaacatcgacatctggatgggcggcgtgtccgagcctctgaagcgcaaaggccgcgtgggcccactcctcgcctgcatcatcggtacccagttcaggaagctccgggatggtgatcggtgaggaggggcaggcgtcgtgggccgctgggtggctgtgggcccatccttgactctcttggagcccaaatttcctcctgtcagttgaaggactggagggagtcagtaattttccagtgtgttccaggaatcctccagatgccctggagtgcccctaatgtgccctgaacctgttgggggtgcagcaaggaaagacctggacccctggttgtaaagggtggaagatagaaaagtgccacccttagctacttcttcccatgggtttcactgtgccaccatgtgggtgtcagtcaccagtgggcagtcccctcccagctttcccacagctccccttagtgtcatttcctcgtggtcctgatgtcttcatgtctagttcttgcttagcctgtactgcacctttgggaaaattagaaaaaggtgcccctctctgggtgggcgaattataaaccacccccaagattctcttccactcctgtggatgcagctcctggccagggcacagggcttcaggagtgtgtgtgggcccgggtccccctccagcatggtgccctggaggccgccgggctaggggtaagggaaaggccactgggcagctgtgctttactctgcacgatgagtggagcatcacttgtgtgaaagcccctgggctgcccaagggcctggggccctcctgtgcttccaggtggcatttgttgtggctttgttatatcctgggagcagcacaagcccatcgatgccctgccagcccagaatatccttgggcacagtgtccatgggtgttccccatgcaggttttggtgggagaacgagggtgtgttcagcatgcagcagcgacaggccctggcccagatctcattgccccggatcatctgcgacaacacaggcatcaccaccgtgtctaagaacaacatcttcatgtccaactcatatccccgggactttgtcaactgcagtacacttcctgcattgaacctggcttcctggagggaagcctcctagaggccaggtaagggggtgcagcagtgaggggtatatctgggctggccagttggaaccacggagatctccttgccctagatgagcccagccctgttctgggtgcagctgagaaaatgagtgactagacgttcatttgtgtgctcatgtatgtgcgaagtatataaattggcttttcatgcgtgtgtgttgtctgaacatggggagtgtttcatgggttatgtgtatgtgccatttatgtgagtgtgtgtttgtgctgatgagaatactgagtatgtggaaggcagcagagcggactggtgaggagcacagctcaggaactagactgcctgggttccaatcctggctctgtggcttgctagctatgtgaccttgagcaaattaccctccttaaacaagagttttcttccttgtaaattacatctgtcatggtttcttggagggcccacttgtatcctctggttcttcatttattgagcacctactacatgcaaggcactgtactaggcgtgagaagcatatagaggcaagaaagagataccaagatgccatctgtgtcctggttagcagagctggaccagtggtgccttggagggataagccagctgcagctgggctgtgtggttgacttatgggcccagccagccaggctcaggccatggctcccctttttcttcctcaccctgatttcttgcttattcactgaagttctcctgaagaggaactgggcctgttgccctttctgtaccatttatttgctcccaatgtttatgataataaaggcaccgctgatggggacctccactctgtctgtgtctgaggaggaactggcgcttttgcagaggcttactctgggctctgagcttgaaccagtgtggtctgtgctcagggccctgtgtttctgaaccgagggtgaggatgttggggagttttcctttgagatccgtacgtggagggcagccatctcttggaagcctgggggccggggcatgcggtgcagaccctcctccctcaccttccacccctgccaccctgcagggaactgtggtcaccaagccctcatgtttgttcattgctctagcaaacgtttgctatgtgttcactctgtgtcaggcctgtgccaggggctaggaagtggaggggacaaaatgctgtgtggtaggagagaaagtacagagacctggtgaggaggcaggcccttccccaacaagaggggcctctgcatcctgcatcccagcagcctggcacaggggttcagaggccctcaagacagtggactccttctcattcatgttgcacatggctcctggagaagggagagcagatggctgggcccagaggacagggccagcactgagggaggggaaggagtgtatttccctagtagtcttgcctggagcttgaaccctgcgtctgactggtggactccctccctctcctcttccttctcaaatatggggagggggctggaagtggtgtaggacggtggggtctaatgtactcatggggcccctggtaacgttaggacctcaccatggtaagaagcagcaaaaatactgcttgtcctcatttctgtgatgaggagagggctgctcagaggggtgaagcgactcgtctgaggccttaaagaagtgggtggcagtgccaggctgcagccgaggtcatctggctcctgggctcttcccacaggatgactgggtgtctcccactcccaccccaccagttgggggatctggaggccctggttgggctaatctttcccagggggtcattttaaaagaagaacatatgaatatgtattgggcagaaactcaaggaatgttctggaagtgccccttcagaggcatcacaggatctaaggaccactctagaagagggtatttctcagaagggccactggaaggggtattagcttcagctgcgggagacccaggcttggtttcccttcctgttttatcccttggcaccaccgcctaccgtcccccccgtgtcctctctcttgctactccacggccagtgcttgttttccccaggagccccctgcccctcccctttctctgagaactcttagaaatcccaccaaaccatccccttccacctcaagacccacgcacgcgccatctcagtggtaagacatgtatggcctgtaaacgtctagttacttatttggcagtgattccgaggtctgcttttggagggaacggtgtcacgcctagcatctttagtcagtcatcagatgtttttgagcacttctaatgtgctgtgcaccatgctaggtgccacaggggaccctcggaggcaggctgaagtcctggcccagggagcttacaatctaggtgagaggacaggaagaaagataaaggttaagggccaagacttgtggagggaagaggacaggtaacatccagcaagctggagcagaagggcatctcagcggggctaagtcttgacagaaaggagaagccactggagctgagtgtaagagctgggagggccgaggcagccaccctggggcctgagcaagctgttcatccaggggtatagagaggcccagctgcaaagaagggctgggactgggatatggagctctaagggaccaggtcattgaacttgcttgaaatggccctgtggaccaaagggaactttcctgtgcagcgcgggcccctaattcttcactgaggcccagggtgacaggtccagcttgtcgatggctgagcaatccacgaagtcataggggtagctgttggcccagaatgggtcccgtgggaccttggtgatgcgggtgttgtcacagacaaggcgtg

SEQ ID NO: 15674 - DNA, 25282 bp, Human
aggtgagctccaccttgggatccagagcaggcgtcgggggaacttaggggagggggcgcggggatgggtttgtaagagggcatggggtggctcaccttagaagaagggaaatgagaagatgtgggcggtcccgtagcccagattcctgaaagctcctaaaggtccctggagtagggtacgccctcctacgaggcccagggtccgcggggagggaggaggctgggcttgtgggcggggcccgcggagccgccccgcctctacctccgccttcccgccgcggtcccgggctctcccctcgcctggctcccctcccttctgcactcgtgcgggagggcggagctgggcccgctccattgtggagaggaggggagaggcgcgcgggagccgcgcggaggcccggccaccagcgccctagcctcttggccgccgcggctgcacctggcgagccccgcagccgggatgcggcgggcgcccggggctggcgggcagcgcagcggctccggggacatgtgcgctggcccagaccgcccgcgaccatgagcctgaccgcccgcgtctcctgctccatgcttagctgcttcgtaagtgcccaccctgcctttgggggcctaggaggcacccgcagccccgcccagggtcagccctcgatttcagcccatcccccttcccgaggcccctggcccggccccgaacgtttggggggcagggaaggtgggttaacccttttatttcttggacttgcttcaatctttgggtgccggagatggtcgaaggccaggaatggaaattctgtggtccatcctggccccgcagccactgcccttgactgcagatctctaggccccgccctgcaggggtacatccctttacctccgcctctccctcttggtcccacccgctgaatccttgcttggggatgtgggatgtggctagtaggctgaatgggatgttaggaggttggtcggggagcacgggatgtctttgagctggcttggggctccagtcccttccctcttccaccattccatccctcacctggcatgccagccttttctccttgactgtcccccagacagcctctcttctccatcttccctgcctctgcagggttccgtacctctgcatcattcccggtcctcccctcctcccgctctggctgatgctccttcccagcttcccccatctgtcctctcagctgtccccccaccttccccgtgggtgtctgccgggcctcctctctctctctcccctggctgtccttgggtctcctggctcctcccaggcgcgtggatccccccgggtcccctccctggtggttgggaggggagttccttttgcttgctgtgggtattcctcaggaattcccctctgattagcaggcagagcaggttacttggcaggtaatgggggcttgtcagcaatgtgggtctaacaagaagataagcccagctctcaaacacgtcttccttttgaaagcgtcggtgaaggccctctagaggcgtgggactgaatccccccacccactcctctttgtctccttcacccaccagattgaagcttcagtggcttgtaggcgcctgatttcccttctctctgaaaccagctgccatacctggctccttttcctcaggacagcactttcccatccccactcctgccttacccttatgcgggtctaagggaaagagtctttcttttccttagttttctctcctccatttttgaaatgttggttctataggagagtccctctttgaagagtgcagattcccaattcctcctggggcctcactctttccttaggcttaataggctgatatgctctccatttcacccttccctgtctccaaccaagtcagatctcttttcccttctctggtgaccagaacctttagaggtgtgtgtgtgtgggtatctgtggatttcttggtggggagaggagcagaatgagcctgatgggctaagtggagcttggtgacttaggactgtggccttcctacagggtgaggaggggccccccagcctggagtacatccaagccaaggatctgttcccccccaaggaactagtgaaggaggaagagaatcttcaggtaaggaggagttgggggccaggatagatggggctccctgcccagttaaaaaacaccctcccttctcccaaaaatcctcaagggcatctggtaccagagctctggcttcatgttccctggtctctggaggaggagggtttgtctgcgcatcctggagcctttggccgcagggaaggaaaggcagctttcctgtacagctgttgcctggtgctgttaccgtggagagaactctcctctcttgccttggcccaccttttccagaggggatcccacagatcaggggctgtagaagaggataaggtggtcactcacttctggactgaaggtttctctgccccttgacaggtccccttcacagtgctgcagggtgagggagtagagttcctgggccgggcagccgatgccctcattgccatctctaactaccggctgcatatcaaattcaaggactctgtcatcaacgtgagtttctgtattgttctcctacccctaagctagaatccctatgaagttcaaggtgggattgttccaaggctgtccttgatcatgtcattaaaaaagttggaggccgggcgcagtggctcacgcctgtaatcccagcactttgggaggccgaggcgggtggatcacttgaggtcaggagttcgagaccagcctggccaacatggtgaaactgtgtctctactaacaatacaaaaattagtcgggcttggtggtgcgcacctgtaatcccacctactcgggggctgaggtacgggaatcacttgaacctgggaggtggaggttgcagtgagccgagattgtgccactgctgtccagcttgggtgacagagtgagactacctctcaaaaaaataaaaaaaaaaaagttggggatcccttctgtttctctctgacctcatgttttcctgcctcattttcctagctctgtttctggctcattctcctttctcctcttctctctttccattattctattactggcccttctaaggagcacagtggcattgttggaagaacacaggctttggagtcaggcaaacctgggctcttttcctgcgttgccactcaccagctgggtgaccttggtcaagtcacctaactgaggcttgatttttctcctcgtaatatgggctgaaagcacctgctgtgcaacgttattgggatcattaattgggatcacatatgcagaggactccgtacagttaccaggtgcttaacagaccctcagtaaatgttggtttccttcctgctattgatacattagtgcctacgctagggtgagggtgaggagtggtacccagtggggagtctgagcttcagtttgcccttcctctacaggtccccctccggatgattgacagtgtggagagccgtgatatgttccagttgcacatttcctgcaaggactccaaagtggtgaggtgagaacaacggagcctcactcaggtcccctggccctagtcttgtccagttctctgtgctgcagggtttctctggtgcaagagaggaaagatcctgcctcactttccccagttggaagaaaaggtgaagaccatgttctgggttgggaggtcagtttactgacccataggatcttgacctgaaaaaatgggggtaatgcctagttcatggagtcatcgtaaggattaagtgagataatgtgtatgtgtatgaaagcaccgaggacaatatctggcacagagcactcatattattgttggtttatttatttattcatttgatatacatgtattgagtaccctactcaatgccagcctgttttaagccctggggatacagcagggaacaaatagacaaaattttgccgcctcagagagcttacattccaatgaggagataccaaccgtaagtaataagtaaaatttgtgaaatgatagtaagtgtaaaggaaaaaaataaagcagggaaagggaataaggagtgctatgagggtgaagattgtaaaacaatcaggctgggcacggtggttcacgcctgtaataccagcacttcgggtggccaaggtgggaagatcccttcagcttaggagttcaagatcagcctgggcaacatagcgagaccccatctctactaaaaatagaaaaaattagccaggtgtggtgatgcgtggggagatcacttcagcttaggagttcaagatcagcttgggcaacaggacgagaccccatctctactaaaaatataaaaaattagccaggcgtggtgatgcatgcctgtagtcccagctactcaagaggctgagataggaggacctcttgagcctgagaagtcgaggctgcagtgagctgtgattacaccactgcactccagcctggatgacagagtgagaccctgtctcaaaaaaacaaaagtgatcagagaagctgcaccgaaaaggtggcagtcgagtcaagacttgaagaaagtggccatgtggctatttggtggaagagtgtgccagagacagagaacggcaagtgcaaaggccttgaggtgggtgtgtgcctgcatattgggagactggcagggaggctggtgttgttggagtagagcacgtgtgggtgagggtagtgggttatatgacctgagaacaaagccgggtgtcagacactttggctgtcatgaagactggcttttactttgagggaactgagaaaccactggaggattttgagcaaaggagtgatgtgatctgattaatgtttcatagaatcacactggctgctatattgagactagatgaaagagaatgggggcaagagcaaaagcaaaaactgggagactagttaggaagctattgcagttacccagatgagagatcatggtggcctgtctgaggtggtagcagccaaagcggtgagaagcattcagattctgggtgtattttgaaggtggagatgagaagatttgctgacagatttgaagtgaaagaaagaggaatctggatgactccaaggtttattaaaaggatacctactttagagcctaccatgtgctcaggtctgtggggcattcagaaggagcattcacattgcccttcccttcaaggaggctaaactctagctgctggaagaagatttaacatgtggcaatatgctatgggaaaatgtgttgcttagtactccaagtaggccaggcacagtggcacatacctgtaatcctagtactttgggaggccgagggaggaggatcgcttgagcccaggagttcaagatcagcctggacaacatagagagaccctgtctctatgaagaatttaaaaagttagccagacgtggtggtgcacaattatggtctcagctactcaggggactgatttgtgaggattgcctgagcccaggaggtcgaggctgcagggagctgtgatcgtgccactacactccagcctgggtgacagagcaagagcaagaccctctctcaaaaaaaaaaaaaaaaggtatatatatatattccaagcacattaagaatcaagagaggaaggagtttctggaatagagtaggctgggaaggcttcaaggaagaggtgagactgaaactatcttcaaagcatcagtaggatgtggctaggcagagaggagacattatcaagcagaagataaaccaaggagatgggaaggatgtgagcagaacttcccgcctgaagcagaaggtttgagttagggagtcatgggagataacactggtccattagggtagggacaaggagtgcagacgttcagggccacatggtagcatttagatttgatacgagaaacagtagcgccccattcgagaggataagtatgcctcaaacacaggagttcttgggaagagaattatcacaagagacaacttctgttgggtgttggccagtgtccctcgtccccccaccctgggtccccactgctttacctcttgctttgcagccttctctcctcacagccttcctgtggctgtgtttttggccctgatagccccatggcacaactgcactttgcctcacctaggcctgtggcttcttgcctggcaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgaggccagtctattttctttgggaggctgcttcttaccccttagttctcatccctcctccactcctgcacattggtgctctgggaagctaaccatcgtgggggctctgttgcaggtgagcacatacgttgtcgacaggaggcggagcttgcaaggatgggctttgacctgcagaacgtctggagagtctcacacatcaacagcaactacaagtgagagggttggggaccaaaacaccttccacaccaaactacttccgtgtttggataaagtgtggtgggcacagcttctgagtctgagagggaggaaggctcatggtttctcttcccacaaagccatccccagggatcctgtcatcacatgttttagacccagtgcagtgacccccacctggtctcttctcagattgtgccccagttacccccagaagctgctggttcctgtgtggatcactgacaaagagctggagaacgtggcttccttccgctcctggaagcggattcccgtggttgtgtataggtgaggcagtggggctgggaagtagggaggccatttcttatgcaacaaggaaagagtcaaaattggagattttgggtaacctggttgactgagaattgacactctatggggaagtatgaaataactttaaaacaaaaactatcttagttttttctcctaagaataaggctattagggagtttattcattccccccctttttttagagtgtgtgtgtgtgtgtgtgtgtgtgtgtgtgtataaaatagtacattattttatacacacattagtacaggggttggcaaactggcctgcagacaaaatctggcttatagcctattatataaaacggcttgtaagctgtgagtggtttttacatttttaaagggctatttttaaaaaaagcaaagaagaatacatgacagaaactggttgtgacccacaaggccaaaaattgttgtctggttttttactgaaaatgtttgctgatccctgcactagaatattgtagctaaaatagagtgagacaggaagtaaccctgaagtttggaattgttcctattcttggctcagccaggccttgttctcctgctgggtgtctgtacctggagcagttgctgtgcagatttgatgagtcaaggtcaccttggacatacagagcccatttgagaaagtatgtgtgatggtgctttgtaaacggtgaagcctgctagtgacgttggggcttttggttgctgttatggcctggatgagttggtagcccctgctggctctagagactttggtctaaccccctgaggtaggcctctggaggcttcgaatgccaagggcattacggtttcttctgttttgtcagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttggtaaggtgtggatgatgctaaccccccagggagcaggccccctccttggcttcattggctcccagggagtccccagtgagagtctgggaagatgacaacacacggggtgctggggtccctgccttgtcagaagctgtggggtatgaggggtctctagttgcatgttctgccttctgagagggagtgccagagggccagcaagaggttgggtggctggctgactcagggactccttcctgctgtgtgtttagattcttctctgactgcgtgctctggagtggagagcacagcagctcctcaaaagctgctgatcctggatgcgcgatcctacacggcagcagtggccaaccgggccaagggtggaggctgtgaatgtgaaggtattgctgttatcccagtgtctgcagccagcctgtgctctgggtggctttggtgaggagggggttgggggccatttgtatagtggaaagagcccaaacaaacctggcttgtaatcacaactttgctacctactagctatggctatgactatgctgaagttgcttaatctgtccaagctttattttctcttctataagaaggggatgttacacactttgcaaaattgttgggatgattagaagttgcatatgtaggctgggcccagtggctcatgcctgtaatcccagtactttgggaggcagaggcaggcggatggcttgagctcaggagtttgagaccagcctgggcaacatggtgaaaccctgcctctatcaaaaatacaaaccattagctgggcatgatggtgcatgcctgtggccccatcccagccacttgggaggctgaggcatgagaatcgcttgcatctgggacgcagaggttgcagtgagctgatatcatgccactgcacctctagcctgggtgaccatgagaccctgtcttaaaaaagaaaaagaaattgtatatataaaattattgccacagagcagctactatttattgagaattgattatatattgtctttctaagtactgctatcatttgtcattactgttactattattaatatatggcacctgagtctccagagatacaagtgtgattcagatttcaagactgtatttagttcctatcctggagtgctctgccctgccaggaaagctttgtccaccaggaccactcttgtcctggatgcctgtttccaggacgtgctttttttgtttgtttgtttgttttgagacggagtctcgctctgtcgcccaggctggagtgcaatgtgccatctcagctcactgcaacctccatctcccaggttcaagcaattctcctgcctcagtctcccgagtagctgggattacaagtgcctaccactatggccagctaatttttatatttttagtagagatggggtttcactgtgttagtcaggctgttcttgaactcctgacctcaggtgatccaaccgcttcagcctcccaaagtgctgggattacaggtgtgagccaccgcgcccggcctaggacgtgcttttatgtcccactctcctgtcatgtctacagagtactatcccaactgtgaggtcgtgttcatgggaatggccaacatccatgccatccggaacagctttcagtacctccgggctgtgtgtagccagatgccggatcctagcaagtaggtgttccctacttggattccttccagtctcattccttacccagtacctcttattcttggaagattagatggggagatgagaagtttggagagcaggagacctgagggcctgggtggagttgggtgccgtgggctagttccaagaacccttccacttctcagccaacactttggcgtggtcacaggacatggattcctttcgtttggatcagttgttctactcaaagaacacagagaactggggagaggaaatggctgagtgtgcatgtgatgcttctcagttcctcttttgagcttcagatgcttttatctgctgtaggtcctgtcttccctaccttcctgctagatacctcttgtccaaaaggccctgggttgtacctcttggtttcagttctcaatggggactttgttgggtggggctggctgtggatggtggagagactgctgtggcctcagcaccctttgtgaccgacttgatgtctgcttttgtgtagctggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggaggtattgagaggaattcggtgggaaaaccagaaggaatgtggcaggagggaaggtgttgagccctctggatctgtcctggggatctttcagtagaggacattggtggctctttttttctttttttttccaactcccaaaggcttggaaaattggtggctttgagtcctcttctaggtccagtcctatttttctttgaagctgccagcttcctgctttgggcagttcccaggggagtagcacatcagcatttccagagaggccctatgtttgaacagtttctttttttgcagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaagtcctaagccctgtgacaacagggatggggggaatgacagcccgaggcccccaggtgcaagctctctctgctttctaggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtgagtctgagcccttttcctgtaggtgctatttagaaacctatagggagaagcagctgagtcagtagggaaaatgtagagtcaagggcttagggaaagaaaaaggacaaggaactcttgacaaagcactagtattgggctgcttccctaggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacaggtaagaaaagcccttcttcctttctcctctctccactaggaaggcagtaactgtttcccatctcatctaaatgttctctttctttcttttttttgagacggaatctcgctttgtcgcccagggtggagtgccagtggtgcaatcttggctcactgcaacctccacttcccgggttcaactgattctcctgccccagcctcccgagtagcttggattacaggcaccgaccaccacgcccagccaattttttgtatttttagtagagatggggtttcaccatgttggccaggctggtctcaaactcctgacctcaaatgatccacctgcctcggcctcccaaagtgatgggattacaggcgtgagccaccgtgcccggcctctttctgaggtatttaaaagcaacttcttgagtcatttgcaggaaaaacttggccaagacttgtagctagcctggagtgcactctgtgtgttttcaaggtcctctgaagataaggttggatactttctttcctggaggagctgctatcactctgtatgatatacccaagcaggggagagaacaaaacagaaaggactgttttaggaaggtttgtgggaatggtcttgatttttgttcactggtacagggcatggggagcttgctatattagtagcaacctttgttgtgtccagcattagcttccagaaacatctgactctcagggaaatgggttcccagcaggaggatggccttatattactccctcagaaaaaggccagaatttaaaagggagacataaaattaggtatcttctggctcaatgtttggggagaagtgagatgatgttggttaatttatgagagtaatacctatttcttgttttaaaaaaatagtcaatataaaagtagaaaatgaaaatcttcccttatgatccttgtccccacaggtgtccactgctaacatttggtacgtgtctttccaaatgtttatctctacataggtaaatccacactcacgctttcatatggaaacattttttataaacaaaatcagaatatttttacatacgctttttacttttttgcatattctgcaaattgtttttcccgctttgtattaggttgtcttctcatgacagcacatctaaattccctttcttgtttttattggcttcagagtagtccacaatttatataaccagattcctactcatcatttaggtaatttccatttttttttttttttatcattacagggagtgctttacatccttatatgtgtagctttttaaaaatttgtaaattacaggctgggcacggtggctcatgcctgtaatcccagcactttgggaggccgaggcaggtggatcacttgaggtcaggagttcaaggccagcctggccaacatggtgaaaccctgtctctactaaaaatacaaaaattagccgggcatggtggcaggcacctgtaatcccatctactcaggaggctgaggcataagaatcgcttgaatctgggggggtggagattgcagtaagccaagatcacgccacgcactccagcctgggcaatagagtgagactccatctcaaaaaaaaaaaaaaaaaattgtaaaatacacatgctatttaccatctacaccatttttaagtacatagtttagtagggttactttgtgtgttttttttttgttttgtttttttgtttttgacagagtttcgctctgttgcccaggctggactgcagtggcacaatctcagctcactgcaacctctgcctcccgggttcaggtgattctcctgccccagcctctcgagtagctgggattacaggcatgcgccaccatgcccagctaatttttgtatttgtagtagagacggggttttaccatgttggtcacactggtcttgaactcctgacctcaagttatccaccatctcggcctcccaaagtgttgggattacaggtgtgagctcctgcgcctggccagtagggttactttgtatgcatatttttgcatttgtgctagtatttttgaatgaaaatactgtgctcaaaggatatatatacatatatacgcgtatatatatatacacatatatgtatatatatccgtatacatatatacatgtatacgtatatacatagacatatacatatatgtgtgtatatatgtatactatatatatacacacatatatacatatatacgtgtatatatgtgtatatatatctcaaattttgatatttgtttattggctgagagcttttttgttttttagagacagggtcttgttctgtcactcaggctgggtgcagtggcacaattatagtaacctcaaactcctgacctcaggtaatccttctgtttcagcctcccaggtagctaattagctcattaggcatgtgccaatttttattttttgtagagacgggtctgttgcccaggttagtcttaaattcctggcgtcgagtgatcttcctgccttggcctcccaaaacactggaattacaggtgtgagccaccatgcccagcctggctgaaagtttttaaagttaaaatataacatatgttattggttgaatattataaaggaaaacaaaaagcccagcatcccaaattattggttttagggtcttttgaactaagtcattgtgaggggaccgtgataggtttcaggatttcagtgattttttttttccttccccaaactatgcagaatttggctacaggttcataggtttacttttcctgggagaggggccataacttttaatcaaatttttaataagctctgtgacccatttaataatcatttcattaacttagtatctgatttatcaattcaacaaatgtttctttaatacctacaagttgcgtattactgtactaggttttgtgggctacagcaaagaaatagaagatattggttctactttcaagataattttaagctgtaagataagacacagaacaactagagagagcaattcttttttttttttttttttttttttgagacagaatctcgctctgtcaccggttggagtgcagtggcgcaatcttggctcactgcaacctccgcctcccgggttcaagtgattcttctgtctcagcctcccgagtatctgggactacaggtgcccaccaccacacctggctagttttttgtatttttagtagagacggggtttcaccatgttggccaggatggtctcgatctcttgacctcgtaatctacccgcctcggcctcccaaagtgctgggattaccagacccggccaactagagaacaattctaagtcaacatctaagcagataagaatgtgtgtagttcaggctgggtgcagtggctcatgcctgtaatcccagcactttgggaggccaaggtgcgcagattgcttgagcccaggagtttgagaccaacctgggcaacatggtagaaccccacctctacaaaaaatgcaaaaattagccaggcatggtggcgtgcgcctgtggtcccagctacttggagggctgacgtaggaggattgtttgctcccagcaggttgaggctgcagtgagctgtgatcatgccattgcactccagcctgggtgacacagcgagaccttgtctcaaaaaaacaaatgtgtgtagttcaaagctttagagaaatgatgtgttttttaaaagggtcacttggtggctgttttactcaggaaattttcatgaaggaccagacaagaactgtgggtctttttgtgttctgtgtatctggcttagaacctggcacgtaataagtaaatttaaataaatttactaaagtaaaaatttacttaaaactggacaaatggctgggcgtggtggctcatgcttgtaatcccagcactttgggaggccgaggcgggcggatcatgaggtcaggagatcaagaccatcctggctaacacggtgaaaccccgtctctactaaaaatacaaaaaaaaaaaaaattagccgggcgtggtggcaggcgcctgtagtcccagctactctggaggctgaggcaggagaatggtatgaacctgggaaggcggagtttgcagtgagcagagatcgcgccactgcactccagcccgggcaacagagtgagactgtctcaaaaaaaaaaaaaactggacaaatgaatgaaataaagggagttgtgagctcagtaacaaggttagtggagaggggtccaaagcaagtggatacatgagaggtagggttttctcgctccattgcccagctggagtgcagtcacatgatcttctcagctcactccgcccaccgggttcaagtgattcttctgcctcagcctcccgagtaactgggattacaggtgtgtgccactacacctggctaatttttgtatttttagtagagacggggtttcgccatgttggccaagctggtctcgaactcctgacctcaagtgatccgctcaccttggcctcccaaagtgctgggattataggtgtgagccactgcacctgggtgagaggtagtttttttttttttaaaaaaaaaagaagttctgtggctggcaggggttgagaaggggctattttaaggaatagtggaaatataggacaggtcattgagggcattgaaggctttaaacattacagtgaagagtttattttgattcagttgtcaataggaagtcattgtaggaagttactgtggtctgctgacagtgggatccttggagaactaatcagtgagtacagggtagctggaggcacagagaccagccagcactgctgtagtagttcagatatgaggggaagagtccctggcaaagagaaaggattaaattcagaagcactgtagagaaccattggcaggctacagaattgaaagttggagagtagaagtgaaaagtactttgggtcccaagtatctgagcttaaaaagtaggagaatattagtaccactaatagacattgaaaggtcgagaagaccagccagtttggggagaaagcggagatacagggaaattgggattgaaatattagttgacagcaaagaaggaggtgtgttgtaggcagctcaagatggagagtagatttcgagaaataattggtataaagattttaaaggaaatggtctctgtaacaactgacctgacttacctttgattctacctttccctagatcaaaaatgtccttcttcttctccttcttctccccctcctccccctcctcccccctcctcccccctcctcccccgcttctccttctccttctcctcctccttcttcttcttcttccattaaagtcataaacacattcttctatacccatctcaaatcctaccctctctctgtagccttccttgacctcctagctggatgagctctctctccttgttgtaaactcaggtattattatctctgtcaacattgctgactaacctttggtacacatagaatgagttgtggaggatggcagaatgttgttatttgaatttggatgaagagcacatggaagttaattatattcttctttttgttgttgtttgagacagagtcttgctctgtcacccaggctggaatatagtggtgcgatctcggctcactgcaacctctgcctcttgcctcccaggttcaagcgattctcatgcctcagcctcccaagtaggagctgggtttacaggcatgcaccaccatgcccagctagtttttgtatttttagtagagatgggatttcaccatgttggccaggctggtcttggacttgtggcctcgagagatctgcctgccttgacctcccaaagtgttgagattataggcatgagccactgtgcccagcatattctttacttcttttgtatgcttgaaagtttccataataaaaaataaaatgaaagaagtcagctgtggcacttaaaagaatacagatccctaggccccactcttggccattcttattcagtaggtcttgggtggaccctggttgtctggatgtctaagaagatccactaagatgcctgatgtgtatcacacattcaattggcacctagcagtggaaacctgatgttgtattttgagctcattcattcatttctcaagtcatttgcccctggtactgtgctaggcgctggggattcaaataagacagagtcctgccttcaggacacttcagtagagggagttaaacaagtaaacaataaagtgcaataatgtgttataggaagcactgagcaatgtgctttgatgtggattcttttgtttaatcttcataatagctttaagagctaggtactttacctttattccatagatgagggatctgaggcgtagagaagttaaagtcacacagcaaagatgttgttaaattgggatttgaaccctgcctatgggactccaggaactataatgataaccactgttattgccttcctggaatttcgtaccattaaaaaaatcaaaattcgtcacaaaaggtatatcaagtatgtataaaacatttgttttaagtttcaaaaaccgattacttaaaataagctgcgttgtaactgcctttggggaatttttccgcataggctgaactgactgagccatctaaaaataggaggccagtgaagcctctactgtttccctggtgaatttcactcaagttttcattgctctaaggactttgaactgcattaataatcaggatggtcactcttgaaaatgtcccttaacctatctggtatatatgaatgcctctagaactctgagtgctatatactaggggaagtttcatggggccttgggaagcagaggagcacactgctgctaagtggttatcaagagcagtgttgagggagttgtgttgtcttaataaagtttgtggttattatgtttgtggttggttgcctgtattttgaattctcatagcatctctacaaggtatgatttattatcatcattgtataaagggagaaaccaagtatctgagaggttaatttacttatttgtagtcatgtagctaattagcgtcagagccaatattgtctagctccaaaacccatcttctttctgttttactgtgatggaggcagtgggatattgggtttgagtctcaggtatagtcctagctggaacagtagattcagaaggcattggcatagaaggcagctgaaaccactgtagtggttgagattgcccagggagactggtaggttgagtgctgacaaaagctgaggatagatttttgggttccggaggacacggtccatgtctcatgctttttttacagagtaaactttcagtgaacattggttatttgtgatcttaagggtccttatttctaaacttaagtgttcttaagtgtcattatttctaaactctggctttgatattgctccattgattcagttccatatattgtattgcaagtgcccatctcctgacctggaggtgttatatttgtctttccagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttgtaagtagtcaccaactgccatacacccattatttactctgttcatccagccttccctccattcagcatttattcgttgggtacttgctgtgtgccactgagttaggtgcctgggctataggatgaaaaacaagtaagcaattagaatgatgtttttaagtgctatgattgaggaggcatcaggtgttagagggctggagtggagtgaaacgtcaaggaagactttcttgagaaggtaatgcttgagctgagtgctgaagaatgtgtgatacttagccaggtagacagtgaaaacaaaacaccatttgcagaagcgtagtggcaatagatactccaatgatacggcttaaaaagatgggacatgcgagtatatatgtgtacatgcatgcatacacgcttacactggggctatgagagacagtcaaatagggtggtgggaggtgacattggagaattaggtggagattacaagggtcaggttgagtgcccttcttgtttggattttacccttaaggcaataaaattttaggccagtgcacaatatgatcagagttgtagtttaagaaaatgactcttgcaacaatgtacaatttttttttttttttttttttgagacggagtctcgctctgtcacccaggctggagtgcagtcgtgcaatctcagctcactgcaacctccgccctcccgggttcacgccattctcctgcctcagcctcctgagtagctgggactacaggcgcccgccaccatgcccagctaattttttttttttgtatttttagtagagatggggtctcactgtgttagccaggatggtctcgatcccctgacctcatgatccgcccacctcggcctcccaaagtgctgggattacaggcgtgagccactgcgcccggcccaacagtgtacaattttaatgaggcagttgagacccagattgggaggctggtaaggtcattttggaataatccaggtgagagatgaagactataggctgtgcagtgttgggcagcctcaggttctggcaccatagtccttggggagcttctaggagccagcttcctctccatggtatcttgccatttacacagacactttccttccttctgttaaggtgctccccacttgcctgcttctcacttctctggtgctttaaacaggagtcagcaaactttttttttttttgtaaaaggccaaataataactattttaggttttgtgggccataccgtctatgttgcaactactcagctctgctattgtgcaaaagcagccgtagccaggcactgtggctcacgcctgtagtcttaggactttgtgaggccgaggtaggtggattgctttagccaagaagtttgagaccagcctaggcaacatggtgaaaccccatctctacaaaaattacaaaaaattagctggacatggtggtggacgcctgtggtcccaactactcaggaggctgaggtgggaggatctcttgagtccaggatgttgaggctacagcgagccgtgatcatgctgctgcattccagcctgggcaaaagagcgagaccttgtctcaaaaacaaaacaaaaagcagccatagacagtaagtaaatgaatgaatgcagctgtgttccagcaaaacctgatttacaaaaacaggcagtgggctagtttggcctgtgggccatagcttgccaacccctggtttagaacataacaagagtctttctatgctgtggtgtagcatatcggtaagagtgtaaatctgaagctacaatactaggttcaaatcccagctttactacatatcagctctttctctgtggcttcattttcttatttgtaaaatggggatattagtagtatacattgtaagactgtcataagaaataagttcatgtgtgtaatgcacttagcacagtgcctgacacatggtaaacagtaagcgttaatgatgatgaagataatttgttgtctttgccttttcatcagacatgtttgaaggagtcagatggcagtgatactgaggattttggctctgatcacagtgaagactgcctttcagaagcaagctgggaacctgttgataagaaagagactgaggtatgtttaggcacatatgtggtgggtacttacgtgagccagtgagtcatcatattttccagagatgaatgacatgctgtagactgagctgtcccccagaggagtgtcagcctggtaggcaaatggtagccagttatgaagataagccttgtctctttctgctggggtgctttcctcattgcaatgttgctcttccagtctgtcaacaaggaccaggaatttttctttgtgccttctattaggtgactcgctgggttccagaccatatggcatcacactgctataactgtgactgtgaattctggttggccaaacgaagacaccattgcaggtaagatgttttgtatgatttagtatgactcaaaaaacagggcaggccaggcgcagtggctcacacctgtaatgccaacaccttgggaggccgaggcaggcggatcatgaggtgaggagattgagaccatcctggccaacatggtaaaacctgtctccactaaaaatacaaaaattagctgggcgtggtggcgcatgcctgtaatcccagctactctggaggctgaggcaggagaatagctcgaaccagggagctggaggttgcagtgagccgagattacgccactgcactccatcctggcaacagagcaagactctgtctcaaaaaggacaaaaaacaaaaacaaaaatagtgtaatacatatgtatagaactaagtggaattagtttggaagtggacacctctttatagaaactatttttgtttgtccccaacttttcatttagtatcactcattctcagtatattggcatttcttaatattaattaattaattatttttttattagcgatgggctcttgctatgttgctcaggcaagtctcaaactcctggcctcaagcgattctactgcctcagcctaccaaagtgcagggattactggtgtgagtcaccctgcctggccagtatattggcatttctgatgaactcttccctctttctgctttgacagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctt

SEQ ID NO: 15675 - DNA, 49848 bp, Human
  misc_feature (1)...(49848): n = A,T,C or G
atttaatccacactaaaaaaatttatttttatttttattttttattttttttgagacagagtcttgctctgacacccaggctggagtgcagtggctcgatctcggtttactgcaacctctgcctcccgggtccaagcgattcttctgcctcagcctcccgagtagctgggactacaggtgcacaccaccacgcccaactgatttttgcatttttagtagagacggggttttaccatattggccaggctggtctcgatcgcttgaccttgtgatccacccacctcggcctcctgaagtgctgagattacaggtgtgagccaccacgcccggccgaagcaaactttttaacctgaatattggtatcagtacttatgatctatgtgtggtatcccttgagaacttgtaaattagggggaaagactagcctctgagaagtaaactatgaaacacaccctgtgtccattagatgtataaacagtgtcacttgaaagaaatggatgtacttccaaatccactgctctgatgtggagaaagtagtcacatatctgaagatggaaggaatccttcaaaagaaagacacacacacacacacacacacacacacacacacacacacacacagtaaaatcacattaagggctgcttttttttttttttgacagagtctcactctgttgcccaggctgaagtgcagtggcgggatcttggctcactgcaacttctgcctcccgggttcaagcgattctcctgcctcagcctcccaagtaactgggactacaggcgcgtgccaccatgcccggctaattttttctatttttagtacagacggggtttcaccgtattagccaggatggtctggatctcctgacctcgtgatccgcccacctcagcctcctaaagtgctgggattacaggcgtgagccaacgtgcaaggctttttttttttttttttttaagatggagtcttactctgttgcccaggctggagtgcagtggcgcgatctcagctcactgcaacctccacctcctgggttcaagtgattctcctgcctcggcctcccagagtagctgagattacatgtgctcgccaccacacccagctaatttttgtatttttagtagggatgggatttcactgtgttggccaggctggtttcaacctctgacctcaggtgatccacccacctcggcctcccaaagtgctaggattacaggcgtgagccaccacgcccggccaagggctgcttttttatggtgtttgcagtcccagaggcaaaatgacaatatacatgagatgaatattgggctcccctgccagcggggagcccatgtgtacatgttgctgacactattgtttcctatctctgtggcggtgatctctctggtaaatgagtaaagtggcttctcacttatgaattggccttccaggtagtttttttttgtttttttgttttctgtttttgttgctaggctggagtgcagtggcgcaatctcagctcactacaacctctgcctcccgggttcaagcgattctcctgccttagcctcctgagtggctgggattgcaggtgtgcgccaccacgcctggctaatttttgtatttttagtagagaggggatttcaccatgttggccaggacggtctcgatctcttgaccttgtgatccacccgcctcggcctcccaaagtgctgggattacaggtgtaagccaccacgcccggcccctctgggtagtttttctacagagagaaattaatatataaggaaatgaattgtttctaaagtacagtggattagaaaaaaaaataaagaagttaagtgacttgcctaaggttacccagcttcatctgatttcttttccccccactccactctttggtttcctaatttactcttttgtatgactttttccttacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggcaagccctgaagttgttgggagtttatttctgcttacctaactcaggagaatagggagttagagacaagatgaagctagagaccaagttgtaagaaattttggaaatcctcattttattacaccatttctgtgttcttgataatagcctaactgcttaacttggtgaaagcagcatggaattgaggaggggagctagggaggttcaacacatatgcatagtaggggcaccctgtaggcacttagtggagattcagtgaatggtagctattattattgcttttaaggtattggcaataacaataaactagttaattaggactaaagtcagtctacccaacaggaataagagggagtttatcagatacttagatggtttctaaagcaccagtgacattcaggatgactgagactatgtccttgacaatatttcctgtgttacaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggtatggccttaattcacaggttgtgttagtttgacacaaatgtgttctgagagtcacatgagctgcaactaattgactcctctaaactgtagatgtaacttgtttgttttgtgagataaagtctagctctattgcccagactggagtacagtggcatgctctcagctcactgcaacctccacttcctgggttcaagtgattctcatgcctcagcctcctgagtagctgggattacaggcatgtgccaccatgctgggctaatttttttctttttttttttttttgagatggaatcttgctctgttgcccaggctggagtgcaatggtggggtctcggctcattgcaacctccgcctcccgggttcaagcaattctcctgcctcagcctcctgagtagctgggattacaggcacgcacaaccatgcccagctaattttttgtatttttagtagagacggggtttcaccatgttggccaggatggtctcgatttcctgacctcgtgatccacccgccttggcctcccaaagtgctgggattacaggtgtgagccactgcgcccagccttactttttaaatttttagtagagacaaggtctcacgatgttgcccaggctggtcttgaactcctgaactcaagcaatcctcccacctggtcctcccaaagtgctgggattgcaggcatgagccaccacacctggcctaaaaaagttttttttttttagagatgaggtctcattatgttgctcaggttggtcttgaactcctggcctcaagcagtcctcccactttcgcctcccaaagcacttggattacaggtataagccactttgcccaaccaattttactacattttagtacatttgaaaaccttagaatttagaactggaaaggaccttgcagtcatcaggcttaatgccttcatattacagatgagaaaactaaggttcagagaggttgtaacctgctcaggatcacagagaacttgttatagaactggaacccaggccttccaattccagccaaatgaccattcactctgactctccttcagcagtgctggaggcctccagagtggccctgtaacctcattactttgacagcttagtcccattctctgtaagctgtacacctgtaaaccaggggtggtgggtggtcaatcctagcataaattttttagttttttcattactcccataatgtaatggctccttgggtggtatctaggctactttttttttttttttgagacagtttcactctttttgcccagactggagtgcaatggcgcaatctcggtttactgcaacctctgtctcccaggttcaagcgattctcctgcctcagcctcccaagtagctgagactacaggcatgcaccaccatgcctggctaattttttgtatttagtagagatggggtttcaccatgttggtcaggccatggtggtcaccatgttggtcaccatgttggtttgagaccactcgaactcctgacctcaagtgatccacccgccctggcctcccaaagtgttgggattacaggcgtgaaccaccacgcctggccctaggctactgttatcagatgctcaccaagagcataactttaactgagaaatagtcaaactcttttgtgtgaaaagaaggctatgaacgtggtccttaagattcaggggagctgggcacggtggctcacacctgtaatcccagcactttgggagagtgagacgggaggatcacttaaagccaggagtttgagagcaacctgggcaacacagcaagaccccatctctataaaacaaaagaaaacaagattcaggggcctctaatttgcatgtcctgacagttatgcatgtttggacacacaataaagcttagaatatttcctccatggctagacccctgccctgacaacaatttctgcctcattccatgtcaaaataggagctttcccctaggggacacatactccctcaccctttgtgagtgtatccagtagtcttccacaactgggaagggggtgggaaaataaaaaactttttttttttttttgacagtctttgcctcttgaacaagccaaggctgcttagctgccaaatatgttcattttaatgagttgcattttgctgtttttttcaataggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatggtaagagactttcaagggggacattttggcaaaagatccaggaaaagaaatggttgtggctggaaacctttcacccaagtctccaaagtaaacactggggatcagtcagagataagccatcaggtaacctgagtgggaggaaggggcatcctaagcaggaccccagggctgggtttgacgttgcccctaacctatgtggagggactgacatatatatgcaactgactcatagcaaggtgctcttagctttgggaaatcagtcctccatggtggaattccaacgtagatactctctgtctcccagttcagacccaacacacagcccattgtccttctctgtaaattcgtatgtatcaaattgaaccatattaaattgctgttttattagttaaaatggtcaagtattggcaattttgcatggctcaacttattgaataaagtatcttggataggtattaatctccattctaagctgctattcattcattcactcattcaacaaacagctatagagccagaggctatctagactctgggttttttcttttttttttttttttggagacagagttttgttcctgttgcccaggctggagtgcaatggcgtgatcttggctcaccacaacctccacctgtggggttcaagtgattctcctgcctcagcctccctagcaggtgggattacagtcatgcgccaccatgcctggctaattttgtatttttaatagagatggggtttcttcatgttggtcaccgctggtctcgaactcctgacctcaggtgatctgcccacctcggcctcccaaagtgttgggattacaggcatgagccaccttgcctggcctagactctgggttctgatgatgaataagccacaaactctgcccataagtagctcagataacagctggggactgagggacctggtggatcaaagaaaacccctcagaggaggtgagcagacaccatgggagctggctaggaggtatagcttgcagagaggctcctccgtgagtttccttaaggacagggccaacatctgactcctcctgtgtcccagcacctagcatggtgaccagtacatagaaggaactcagtaaatagtcagtgaaggaatgaggggatgaatgaattaatgaatttgaacaagttcacactcagagagctggctgcctcttgaattttagaattttagagttggaagatcccttagacatggattagccctgtcaatttacagagtgtgaagctcaagcccagtgatataaacttcctgaggcccagagatgtcaagatgcgggtggggtgggagaggtctgcctcattggaaggcggatgttattactgatattatttagaatagctggcccatggtgataaaaagcaggccaacttttactgggttttgttactgttttagaattctccgcttaagagttatcctcttttttattttttattttattttatttattttgagatagggtctcactctgttgcccaggccggagtacagtggcacgatctctgctcactgcaaactctgcctcccaggttcaagcgattctcctgcctcagcctcccgagtagctgggactacagtcacgtgccaccatgcctggctaattttttgtatttttagtagagacaggttttcaccatgttggcccagctggtcttgaactcctgaccataggtgatccacctgcctcagcctcccaaagtgctaggattacaggcatgagccaccgtgcctggccatgtcacccttttattgcctatacagggaagatagctctccctgccacctctcaacttgctgtgctacaaccaagggccaagttggttaggggcaggtctcctgactcctggtctgttgttctttcattgtacaatactgaatcttagtgaggcttcagtcctcacttagaacatttggaaaagcattggcatttatttttgctggagtgaagtggcactgtcatggctcactgcagcctcaatcttctggactcaagcgatcctcccgcctcagacccctgagtaggtgggactacaggctgtatcagcacacctggctaattttgtgaattgtagagatggggtctcagcacgcccggctggtatttatttctttatctttttttttttttccatagagatggggtttcactatgttgcccaggctgctctcaaactcttgagctcaagcaatccacccgccttggcctccaaaagtgtgggattacaggcaagagccaccatgcccagctgtcatttgtttttatataaagagaagacacagccaggtgcagtggtttattccagcactttgggaggccaaggcaggttaatcgcttgagcccaggagttcaagaccagcctgggcaacataacgaaaccctgtttctacaaaagatatcaaaattagctgggcatggtggcgtgtgcctgtagtcccagctacttgggaggctgaagtgggaggatcacctgagctcaggaagttgagattacagtgagctgaaatcatgtgacagcactctagcacaggcaacagagtgagaccctgtctcaaaaacaaacaaaaaaggcacaaagaatttacttatatcctaatatttctgtttccatagaaaattagagtttgctagaaaactgttagaaatcacttttttttttttaaatttttaaagacagaatcttgctctgtcacccagggtggagtgcagtggcaccatctcagctcactgcaacttccacctcccgggttcaagcgattcttctgcctcagcctcccgagtagctgggactacaggtgcgcaccaccatgcccggctaatttttgtatttttagtagagagggggttttaccatattggccaggctggtctcaaactcctgaccttgtgatccgcccaccttggcctcccaaagtgttgggattacaggtgtgagcgaccgcgcccggcctgaaataacttttatatattatattttgttatctattgctgcgtagcaacaacaacaaagcccaaaacctaatggcttaaaataacaatagtttattatttctcacaattctgtgggtcaggaatttgacaggttcacctgagtggatcttctgttccacatggccattggctagcatcactcacttgtttgcagtcagctggaggttggactgggcaagaaggtccaagaagcctctacttacatgtctggtaccttgagctcctccaggtggcctctctttgcacttgacttgtcattcaataaatagtctcacccaagcttctctacagcatagcagctgactttgcaagtgaaagctaaaaccaccagacctcttaaaagttagtcctgaccctaggattgtatcactttcgctgctttctgttgatcgaagaaattcacgaggccagcccagattcactgggtggggaaatagactctagctccttataggaggcgtggcagggtggacaggagggaattgatggcggccactgctggaaacaatctactagtacataggatataaaacaatgataccatatttattttttccttaaaaacatcaccctctttttctagcatcagggaaaaagccatctccatctaaatgcatttttcagacaattgaagtttatttctttaatttcttagttcttaaaattttaattatattgaatgaaaacgttacaaacttcatgatattctaaatatctattttgattatattctaaacatattctaaccttttcttggtgacagtggtatttttctgaacacctgttatggtgaagcatcatgatatagggctgtcttaagcttctgctaaggagtgtttgcccatacaaaggcctctggatcttatacttcagggagcatgtagtaattttttgtgcctccttctcacttttacacatcttgctcccatctcaaactccatatttgttgccttaatttgctgtaggctaggaaatataattaactaagtttgttaaaattatgttaaaattgggataagtagagctaatagtctcttgaataaagagcacagactttcatttgttttacttttgctgtttcctaagtattgtaacctttattgtattctgttttattttcatagcatccccagtggtaggtattatcattcttattttatggataagtacaaggtcttactttatggataagtacaagattctcttagtgtcagggtgcggtgtctcacgcctgtaatccctgtactttgggaggtcaaggagggtggatcatttgaggtcaggggttcgtgaccagcctggccaacatggtgaaaccacgtctctactagaaatataaaaaattagctgagtggtagtggcgcgcacctgtaatcccagctactcaggaggctgagtcatgagaatctcttgagcctgggaatcagaggttgcagtgagccgagaccaggctactgcactccagtctgggcaacagagtgaggccatctcaaaaaaaaaaaaaagaaaaagattctcttatgttagtctgaataacacttagactagaacccaagggcctttactcctgccacaaagatctgctgtcttcatattcatataggagggggaaaatgctcaggaaagtggattttttttttatttctatcttgtctgcttattctccacttgtatcctgtctgggctaggttcctggagaccaacatttctgggtaaagacctccagataagctgggcacagtggctcacgcctgtaatcccagcactttgggaggccgaggtgggtggatcacaaagtcaagatatcgagaccatcctggccaacatggtgaaaccctgtctctactaacaatacaaaaattagctgggtgtggtggtgtgcgcctgtagtcccagctactcgggagactgaggcaggagaatctcttgaacctgagaggcggaggttgcagtgagccaggatcttgccactgcactccagcctggtgacagagccagactccgtctcaaaataaaagcaaaacaaaaaaagacctccagataagagatgggttagcagataggaaacatgcaaaggaaaatcctggtaggtctggttatttctatacatttagcaagaatggctttgaaaatagtgtgacagtgaagagagtgggaattctctcatcaaagccctgaaacatgtttattgctttttaagctgccgactctttgtgaccctggaaaacagaacacagatgaacaatttcagtgcactcaaggagccaaggacagtttggaaacaagcaggatccaaaataccagtaggtgggtcaacattttgttgttcttaatgtcactatgcctttagacttctgtgtgtctctgaggccactcagtgatcttcttatgtctagtgacaaaaggactgtgagtgatgaagaagagtaatgcagattggcaggttctcccactgagtgagtaggaagagcagtgtcatgggaacttgaggagacatcaaagcccaagtggctggcaggttaatcagacagaactcatcagttgttagaagcaaagcatcttgcctttccgcaactgcccagatagtttttcttataaaaacaaacaccaggtattccatttaccagtgctccagaaactaaactaattggaaaccagggttgtttaaagtaagtgtcactgactccagagagagttgaacaacatcactatgaccctggggtgtgtgatttccagccagacgaatgaaatgaattgactttagcacaaattactggaagaagagtgtgtgtgtgtttgtatatatgttcatacacatatatgtatatataatatattcatacacatatacgtatatataatatattcatacatatatgtatatgtattcatgcacacataggtatatatgtattcatgcatatatatgcatatacacatatattcgtgcatgtgtatacatacatacatatattcatacatacacacacacatgctgagttttaaagaacttaagtaaaacaggccgagtgtggtgggtcacgcctgtaatcctagcactttgggaggccaaggtgggcggatcacttgaggtcaggagttcgagagcagcctggccaacatggtgaaaccccgtctctactaaaaatacataaattagccgggcgtggtggcgggcacctgtaatcccagctacttgggaggtggaagctcaataatagcttgaacagctgggtgcggtggctcacacctgtaatcccagcgctttgggaggccaaggcaggcagatcacgaggtcaggagatcgagaccatcctggctaacatggtgacaccccgtctctactaaaaatacaaaaaattagccgggcgtggtggcgggcgcctatagtcccagctactcgggaggctgaggcaggaaaatggcgtgaacccaggaagcagagcttgcagtgagaggagatcgcgccactgcagtccagcctgggcgatagagcaagactccgtctcaaaaaaaaaaaaaaagaatcactcgaacccaggaggcagaagttgcagtgagctgagatggcaccactgcactccagccttggcaacagagtgagattctgactcaaaaaaaaaaattaaataaataaagaacgaacttaagtaaaacaaatttatttggtgtgtgggaattttttttcaatttttaaaaaattgattaaaattttttttggtttaaatttagttaggtattataagtaagggaattactaaaagggcaataatttttttttctttcttttttttttttgagatggagtttcactcttgttgcccaggctagatagagtgcagtggcgtgatctcgactcactgcaaactccacctcctgggttcaagcgatcctcctgtctcagcctcctgagtagctgggattacaggtgcccaccaccatgcccagctaattttttatatttttagtagagatggggtttcaccatgttggccaggctggtcttgaactcctgacctcaggtcatccacccacctcagcctcccaaagtactgggattataggtgtaagtcaccactcccagccaatatatgtttttcacgacagactagtatatcagttttagtttttttttgttttttttttttcctgtggataaatggtagcactaatccacaactttgaagtcagttctcctggaaaaaaaaactttttattcctcgccctagtggggattgagactaatgacgagtttgctgtttgtttcatgtgggcaaatatgtatgtaagggagaatgaaggaaaatgtccacacattttatttatttattttttatattttggaaaaggagtttcgcccttgttccccaggctggagtgcaatggcgcgatattggctcactgcaacctccacctccccaggttcaagcgatttctcctgcctcatcctcccaagtagctgggattacagacatgcaccaccaggcctggttaattttgtattttttagtagagatggagtttctccatgttggtcaggctggtctcaaactcctgacctcaggtgatccacccaccttggcctcccaaagtgttgggattacaggtgtgagccaccgcgcccagccagacattttagatcagtggattttattcctatgaagggaataatgaagaactacctagctggcatcagagtgtttggcactcacaccactgatagaagcaaatgggatgacatagccattagatgacaaagaaaaacccatagttgttgtggcctcccctgctcggcaccctcttccctcagaagtacaaagaacagaccaaaaaaaagtttgacatttttccacctgttcctctagtctttttgtgtgcttaaaaaaaaagtgacaattacgatatgtgtaagcaattttatgtcatgattttcactttacattagaatgtaaacattactctatgttattaaaaaaaaaaaaccctgtaaacttattttgaaattgttgggctgggcaaggtggctcccacctgtaatcccagcactttcggaagccaagacaggcagatcacttgagcccaggaattggagactaccctgggaaacatggcaaaacaccatctctacaaaaaattagccaggcatggtggtgtgcggctgtagacccacaccctctcctacttgggaggctgaggtgggaggatcacctgatcctggggaggtcaaggctgcagtgccatgattatgccactgcattccagtttgggcgacagaataagaccctgtctcaaacaacaacaacaacaacaacaacaacaacaaaaatagttggatttcacctattgttgaattttaggttgcttcattctttattctgttatgaatagggacacagttacttgtaaataatgctttgtttttgcattttggattatttcctcaggatggattctcagaagcagaattacttggtcaaagggtttgaagattttaaggattcttttcccctcctttttaagacagggtctcgctctgtcgcccaggcttccttgcagtggcgcaatctcagttcatggttttttttttttttttttttttgacacagagtcttgctatgtcgccaggctggagtgcagtggcgcaaactcggctcactgcaacctccgcctcctgggttcaagcgattctcctgtctcagactcctgagtagctgggattacaggcgtgcaccaccacacccggctaatttttgtatttttagtagagacaagatttcaccatgttgtccaggatggtctccatctcttgactttgtgatctgcccgccatggcctcccaaagtgctgggattacaggcgtgagccaccacgcctggccaatctcagttcactttatggggccaatgtgtgagggtcgcttgaagtctgggagtttgagaccacgctgggcaacaaacattgtgtgacttcatccctaccaaaaatacaaaaactagctggctgtggtggcaggtgcctgtggtcccagctacttgggaggctgaggtgggaggatcgctggagcctgggaagttgagcctgcagtaatctgtgattgtgccactgtactccagcctagtgacagagtcagaccctatctccaaaagaattttatttttttaaaaaggaagctgatcagatctaccctctctgattcagcagtctctctgctttctggtccagctggagagtagggcattctagataacagggaattcnnnnnnnnnnnnnnnnnnnntctgtgccacagagcacacacttttttttttttttttttttgagacggagtctcgcactgttgcccaagctggagcgcagtggatcttggctcactgcaacctctgcctcccgggttcaagagattctcctgcctcagcctcccaagtagctgggattacaggcgcccgccacccaatgccagctaattttttgtatttttaggagatacggggtttcaccatgttggccaggctggtcttgaactcctgacctcatgattcacctgccccggtctcccaaagtgctgggattacaggcatgaaccactgcacccagcctacacttttttttctttggaaatagagtctcgctctgtcacccaggctggagtgcagtggtgtgatctcagctcactgcaacctccgcctcccgggttcaagcaattctcatgcctcagccacctgagtagttggtattacaggcatgcaccaccatgcccagctaattttttgtttttttagtatagagttttcaccatgttggccaggctcacctcaactcctggcctccgcctgccctggcctcccaaagtgctgggattacaggtgtgagctaccgtgcccagccagttcatgcgtttttgaaaagttaattgaatagatgataaaatgtacatgttcatgagatatttataaactttatttgtttattttttttctggagacagagtttcactatgttgtacaagctggccttgacctcctgagctcaagtaatcctcctgccttagcctcccaagtagctgagactacagacctgagccaccatcctggctagttatgggatatttagaggaaaaaaagacgcctttatgttgcaaatgaggaagccttggcctagagagattgatgtttgccaaagtcagatagtaacctagtggtaggtcagggtctagaattcagtgggactagattgaaggtctctgaatgttcttcaggatctctgatgccttaagactgtttttacaaacgttaggccgggcatggtggctcacacctgtaatcctagcactttgggaggccgaggtgggtggatcactcgagataaggagttcaagaccagcttgggcaacataattttctactaaaaatacaaaaactagccgggcatggtggcgtgcatgtgtaatcccagctacttgggaagctgaggcatgagaattgcttgaacccaggaggcggaggttgcagtgagctgaggtcgtaccactgcactcctgggtgacagactgagactctgtctcaacaactacaaatgttattgtgctgtcactgatatgaaggtgggcctgttaccagagaattctgatggacgggcaggagcagaaccctcacctgaaccatcacctgtgatttgtggcatttgcaggggaggctctgcaacagcccagggattgtgtcttgtgaaactgcgcttcaactgcgggtttcttctacctctgaaaatctcccaagagcacttttataatcatgaaatctaaacttagaaactaaaaatactcttagagatcttatagctcagtcctttcatttcttagccagggaagacctagagagtccactgcccaagccaaagccacacagtttaatagtgcactcttcactctgtcaagccaccggcagggaccttctgcatcacccagctgtcactgggactctaccaggtaaggatccttgtgggctggaaactggtggtggagcgggggtgggggtgggttctggcaccctctgctggtgcaaaggggtcagtgcaactctaggaatggcttagggagtagggaacaggtcctctggatgggctggtgggcttttggttctgtcaagaacttgagcaaactgatgtgtttgtgtccaccccgctccccctacctccaaaaaacccgtgcaattcaggatgagtgtggaacctgtttcttctgaaatctataatgcagagtccagaaataaagatgatggaaaggtacacttaaaatggaaaagtgagtataaagtcatgggttttattagacaaaatgaaatttaaagtatatttctaatgtggttgatatttctaagtacacaacctgtgttgcacatttagaaccatagcaatgtccttctgaatttttttcttttattatatttcattttaaaagcagggcccttctgactacagacttcagaagggaaatgctttttttttaatttctagactttataggaaatatttctaatatataaatgtatattgtataagaaatgtaacaaaacagtgcacaatacaataagtcctcaccttattctgttaataggaaatgacaatgactttaagcaaactacgactttaagcaaaacgatgtataacaaaaccaattttaccatgggctaattgatgtaagcaagagttaagttcctatagcatatttctggtcacaaatacatcaccatacttctaaataaagaccaagacacttctaatattaaacattgaaataaatgtgagctatgtacacatttaagagagattaataaaaacaagtaagataagtaattacctgtttattctagttcagggtcacaggtggctggaacctatcctggcaactcagggtacaaggagggaaccagccctagacagacaccattccattgcagagtgtactcacacactcccactcacacagactggggcaacttcaacacactagttcacctaacgtgcacatatttaggatgtgggaggaaaccggactacctggaaaaaacccatgcagatgcggggagaacatgcaagtgccacacagacagtggccccagctgggaattgattgttttttttttttctcatcagagttacaatgaaacaatgttgaataaaatgacattatttgaggaactgctacatagatatttactatataacattataaaagtggagagtatgcagtgtcactctcatatcctgtgggcattattctttgtatcagttttctcttacaggcttaaaggatataatgtctatttttaatactagtcgtaagtgacattagcagaagtgtttgacaacatttgaaatgaaaacatgcatatatgtatgcactccaaaaatatgagctcagtgtagtctggaaagactagacaaactcaaatagaatactttctattattacacactaagaactatagatgtcatttttcctgttaaaacttcacaggaagagggtctatctgtaagttgtttgctgcctttcaccctggaagtaagcaacaagggctgttgtttgggataactgactgaaattcccttctctctctctgtcatcaattctcccctgacctcccattcaagccaaacagggcaagctaaggatgatgcaactgtaaaaaggcaattgttacactatgagttataatagtattatgtatttcttttagatgaaagcctgtgtttccagtgtttacagtgatgttttaaatgctgctttctcttatgcacagtggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtaagttcacttgcgggaatcaggataggtgaactcaatcaagtatcagtcgggcgaggtggctcagcctgtaattccagcactttgggaggtgaggcgagcggatcacctgagcccaggaatttgggaccagcctggtcaacatgatgaaacctggtctctacaaaaaaaaaaaaaaaaaaaaaaaaaacattagctgggcgtggtggcacacgcctctagttccaggtacccaggaggctgaggtgggaggatcacttggacctgagaggtggaggttgcagtgagctgtgatcatgaaactgcactccagcttgggtgacagtgagaccctgtctcaaaataaaaataaaagtaaaaaaaagttatcagctctcaaaaaagtaaactttccagcatattttttttggtttggtcctctctcctttcctacttttctggaaaccttgaattccaggggaagacagtatagccctatatctcattgcatttcccacaggcaaacagatccagacactgatcagtttttatattactgaaacaggtccctttgtccaaaggaagtaaaataatcaaatactgaccctggttttggcgaggaatcgatccttctttacctggggatagaggtaggccatcactgcctactgcccatgtctctgcattgtattctaagctgaaattaaattctcccagaatttatttagaatgtattctaagctggcattaaatttttccagagagtctatgctggaggaacctagagacacatgacatttattgtcatcggtttatagatttacaggttaaaaaaaatgaaggctgtatattttcagttgataatttgcttataatcagggcatggatattgtttcacagttgtttataagttaaagaaagatacatctaaacttgtcatttgtcttaggcagaaaatctattggcttgggtattatttgtatttagaatctgtttcttgtcaagcatcactctcgaatgggtgggcagatgatccagggctgcattttggggtcaggctaaactaacagtctctactctctggactgaacctaacgtatgggacatggccactcttggcagaatatgtatacatctcttctttcatgccacctttatcctcttccatgttgtctgaatatcactgaatgactttgaccctgactgtgttacaatcattaggtatcaggcacccatctcccagacaaaaggagcaaccagagcatagtgaagccttccaagcaagttctgacacattggtggctgtagagaaatcttacagtgtaagtaatactgcctggaaagccaagttgaacccaaagatctaataagatagaactgagttattgttatgtgttatgacaccaaaataatagctatagtagttctttttggctggagcatgtgccttcatgtcactgacatgaataaaataatctttcctcctgtctgatactttttaaaaagtcagttcaactcaatgaattgtgtatcctggagattgggagagtacagaaaagtgtcagattcagctttggcacatgagtttctggcatagtttgctaaacaaaactagggcaaagctccttccccagcaggcgactgaggtcagttaggagtaggaaaagcaagggcagggttgctatgagagtatcttcacctggaatatcctctaagggccaaactcagcacccagctcagtggaagtgatgtgtttgtgcctgacaactgcacctcagcaggatctatatgcgtttccactgcagttacagccttgcttcagggctttaacacactctaggccatagcgcagccagactaagaaaccaaaatttttttattgtcattgacatgggattgcaatcatttaaagaatatagacagcaattgagaatgatacaatatatgaatacaatagtgataaaatgtaaggtcttttgacctattgtatttaatcatggcatatgaaccattcataagatcaacttattctttctcggacttgagggctggaagaacagtcatattaaccatactggctgagctggagaagcaggcctaggcaggaaagtggggaatgtctgccggaggccaggacgaattcagtttgatgagaggtaaagaggagcagctgttaagtgcacaggaagggaagtgtgtggcaaaaagcagtgtccgaggaaattagtcacaaaatctctgccaagagatcactgaaggttgggtgtagtggctcacacctataattccagtacattgggaggctgaagctggaggatcgcttaaagccaggagttcaagaccaggctgggcaccatagtatgaccctgcctacaaaaaaatgtaaaaatcagctgagtgcagtggctcactcctgtaatcccagccctttgggaggccaaggtgggcagattgcttgagtccaggagtttgagaccagccttggcaacatggcaagaccccatctctacaaaagatacaaaagttagctggatatgctgcatgcctctagtcccagctacttgggaggctgaagtgggaggatcacctgagtctggggaggttgaggctgcagtgagccatgatcaggccactgcactccagcctgggggacagagtgagaccctgtctaaaaaaaataaaaattagtcaggcatgatagtgtgcacctgtagtctcagctattcgggaggctgaggcaggaggatcgcttgagcccagcagttcaaggctgcagtgagctgtcattgcgccactgtactctagcctgggtggactgaatgaaaccatgtctcaaaaaaaaaaaaaaaaagactgaagtgagccatttgtttggccacatagtaatcaggtcctgaatattgcgaaataagcaggaaaaaaggggtggagcagagatgctaaagaaataaatttgcaggccggtcgcggtggctcacacctataatcccagcactttgggaggccgaggtgggaggatcacttgaggtcaggagtttgagaccagccatgccaacatggtgaaaccccatctctactaaaaatacaaaaagtagacaggtgtggtggcacacacctgtgatcccagctacttgggaagctgaggcaggagaatcactgggaccccagaggcggaggctgcagtgagccgagatcatgccactgcacgccagcctgggtgacagaggaagactctgtctcaaaaaaaaaaaaaaagaaatttgcaggccgggtgtggtggctcatgtctgtaatcccagcactttgggaggcagaggcaggcagatcacgaagtcaggagttcaagaccagtttggccaccatagtgaaacccctctctactaaaaatacaaaaattagctgggcatggtggcacatgcctatagtcccagctactcaggaggctgaggcaggagaatcacttgaacctgggaggtggaggttgcagtgagccaagatcgcacctctgcactccagtctgagtgacagagagagactctgtctcagaaaaataaataagtaaatataaatttgctgctttttactattttatttttattattgagactacattgctgtttttaaaatgcttcttcatttgcctttaacctataatactcaagggactcacaggttctgagtagccgcagcctcctcatctgtaagatgatgccaacacatgggctatgtctctgcctgtgagggattagtgtgtttaaattcagtcctcaacttgagttgactagggcctttctccttatttagaatattagaataggacggtcacctcatctccacccattctgcagatgatgatgctgaggctcaggattagcattccttcatgctattccagtcagttaacagctgcttttccccaccaggaagggaaggcagaggcacatgcacaaagaggtagggagagtcagctcagtgtcacactgactgctgggtagtgttagataaccccgttgttaacactgcatccaactataaagggatttcgttacaatgaacagcaacttaaaagtgatttcctacattattaatagcatcagtccatgcaatcaacttgttcaccagagtcttctgaggatataacagatgaatttttaactccagacgatgaatatttttactcctcgactgctcaagaaaacttagctctagaggtaaaaaacgcagttcagggtaaagtaccttttcacctttctccattgccttatttcttttattgagaaaaatagcttacatatcaaagtatgtaatgtctaccaggattttttataccttttttggtgtcaggagtgtgatatgaacccatgcattcatacgtgttttgaaaaacatctgaaaatttttttatttttgaggatgggaagtcatgtgcagtttctcccaaaattgtggttactgcatttatacagcactttgtacttttttttcaaaacttttttttttttttaatttttgagatagagtctcgctctgtcacccaggctggagtgcagtggtgtgatctcggctcaccgcatcctctgcctcccgggttcaagcgattctcctgcctcagcctcctgagtagctggaattacaggcgtgtgccatcacacccagctaatttttgtatttttagtagagatggggtttcaccatgttggtcgggctggtctcaaactcctgaactcgtgatccgcccgcctcggcctcccaaaatgctgggattacaggcgtgagccaccatgccggctcaaaatgtttttattcatgctacttaattcatacttcctaatgggaaaggacaaggctatcattcctctctctgaggaagactggtgttctgcagatatacggaattaattaactccagcctgccaagttttagtgatgggagagccaggattgaggcaagggttcagcaacaaatatgagactgtccaatataccaagttttcttgggaatctgcctagcttttacaagaacctcctgtacagagtattttcatttgtaaaatgaattttgatgaattctcttatttacttattttccaccctacctccctgctaacctggcacctttttgggatcttttacctatatgaaagggaggattgtgtcaatcacagtatttgactgataagaattctaggatgcatcaaagatgtaatttcaggccaggcgcggtagctcacgcctgtaatcccagcacttggggaggccgaggtgggtggatcgtgaggtcagaagttcaagaccagcctggccaagatggtgaaacctcgtctctactaaaaatacaaaaattaaccgggcgcagtggcaggtgcctgtattcccagctactcgggaggctgaggcaggagaattgcttgaacccgggggacagagggtgcagtgagctgagatcgtgccactgcactccagcctgggcgacagaatgagactccgtctcaaaaaatatatatatataatttcagctaggtgtggtggctcatgtctataatcacaacactttaggaggctgaggcgggaggattgcttgagctcaggagtttgagaacagcttgagcaacatagcaagaccttgtttgaaaaaaaggaaatgaaacattactagtccccaaaagaccccttgtgatcccatccagtcactgcctcttccaaaaggaaccattgttctgacttcttacctcgtagagtagttttgcagactgggccagcttttaagccttctttagctcttctgataaagctcccaagaaccaaaatatctttgttggaagattgggttgaatagggatagtgatataaggaggcggagtcacataattcctcttcacaatgagaggtgagggaggacttactgaggagaggacatatgatacaaataagtacttaatgtctaggaagcaagtttgtgctttttctataaagatgcagggatcttatgaagattttcaagatttaagaacatcaagaaattattgaccttttaatatgtctgcctccagtgaacctcctttctttgcttttcttttgttcttttttagacctcgagtcccatagaagaggactttgaaggaatacaaggtgcatttgcccaacctcaagtctctggtaataagcccttagggaagattccttgagaatcacttcccttaaatttcttctgttggatcacagatgtttagagctggggggatcctgagggacagcctcgtccaaacctttcattatatggttgagaaaaccaaggttcaatgatttctcctcaatagaacaaatcccttcctcctcaccaacctcatgacatccacgtgttgtattatttatacctccccttgcatttttatagcaaatgttgttgtagtcactgctttttccccctttggtctctcaagctttcaggctccttggtgtgccacatagcaagtgcagttatctttgctaagctgacctgggggatttgcccaagctacatagctagttattaacataacaaaattagaactaggtttccatgtatttcttctccccagaaggcagtgtcaccagcattttcctttgcttgcttagcatcttagcaaagagttagtaacagttaacaatgcagattcaacttaacatctaccacttgggaggccttgggttctatataacttagcaggggctttcttttagatgagaaggtagccttggatcagtagccagggatgtggcaccagacagatataagttaactgttggctttgttacatttttaaaattgtgtactcttgttcttttaaggtatgtactcatctattttaaaagtagagttatccacctaccaacctgtgtagctatccatggtcatgtctcaaccgtctaaacccaaacagcgtagtgttatgaacttactcccttcttccactgcatactccagcttccaactgtaaccttgtgaaggcccctgccagagttgggagcattttaagaagctgtaagcttttagatcaacttttacttaaagtctcagcataatatgtattaaaagtctccagagccttgggccacccacctcttcctgcagagcctcttttttggacctgccttgtatgtggccacttaacttgtatgtggaggtgagttgagtgggatggaaaagtttagggcagacaggtcagataaccagagctagtttaatacagacacatgaagtatgtgaaaaagtctctgatttctactccattcacttctttctgcccctctctgcccccttttccttctagtgttctgatatatatccccttccacatgagaggacacaacaggggtacaggatgcagcatgctaggttccaagacccattctgcccctgactttttctgcataaccttcagcaagtcacttcaccccagggccctactttcccctggtataaagtaaaggagagggtcggactctaaagtctctaagctctaaatgttgcttcttaggaattagtttatgctttctggatatttatcattttaaaagggtcagaggaagaggaacccccaatgtctctccactggtggggtttcagagctccttggtagctgtgaaaggtggcattgttctgatgggccttcttagtgtctaccagaccacctggacctaaggaatgggatgggggtgggggagtcataggcatttggaaacagggctggatgctccatctgcccccttctttattaactaggacagtacagtggtgggaaggaaaatggatactggccctgcctgcctggagcaaagcatcttactgagaactggggaggagtaacttcagataacttgatgccaagaagaacagaagacagttgaattagctcctcagtactcaagaccccacgcccacgcccacgcccacacctagtgtttgatggccaagtggcatagttagagttcggggctgtttagttaacaaacagttcttgttttcaacgccccctggcgtctgttgacaggaaccgggtcagtttgccttcttaaaaagacaaaacaacatttgtcttcagaaataactgtggttataactgaaaggccagtaaatagcttgattgtattctgagtgtcagaatatagttctgtgctctgagcaaggaaaataaactttcagagcaaaaacctcttctacagcactcaatccaaacccaattagggcagcactttgtttatccagattatttctaattctggaccagaccaagggacattctagggaatggtgacaataatttgggttgacaaagattcagtaaaaaaaaatatatatatatatttttaactttattctttcaggtgaggaaaagttccaaatgagaaaaattcttggaaagaatgctgagattttgcccaggtctcaatttcaacctgtacgaaggtatgggctattattatcttatgcagtttcaaactcatagatgcaatgttaaatggtgataatgctccgtgtttatatattgcttgtcttcagatgtattagctactatcttataaaagttagctttgggcagcttagctgtgttaggacttgtgcagtagaatttgagggattgagtcatcacctttacttagatctgactctgactttctgttcatgtgaccttgtcaaggttctcaacccctctattctattttcccatctgtgaagcagggataagaatccttactgagaatgttgacaataggaacttaaagtaataatataactcctgggcatttatcccagagagatgaaaatttacatttacacagaaatacatacaggaacgtttataacaaatttatccataatacctccaaactggaaacccggatgtccttcaccaagtaaatgattaaacagactttggtacatccataccattgagtgcttgctactcagcagtaaaaagaaataaactattgatacatgcaacaacttggctaaatttccagagaattatgctgagtaggaaaagcaatcccaaaaagttatttactgtgtgattccattaatataacattcttgaaatgacaaaattataaaaataaagaacagatgagtggttgccaggggttaaggaaggggtggggaaaggagggaagcaggcatagctgtaaaccagaaatatctttgtggtagtagaaatgttctgtatcttgactgtatcaatgtcaatatcctggttgtgatactgtcctatagatttgcaagatgttaccactgggataaagtgggtaaagtgtattttctttttcttgagatagaatttcactcttgttgtgtgatctcagctcactgcagtggcgtgatctcagctcactgcagtggcgtgatctcagctcactgcaacctccacctcccgggttcaagtgattctcctgccccagcctcccaagtagcggaattataggcatgtgccaccacacctggctaattttgtatttttagtagagatggggtttcaccatgttggccaggttgatctcgaactcttgacctcaggtgatccacctgcctcggcctcccaaagtgctgggattacaggcgtgagccaccgcattcagccagtaaagtgtatttcttacaattgcatgtgaatctacaattatctcaaaagaaaagtttaaaaaattcataattgttataacgtatctggcacaataacattcaatttattttattctctctgggcctcagtttccttaattataattattgtagctagtatttcctaaatatctagcatatgccaggcactctgtttcattgtctgatttaatccacataacaaccctgtgaggcacataccattgcctccatttgccagtaaagaaagcaaagttcagagagtttaaatatttttttctaaggtcactcagctagtcagtcaggatagactagattatgctatatatagtaaacaactcccaaattttagtggtttaaaacaacaagtttcttctttgctcctgcttcatgtccatggctcatgggttggccaggaatgttctgtgctatattgccttctatcagacttaggctgagggaggccccatttttgtgcttccttgattgctaaggcaggaaaaatggaacacggtgagttgtgtactggctgttaaagtttctgcccagaagtgactcatcactttcactcatattttattggttaaaacaagttctgtggtcatttatgtaaatcaagagggccaaaaagtcctgttgtattatttagaaggagaaacaaacatttttggtaacagaattaataaagtcacaactcaaccccaaatccatgatctttcatttatatcactggtctcagaggatttttgcaaggattaaaaatgtgaaggacaggcacagtggctcacacctgtaatcttagcactttgggaggccgaggcaggcagatcacctgaggtcaggagtttgagatcagcctgaccaacatggagaaaccccgtctctactaaaaatacagaaaattagccgggcgtggtggcgcatgcctgtaatgccagctacttgggaggctgaggcaggagaatcacttgaacccaggaggcgaaggttgcagtgagctgagatcgcgccattgcactccagcctgggcaacaagagtgagactccatctcaaaaaaaaaaaaaaaaaagtgaaaacatggaaggatttagcatgggatctgccttatagttaatgttcagtgagtactgacattgaatcttaaatattggttaaagtagaaacaggtcaagtttgtcttcactattctggccattttttggtacaagcctctctggcctctcctggtacactatgccaggaagcttcttacaggtgctgaggcctcatggctgtgcccctttgctccaatatcttacctcccagcaaagttcctgtgctctgttgattttctcatgaatttgctcacagtcgtatagagtctttaactgatttcagagctgacccttagagagtatttattcaactctggagagaaaaatgaggcccagacatgtcagagaactcgcagctagtagtacagccagaaccagaactcacacttttttttttttttttttttttttttggagatggagtctcattcttgctgcccaggctggagtgcaatggcgcgatctcagctcactgcaacctccgcctcctgggttcaagcaattcctgtctcagcctcccgagtagctggaactacaggcacgtgctaccaagcccagctaatttttgtatttttagtagagacggggtttcaccatgttggccaggatggtctcgatctgttgacctcgtgacccacccgctttggcctcccaaagtgctgggattacagacgtgagccaacgtgcctggcacagaactcacactttctactcctgagcttagtgccctttcctctgcgtctcacactgggctgatcaactggttccttgtagcaagtagttagtgtactttgttcacagaggggatttatgtaattttcttactttctttctcacagtactgaagatgaacaagaagagacatcaaaggagtcaccaaaggaactgaaagagaaagacatgtatgatcaccaaagagaatgcctagggatgcttgtgtaaagtcttggttttaagggaatagtatattcttgtttgtaaggatctttccatttttacgtgtagacttaatgtgagtatgctgcttctttcaccaaaaagttgttatcaaattggtgatatgatttataactaatagcagcttacactcaaggaaatgtagtgatgataataataatcataataataataagtttacgcttaaggtagattaaatctgttttccacgtaaatatcctggaaatatggaatatttcatctatggaaatagtttatttttagctgctgatatgtttaaagttacagtatctagcaaagaaagtctctatggtgccaggtgtggtggctcatgcctgtaatcccagcactttgggaggctgaggtgggcggatcacctgagatcaggagttcgtgaccagcctggccaacatggtaaaatcccatctctactaaaaatactaaaattagccaggcatggtggcacacgcttgtagtcccagctacccaggaggctgaggcaggagaatcacttgaacccgggaggcggaggttgcagtgagccgagatcatgccattgcactccatcctgggtgacaagagcaaaactctgtccctgccgccaaaaaaaagtctctttggtaataaagttacaatctcttttaaatatgttctctaatattctctttaagatacataagatgttctaagatattctctaattctggcctattgccacatacaaattttgttaagattatacttaaaaagtacctctcaggaatatattgtttgatttttctagtcatcttctcatcattactgtgtgctcttaattctttagatcattgacggatattcaagacctgtctagtatctcctatgaaccagacagctcttttaaggaagcttcatgcaaaacacccaaaataaaccatgcacctaccagtgtcagcactccactcagcccaggtaatcacagggaagagaagtgtttggggagaaggacttacagccccagcccattgtctctgggaagccaagccgtggtatcagagctggtggctgtgttgtcatagtgcaaaggtttttctttagggccaaaactgggtaatcccattgtaggccagggggcggggtgatggtggtggtgattattgggcagccgttaggaggttttggttagaactgcagtggtaaagccatgcaaatgctacatctcctctaagcactactgaatttagtacaaaaacattgagctttgtagagtttgcaacttaaaacagtaccttgtgcttaaactttatatagttcttaagtcctgcaaccatatgcaaccagcatcaaatatcctctctttagtggccttacttccaatatatttgtggtttaaaaaatcaccgtttattttattttggtaaagtttagaggccaagtttagagactattattttttataccatgaggagctgtgtctcagatcaatgattgtttcagtaattttttttttttttttttttaaagacagagtctcactctgttgcccaggccggagtgcagtggcgcaatctcggctcactgcaagctccgcctcccgggttcatgccattctcctgcctcagcctcccgagtagctgggactacaggcgcccgccaccgcacccagctaatgttttgtatttttagtagagacagggtttcaccgtgttagccaggatggtcttgatctcctgacctcgtgatccacccacctcggcctcccacaaagtgctgggattacaggcgtgagccaccgtacccggccttatttcagttattaacaatttggaaaatccttagtataggtataggtttgtgggtttggatgttttgtttgtttgtttgtttgtttgtttgtttgttttaataatgtaaaagattcatttctgcacatcatattggggcagaaaaaacaaaaacaaagggaaaaaggaaaaaaggagaaataatataaaggattcagacagtaaccttccgcttttctccaacagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttgtaagtatatcaattccacgttacaaactcatggagtcagcccaaagggcccagtgacccaaactgccaagatttctccaaattcattaagaaagcaagaaataagctgggtcctctcctggcttgcctgggactcctctcttgagtctatattatgggaggcttaagttttgcttcctccttaaagccttccctggttacttccctgagagttttgatcgatctctactgttctctgaactcctgaactaataacctgcaggaaaaacacttaatcatatactgccttcttctcctcctcttcttctacttcttcctcctttttttttcttttcctctccctttctcatatgtgtaccctagtcaggaaaactacaagttctggccaggcacagtggctcaagcctataatcccagcactttgggagaccgaggcgggcagatcacttgatttcaggagtttgagaccagcctgggcagcatgacgaaaccccatctctacaaaagatacagaaaattagctgggacatggtgccatgtgcctgtagtttcagctacacgggaggctgaggtgggaggattacctgagcccaggaggtcgaggttgcagtgaactgtgattgcaccactacactccagcctgggtgacagagtgagaccctgtctccaaaaaaaaaaaaaaaaaagaaaagaaaagtacaagttcctttatgaaaaattgattgtcaacttttttggtatttggctcaaaaaaggtctcactttgaagtagggagatgacaaggaattttatgtgttcatttaaccgttaattgggcagattctaagtgccaagcaccatgtcaggccctcttcaaggcatccaagtgtgaataagaaagacatgatccctgcctcaaaggagctcactgtctagtgagaaagacaggcctgatgtaacacagcggtaagtactgagtgctgaggaggcagtcagggataaggcttcccaggccagatgcagtggcttatgcctgtaatcccaccactttgggaagctgaagtgggtggatcatttgagatcaggagtttgagaccagcctggccaacatgatgaaaccccgtctctactaaaaatacagaaaaaaatttggctgggcgtggtggtacacacctgtaatcccagctacttgggaggctgaggcaggagaattgcatgaacccgggaggtgaaggttgcagtgagctgagattgtgccactgcactccagcctgggcaacagagtaagactccatctcaaaaaaaaaaaaaaaaaaaaaaaaaggaggcttcccagaggaggtgacatgtgagtgagtttgacttaatcaacaaaacaactggaaatgactgagctgcatatgcctttttagctcaacacacatgacagttaccatgtttatctcttccttatagaaaagattgtcttcatttattggggctggatcccccagccttgttaaggcatgtgactcatcaccaccccatgccacccagagaaggagcctgcctaaaggtaccctgtgtttaatatcaaaatagaagtttataatcaaggaggcttaaattgatgcttatcaatctttgatgccacattaggttcagacagaaatgctgttttccccatgattataaaagtaaaacacactcattgtaggaaacttggagaataaataaaagcttaacaaagaaggtgactatacacttttttaacctcatgtactttttttttgcatatcttttaaatatttttataaatatataataatatgttttagcatagtgagatcatattgtgtatcagttctggactgctttattcccttgttatattttgaggcttttcccttgttattaaaaattgttcataaatatatgtagtagttatagtccattctacatgttgcttaaccattttcttatgtttaagatttatatcattttccaatttttgctctttatacataaatttttatctgtacctctgatcctttccttaggatagattcttagaagacagtttccaaatcacaaggtctgagaatattagcagtcttgaggcatattacctttattactttaattttaacgtcttctgtctttggtataactcttggaatttccctcagggggatagggattttgtgaattatgttgaggtattttggtcaatgttataattgagcacttggggcaagacccaaagtgtggttgcctctaaatcccctggcctgataatatttagttaaaggcctcctactttgtgcttttgttcattttgactggtccagaacctctgtattcctccagcagccctggtccagattgagccacttagtaagaatttgtaccttacctcctccaaatatccttaggaagggaggggcatagatcaagcagtaccagggtaagggctgatgtaggaaaggaaagggattggggtagaagtggggagtaaaggccattcacatgttaggaggtctctactggaactattatgtaagaggcttccttcctccttagtttgtttcatcattgagagaaatcctcagtcaagtctatgtgagagccgagaaaaattcagttcaggtccaggagggtgttaagacattttcccttttgtcttttttaaaaactagtagaagccttctcacagcatcacattgatgagctgccaccaccatctcaggagctacttgatgacattggtaagagatgttcaatacagaatatacttctcggccctgttagttatgtcactgaccacagtatggtgtctttgtctcaagtgtgaacactagtataaaaggctgtatgatggcctggttgaatataggaaggggcagttttccaaaatttaggaaggggcagttttgcaataaaatgagccacagcctggccaggatgattggcttgtgtcagttgtcattttgttacttaaaggacttatgttgatgaatctaaggggaagtaacattcaagtggtttattatgatgaatttcttttattaaaggagttcttatctccttttcagaccaaaccagccattcctttgaggcctgaggtctagcttcccaggccaagacacctgtgctttcagttttgccattagctgtaggtattaaaggtattgaaattgtgaataaatccccttcctaagaacagggaagtcagtggcacaaaacctacagagaccagaattttcaggcagagcagttaccaaccaaattttatttgcagctgattggctggccctgtccagctggtctgatgctgaaagtaaatgttacattgttatggaaactggggcaggtggtctgttttcctaggaaagacttgactgcgcctttcttgacagcctggccaaccagcccttcaccctcagaaaatgcatctcatcagactctggatagtccagttcttgttatgggacctataatttcctgaggggcaccccttggttttcagggtctctgaggtcttgggtttcataaaggaggaggtaaatcagaattttcaggtctgactcaatggacagctctcttcagggtcattatcataacccttagctcctgtcccttggcctgatgaacttgggtggagccagtcagtgctgtcagaccttccttggtttctttctttttccatggtcataggacctttcttgcttcactttacccctcccccagtgccacagtgttgtagagtcacagggttgttgggtcaggctcttagagcccacactcccacccctgctttccatatctgggattccctaggcagtccttgcaaattcctcctctttggttgctcttcttaaaataacagaactgctgagagtggaggtcaccccacacatgtcctgctcaggtagattcttagtatcatttgttcctcggtcatgatttaaggcagtattgtaggctcctttgcagtttgatcatagctgatactttttctctggatcctgctgtcttccctctatagttgctgtgtaaaccttccattcacctcctccatttcagcagctgtgttaccagactttgtcctgggctctggccttatggtgctgctgcaccccagcacagtctgcagaagccttccctcatttcacttatgggaattatctggaccaggtttctaggtaatgtctgcactttgagatgggtcagtaattttgcagaaggataaagggcagagggcacttgagtagtttcttctgataatgggcttgcctgcctgattactatatatcatcactctgttgtttcccttaaagagacctttggggagttactggaactctcaactgctattttggagggctcacatccaaagctctaggctcctgacaggtgcctaaagtggaaggttctttagaactaggatacagatgatcatttaagatctgcgcaggactacttttaacaaggacgaaaatggattttttaaatttcaaattatattaaatgatcttatggggacccttgacacccatggctgccaggtaggactgcttcctgcactgcaggaagggagaagacctgcaccagcacagaagaggaccatgccaacgagctcagggtggcttgtctatgctgcctcccaacttgctttgctttgcagagcactttgaggataaagcagcatactgagttagcagatgcttgtcttagtctagtgagtattccttgccttgcctttttcctttcctttcctttttcctttcctttgacagggtttcactcttgttgcccaggctagagtgcaatggagtgatctcagctcactgcaaccttcacctccagggttcaagcaattctcctgcctcagcctcccgagtagctgggattacaggcatgagccaccatgcctggctaattttttgtatttttagtagagatggggttcaccatgttggtcaggctgatctcaaactcctgacctcaggtgatccacctgcctcagcctcccaaagtgctgggattacaggtgtgagccactgctcctggccaggctgagtatttctttaggaactggaaatgatggatattctttgctttcaatcttttctttttcttttcctttttttttttttttgagacagagtcttactctgtcacccaggctggagtgcagtggcatcatctcggctcactgcaacctccacctcctgggttcaagcaattctcctgcctcagcctcctgagtagctgggattacaggtgtgtgccaccatgcccggctaatttttatttttttagtagagatggggtttcactatgttggccaggctgggctcgaactcctgacctcaagtgatccccctgcctcggcctcccaaaatgctgggattacaggcgtgagccaccatgctcagcctgccttctgtcttttcataaaccaggaaaaaagtatgaaatataggtgaatagagatggggaaacatttagattgttttgatgttactaactttttgagagactataaaatagagattaagagcataaaccttagagctagactgcctggatttttaccaattttaccacttactgtctgtgtgatttttaggcaagtttcttaacctaaatttcctcatctgctaaataggagtaacaataacacagtctatttcagagggttgttgtgaagattaattgtgaacattcatcctgaattaatgtatgcgagtgcttagaaacagaacctgacacctggggttctgcaagtgttatgtatgatcatcatcatttctattttgagtgttgtgtgggattttgtcatacctaaagaattcctttcaaacctggaatgccctaaagcagtggttctcaaattttatcagacatcagaatcacctgaagggctaagtaaaacacacattgctagacccccagagtttctgattcagcaggtctgagatgaggcctgagaatttgcattcctaacgagttcccgggttatgttaatgctgcaagtctaaggatcacccttggagaaccactgctctagagaacggcaggacacgcaagggaggaaataagtttcctttggcttttgtgttgtgacagagctcttgaaacagcagcagggctcatccacggtgttgcatgagaacacagcaagtgatggaggaggcactgcaaatggtaagtgaactacctagattgttttcatcaggttcttttaacgctgtccttggcaacacagtggtacatatagggaagtgtgaccttgaggtcaggcacaactccacctcaagtctgactttatagttatttgtatggcaagctgttttactgtttctgagcctcagtcgtcttaatctgtaaaatggggacaataatttctgtctcatgaagtacatattagctccatgtacagagccatgtacaagtactaacattttcaaatacttagcaaatgttagtcctcttccctttataggactgctggcaggatggaatgagatagcatatgtaaaatgcttggcatacattaaagggtacatcccttccccacccaaattcctttcctggagctccaagttagaaacatctaacaagtgagaacaagatggtccccaaagtaaatttgtgcaatttgttttcatggttgcttgcctcctcttttatgtgccctttctttcttcagcttcctctgtcttccttgagccttggcacaagcaaggtttcctgtagcttcacctggcactgaaaagcttccaagaccccagaagcagctgctgcaaatgcaggtggcctgcagactgccacctggccccctgctctcctgggaagaggggagctaatgcattgcacacttcagggaccactgattggccttaatttttgcactctattttaaggcaagctttctcaatttttttttcgttctaataaagttaattctttcaactgtttttagatcaaaggcacttagaagaacaagaaactgacagtaaaaaagaagatagtagtatgcttttgtccaaagaaactgaagatcttggagaggacacagagaggtaacaggaaaagctggactgttgaaaggatttaaaaaattgtatagtttatgttaggtttttttctaatattgacaaataagaaagaaaaaaagtggggtcttttttcatactatcctaatagcccctattcctaaagggttacttttttaaaaagcgttgctttttttgctttaaaaatgtttaattgtgatacaatgtatataacaaaatttaccatcttaaccatttttaagtgcacagtccaataaccttaataagtatattcacattgttgtgcaactaatgtcccaaaccttttcatcttgcaaaactgaaactctatacccattttaaaactccccattttctcttcttcccacaccctggccaccaccattttgctttttgtttctatgagtttgactactgttgatactttacataagtgaaatcatacagtatttgtctttttgtgactggcttattttaacttagcgtaatgtcctcaaagttcatctgtgttgtagcacgtgtcagcatttccttcttttttaaggctgaataatatgtttcatttatccagtcatctgttgatggacatttaggttgcttccaccttttgttatggtgaagaattctgctgtgaacatgagtgtacggatatctctttgagatcctgctttcaattcttttggatatatacccagaaatggtattactggatcatatggtaattctatttttaattttttgaggaactgccacactattttccatagcagctgcctcattttacagtcccaccaacagtgcacaagggtttcagtttctccacatccttgccaacacttgttattttctctctctttttgtgggggtggaggctttttttttcttaaatatagtagccatcctaatgggtgtgaggtggtgcctcactgtagttttagttttcccttccctaatgattaatgatgttgaacatcttttcatgtgcttgttggccatttgtatatcttctttggagaaatgtctgagttctttgccgtctgtgtgtgtgtgtgtgtgtgtgtgtctgtgtgtgtgtatacatatatatgtatacatatatgtatgatctatatatatgtatacatatatatgtatgatctctctctatatacatacatatgtatgatcttgcgctctctctctctctctctctctctctctctctctctctctctctatatatatatatatatatatatatatatatatatataaattagagatgggctttatgttgcccaggctgaacttgaagtcctaggctcaagtgatcttcctgccccatcctcccaagtagctgggactacaggtgcaagccaccatgcctggctctttgcctattttttgatagggttatttgttgttattttctcttgagttgtttttagggttttgtttgtttatttttacttcattttgttaggcaaacacaagtttcagtctctttcaaaacattttagttaaaggccttagaagagaaaatgggggcagtcttccagacaattcagtctaaaagtacaaggttgcctcaagaaacctgactctgttcctgatttggagctctttttgcctgtgttgtagggtaaactacttcagctcacctcctctgcctcttgacttctcttgaactatcattattcggggccaggactaggttaaggtgagctcaggagatagactccttggatacaaaattgaagggagcaccaaaaaaactcagtagtcaaaataagtaatattttagtgcaattttttttttttttgagacagagtctcacattgttgcccaggctggagtgcaatagggcatgaacaccactcactgcagccttgatctcctgggctcaagtgatcctcctgcctcagctgccaagtagttgggtctataggctcatgccaacatgcctggataatttttgtattttttgtagagatggggttttgccatgttgcccagactggccttgaactcctgagctcaagtgatccacccaactgggactcccaaagtgctgacattacaggggccaggcgcagtggctcacacctataatcccagtactttgggaggccaaggtgggtggatcacttgaagccaggagtttgaaaccagcctggccaacatggcaaaaccccgtctctactaaaattatatataaaaaaattagccaggcatggtggcacacacctgtagtcccagctactcaggaggttgaggcaggagaatcgcttgaacctgggaggcagaggttgcagtgagctgagatggtgccgctgcactccagcctgggcgacagagcgagactgtctcaaaaaaaaaaaagaaaattaagctctttttacgtgatcaaaagttagctattattattgttgtctcttcctcttccaaaagggccagcagtgctggccacagatagatgccccacagatgctcagtcatctcagtgctgtgaatgatcaatctaggcaccaagccagagtggaagacattttttcagatgagcaggactttcaggcattcttaaaatactctaccctgcatcttctagccttttcttggaaaaacatgtaggaaagcatgtatagttctagcctcaggtagaaaactaactcagtgacctagaattgagacagagtctaccatcagacttggggaagcagtgatcttaataggtgctaaggctttttgtcaagggattaaaggactattttggtgcatatttcttctttctttctttcttctttttttttgagacagagtcttgctctgtcacccaggctagagtgcagtcgcgtgatctcggctcactgcagctgccgcctcctaggctcaagccattctcctgcctcagcctcccgggtggctgggattacaggcgcacgcgaccacgccggctgatttttgtatttgtagtagagatggggttggactgtgttggccagggtggtctcaaactcctaacctcaggtgatccacccaccttggcctcccaaagtgctgggattacagatgtgagccaccacacccgaccagtgcatatttcagtcagatctaagtgacctctatgactccagacacaatctcactgagctcttgttttttcatacatatagtgaaagcacaggttttaaggtccctttctactctaaagtgttatgcatctttgtcaagggggatgggaaatgactgttgtctccattctcttcacttgtccttaaacagagctcactctactctggatgaggacctggaaagatggctgcagccacctgaggagagcgtggagctacaagaccttcccaagggctctgaaaggttattgttccccaaaggggaatccttttcttctttttcaggaagtggggctaggttttagacttcttggagaatgaatgcctgatgatggcattacattgatttagataagccagccctgactccacctgtctgcactcatatttgcccctcttcctctgaccacccacagtactcaagatattgattagcagattcatatcattatagacagaggcttctaagtttgctgtatcttggccctgctacctttgacattttcatcagtcatgtgaattaaatcagaaaaggtatgcttatcaaatttttagataacacaaatctaggaatgaatgctgatgtgatgagtgatagactgaggattcaaaatcatcttgacaggtggaaatgttagattctgtaaaagataaaggtcaaagatccaaaattacagaatgtgtgagacctggtctaactggagaagttttcatcagaagcttctgctcactataattttactgagggcaagaagtatgtcttatttttgtatgcccagtaatgagccatgcatcttgagacatgatgagaagtcaagaaattcttcctgaggaaggcatgggcaatgactctgtgaggcctgtttgatgaagtgctgaaaaggtcaatgcagcattgatgctggatatataaaaatgtactgtccagatgacggtaatgtgctgttcagaggagtcctaggacacatgtggggctccattctgggtatcacattttaaaagggatattaacaaacacaagagtgtggctacagaacagtcagaggtctggaaaccatgtcatatgagaacagctgaaggagctgagaggctcagcctgagaaaggcagatggaatggagaatttgatagctgccctcaaatacctgaaatattgcaaagtgaagagagtcagcttacttgtctgccctagaagactaattagtgactagaaattgcagagtaacagatttttattcaataaagcacaaacctaatagccacagctatctgataaagggaaatagctgcctgcctttacacttattttagtaatggttactgctgctcaggcagtggctggatgattccctgtcctgggcatttgaacgggggcggaatataacccaaaggcctcctccaactcttgaacctgtgattctattagtgggaaaatattaagaggggaaaaaatctctcttcactctagctggctttattttctctctcattttacgtattttgttttgactatccaccaaatgaaaacagaagaatccctaaacaatgttattttggttcaaccagcatccaccgagcacggacaatgtccaaagcactgtgctaggggctagaggtaccacaaagagggataagatggctctgccgcctataaggagtttccacttgggtcggggggatggtttctgcttaatagattgacaaacatggtcttaaattttgaggtacttaaattatttacatatttcacttaggagagagtttcgggaaatgaagataagatgataaaataaatgatggttttgaaagggacaccaatcaaaacttaagtaaaatgccttttttttcctttggagcagtatagcatagtggttgaaagcagagtctaaggcagactgagtctaaggtcagagtctagctctaggaattattaggtgtgtaatttaacttctctgtgcctcggtttcctcattgcttaatggggatggcagtggtaactaccttatatagttatgggaattaaatgagttaaattatagcacttaaaccaatgcctggtgcatagagaacactcttgttagtgctagctattatatggttttgttgttgttgttgttgttgtttgttttttgttttgagtacagtcctgttttcttggctgttgtgtatacgttttgattccccaaataattgttgttacagggagacaaatatcaaggatcaaaaagttggtgaagagaaaagaaaaagggaagatagcattacaccagagagaaggaaatcagagggtgttctagggacttctgaagaaggtatgaattaatgtatgtttataatgtagtctgtagtccttgggctttgatgtgcttcaaagttatttagaaatgtttcccagatgctatacataatcctcctacctttgataatttatttttctctgcagttcagctcaggttttctgttaattgccaatcatagctttatcacaaaaacagtaataacatccaattctatttccaaagcaagcttttgcccagtctcatcatcattatcttgcacgttgtctggggagacgttttgctgcttcttttttttttagacagtttcactcttgttgcccaggctggagtgcagtggcacgatctcggctcatcgcaacctctgcctcctgggttcaagtgattcccctgcctcagcctcctgagtagctgagattacaggtggatgccaccatgcccagctaatttttgtatttttagtagagacggggtttcaccaggttggccaggatggtctcgatctcttgacctcaggtgatctgcctgcctcggcctcccaaagtgctgggattacaggtgtgagccactgtacccggccgatgttttgcttctaattgtccaacgtcttccaaagagttttaaatttagctcacatagatgcttcaaaatccagtaataaatcatattttatggaatttaagtggagtctacaagtaatgtgaaaattataaattaaccttaattttaaaactattttgatagattttgaaggcttctgatatgccctttacaatgacgctctcccatatttaagttcttcctactcaggaaagtaagagactttaactctttcagatcatctggtattcctttcacctcttcctgatttccttctcattctccccatctctgccctgctttgtgccccagaatgctgaccctagtggactgcatctcctgggcttcctgtttgccaatgacaggccccagcagaagattagtggggctagagagaatttggggtattactttgcctcactgcttacttcagcaccttgtgcctggtagaagtggtgtctctccacaagtgcggcttctgtaggcagtccattcttcccaattccagctctcattaaggtctagtaactgacctctcatctccaacactcagttccttcagacttaggcttcccactgctgctaatcactggatgccttgacattccttgtttgttcccttaactctaaataaacctctgtatgtagtcacttcactaaggatctttatttgaaccagccgtgggtacattctgtttcctccagaaccctgactgcacagggcccagaacgtgtaggcatttagctattaatagtattgatttcactgagaagataatacagggactttgtgaattagtgtcattagcgcccattgctgtggcagaaaactatagaatgttaggaggggaagcccattaattgtgtttttagaaagagtctatctggcagaatataacaaccattgtaggtaaaacagtctactctaaattagagggagcactaatatgaatactggcaccctttgacctagaaattaatcatgttgttttttccttcctcttatatttcatcaagatgaactaaaatcctgtttttggaagcgactaggttggtccgaatcatccaggtaatgaaatatcagatgtttgtagatcaaaagtcatgtttatagacaacagaagcagacttaaaaacatttaccagtgtctaaatacacattaatgacaaagactccaatttagacaaagttgcttaatttttaaaatgttagtgtttatagttaattaaactataaagtgaaattaatgccaactttgattcaataagtgatagagtcagcataagaacagttttaggccaggcacggtggctcatacttgtaatcccagcactttgggaggccgaggcgggcagatcacctgaggtcaggagttcgagaccagcctggccaacatggtgaaaccccgtctctactaaaaatacaaaaattagccgggcatggtggcaggcacctgtaatcccagctactcaggaggctgaggcaggacaatcgcttaaacccggaaggcagaggttgcagtgagccgaggtcgcgccattgcactccacctgggggataagagcaagactccgtctcaaaaaaaaaaaaagaacaggtttaatatggagagaatacagaagatgctgctgtcaattgctctgtagtcattttgcatttccatgacacactgttggttataatcgcccttgattataaagaccaaaattcctttcccttgaatttaattgaatagaaagaggatgtggtttgtgtctttaaaaaacacacataccaactcgaaacttccttttttgttctttaaaaaacatgtgcataggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataacagattttgctgtgtaagatatatttctgaatttgagttattgggagttggggggagaactgccacccaaagaggcttcaatttctgacaaatatgcagctaccgctaccacccattatatatactggtaccagtcatctgtgtctcataacagaactacagcccatccacttggctgagagtgccatattcccattccagctagaattggctcacacaatcaaagtacaggtagtggccagatgtggtggctcacgtctacaatcccagcactttgggaggccaaggcaggaggatggcttgagcccaggaattcgagactggcctaggtaacagagggagttccctgtcactataaaaaattaaaaaattagccagacatgatggtgcatgtctgtagtcctagctacttgcaaggctgaggtgggatgatcacttgagcccaggaggttgaggctgcagtgagccgtgattacaccactgcactccagcttgggtgcagagtgagaccgtgtctcaaaaaaaaaaaaaagtaagtacaggtagcagtaaagtcctaagatagtttgaactcattaaggtgaacaaatattatctccatatattttgtattgtaccactaagatcatagcattgtctctaaattagcctgttgtgaccactggccagatgcatatgtgaagatttttttttttttttttttttttgagacagagtcgctctgtcacccaggcttgagtacagtggcgcgatcttggctcactgcaaccaccacctcccgggttcaggcgattcccctgcctcagcctcctgagtagctgggactacaggcgcatgccaccacacccggctaattttttgtatttttagtagagatggggtttcaccatgttagccaggatggtctcaatctcctgacctcatgatccacctgcctcggcctcccaaaatgctgggattataggcctgaggcccggccatgcagattttttatataccttcatctacctccagtttggaatcttcataatgaataaaaacattttactttctttttttttgagacagagtctcactctgttgcccaggctggagtgcagtggcaccgtcttagctcactacaacctctgcctcctgggttcaagtgattcttgtgcctcagcctcctgggtagctgggattacaggtgtgcactaccacagtgcacactaccacacccagctaatttttgtattttcagtagagacgggtttcaccatgttggccaggctggtctggaactcctgacctcaaatgatctgcctgcctcggcctcccaaagtgctgggattacaagcgtgagccactgtgcctggccataaataaaaacattttcttagaagctatgtgctgttgtgcagtactagccagctaacatgttattattctgtcttggtgagtaaatagtaggtcttttgtttgtgaaaactgaatagttcttgttgtggatggttgtattcctacttctttgcactcagaaattttagcctgcacagataaaatgagaaggtataaatctatttgaccattttaaagtaaggaaacagttgcttgctatggtaaccagaggaaaaccaccagaaaacaaattagtttataaataataccaggtgaagaaaagtttgattttcttagaggcaggatctggctttgttgcctaggctggagtgcagtggcacgatcatggttcactgcagccttgaactcctgggttcaagcgatccttccacctcagcctcccaagtagctgggactacaggcatgggccaccacacctggctttttttttttttttttttttggagacagaatctcgctgttgtcacctggactgaagtgcaatggcatgatctcggctcactgcaacctctgcctcccgggttccagcaattctcctgctgcagcctcccaagtatctgggattacaggcgcctgccaccacacctggcgaatttttttattttta

SEQ ID NO: 15676 - DNA, 62873 bp, Human
  misc_feature (1)...(62873): n = A,T,C or G
tcaagcaatcctcccacctcggcctcccaaagtgtttggattacaggcatgaaccattgtgcccagctactttttttgttttgatcgaaattatcatgtgatttttctaacttaatatagtgcattacacatattttcaaatattaaaacaaacttacatctctggaatatatcccacttggtcatattgtacaattctttttatatatttctgaattatatttgctaatattttgctatggatttttccatcaatattcatgagaagtgttggtatttttttctttttgtacggtcttttgctggctttggtagtggggtgattctaacttcatacagtacattggcaactgttccttcctcttctatcttctggaagaggctgtatggaattggtgttaattcttgtgtaaacattttatagaattcatcagtgaaagcttttgggcctggagatctcaggttttttttttttttagtttaaaaattacaattacaattttctctagttagaggactatttaaattatccttttcatattaggttatttgtagtaatttgtgccttctgaagaattcgctcatcttgtcaaagttgtcaaatttatgttatgtggtgttatttatggcattcctttttggtgtctgaaggttctgtaattatattccctggtatgttcctcacattggtaatttgtgtcttctctttttcttttttctttgcagtcttgctggaggtttgttaaatttatttatcttttcaaaaaccagatccttggctgggtgtggttgcccacacctgtcatcccagcactttgggagactgaggcaggaggatcgcttgaacccacgagttggagaccagcctgggcaacatagagagattctgtccctaaaaaaataaaataaaaaaatcaaccaagcctggtgacacacatctgtggtcccaaactactccagaggctgaggtgggcggatcccttgagcatgggaggttgaggctgcagtgagctgtgatcgcgtcactgcactccagcctgggtgacagaccaagaccctgtcaatcagtcaatcaatcaatcaatagcttccctggagactccagcctgccaccagctttggtaactagtggccgactgtcaggcctctgagcccaagcctgcacgtgtacatccagatggcctgaagcaagtgaagaatcacaaaagaagggaaattggccggctcctgccttaactgatgacattccaccattgtgatttgttcctgccccaccttaactgagtgattaaccttgtgaaattccttctcctggctcagaacctcccccactgagcaccttgtgacccccgcccctgcccgtaagagaaaaaccccctttgtaattttccgctacccatccaaatcctataaaacagccccacccctatctccctttgctgactctcttttcggactcagcccgcctgcacccagttaaaataaacagccttattgctcacaccctgtttggcggtgtcttcacacggatgcgcgtgacaccgatctctttgagcatcagaagcgcatgacaccgaccatcttctctttgagcatcacaagcgcgttacaccgaccatcttctctttgagcatcacaaatggttttattcattgctgtaggccaagggctcaaggctgtttagcacgaagtagacactgggtaatcatttcttgaatgaaacacattttacagatgaggcaactgaggctgagagaagttaagatcacacaagtggcggcgctggtcacctttacattgcaattcactaggaagtgttcaggttgctctgaccgcagggcagatattggggctgcggtgcccagttccaaaggtgaaagcttgctccgcgcccgccagggagctggtctagcggctgcagtgttaacccgaggccccgcccccaacgggtggcgcgaggcggggcgtaggtgagcgctgcagagaggctgcgccttgggccgcctgtcgcctgtgcgcctgcgcgcggcgccgaggggacggggtccgactcagaaatggcggcctccatgttctacggcaggctagtggccgtggccacccttcggaaccaccggcctcggacggcccagcgggctgctgctcaggtaatgccttccagtccgctgtcatctcgagggtcggcaggagaaagggtgaggtgtgaggggtcccgtggcccggctcggggtcacttcgccggcagtgacattttctgggtgccctgcaaggccctcgggcgacttgcctgggagtgctgctcgccaggactacgagcgagcccatgtttgcgcggctctgacccagcccttagtccgcgaggatccccggcggcccggccgtggctgctcctgcagtttctaagagatgggcgggagcaggtgggctctgagtggaggtgagggggtcaggacattttctgctgccattccggcgtctggcacggtgggctgagacttgcgccgcccctttttgggcaggggggaatgcccttcaaaagtacttttgtgtttcttgggagctgtcataggtgggaatgtcagaggaccagcggtgcttactgacttgccttttgtggggcaaggtagggaagtttcccctctcctccaagtagttgtatactgttctacttgttaatagcagtaataagattatgttttctacctaaccagttggagaggtaagaaaataatcttttgtatagccttatttctggataggctatagcataatagttactggccttgttttgaatatttgatgtgtgccaggtaatgtgctaagcgctttacgtgtagtttctcaggtttttcagcaactgtgaggaagtcattcaacacctgcatcattgttgaacatattatggttaagagaacaagtaatttggactaggtcatataggaggtaagatcaaagctgagatttaatcccagaggtgtctggttctaaagccgtgtacttgagttggctccacaacttcgaaaacaaacatcttccttccaactttgacaacaaaaaactgtggaagggcattattggtgtcctaagtcaattccagagttttgggtttttttctgaagtaactcttcatacatgtcatagtatgaattgatttagggccctcccgcccctacctttttttttttttttcatttttattgaagttgttcatactttcagcctaggggtagtgagttctgtgagtttgcttcccgatagaagtgactttttgaccttgaacttccttcttatgaatcttagaagagtgctatttagtttttagaaaatggggaatttagtgacaaatacgttttcattctagtcaaaatctttatctttttggaagttcatttaaaagccttcatttctccttatggaaatttccaatattattttctttataacagttgctgtcttctaccctggtattaagaaatgcagctctagagtttggaaggaccttagtccaaccctttgcttttgtagatgaggacatagaagtacggagtcttaagaaactcgttcaaggtcacacatttaatttagcaatttgttttccacatttttttttttttttccttgagacggagtcttgctctgtcgcccaggctggagtgcagtggcgcgatcttggctcactgcaagctccgcctcccgggttcatgccattctcctgcctcagcctccctagtagctgggactgcaggcgcctgccaccacgtccggctaattttttgtatttttagtaaagacggggtttcaccgtgttagccaggacggtctcgatctcctgacctcgtgatcctcccgccgcggcctcctaaagtgctgggattacaagcttgagccaccgcacccggcctgttttaaacatttgtttaagttctctgaccctcctccaatttcttggtatctttagcctagtgtaccttcgttgaaaatagatatttcagcatatgtctttaagaataaggacattcttccaaataaccgcagtgatcatacttaggaattcaacattgctgtaacatgaatatatatagtttagattcagatttttctagttgtccccaaagtgttctttatagacattagattttttaaaaatttaaactgggatgagaccttgtgacattttctctgaccaactaaccaattaggtgccacctagtgacttatgtgctagtgacctagtgctcttatatgtgttgcagttgtttatttacatgcctgtgaactctgtggctgggacccaagtgtctttatttttttagtgtccctagcccactgtctagttcatagtcatcacaaaaaatatttgagtgtatgactttttgccaggcttatgctagttactcccctacccactaatttttattattattttgacgtataatttatgtacagtaagatgtacagcttaagtggatagctagattaatttttatgtatgtattcacctgtgtaaccatcgtctgcatcaagatatacaatgtttccagccctcagaaggctctcatgtcctctctcttatcaatactccctgacagaaggtagcaaccaattatgacttctgtcaccataggctaattttgactggttttgaacgctataaaaataaatcatgtaagtatatattcttgtttctggcttctttctctctacattatgtttgtgagattaatccatcgatgtgtgagccatagtactttttttctttttatttctctgtagtatactattatatacatataccacagtttatccattctcctgttgatgggcaatcagctaatttctgttttctgtctgttataaataagcctgctctggacactctagacatttttatgtgtgccttttgacagatgtaaggactaatttctattgatacatacccaggaatgggatttctgagtcagaaggtggaggtatactaaacagtagtttgagaggttgctgggtttttttttctttttttttttttttaacttatttatttgtttttttagacagggtcttgctctgttgaccaagctggaggacagtggtgaaatcacagctcactgcagtctcaaactcctgagctgaagggatcctcctgcctcagtctcaggagtagctgggattataggtgtaagccactgtgcccagcttggttgctggcttttaatattgaagtgacactaaatcaaggaattgagctacctaggtcaaatgttaccaaggattttagcttgctaaatggatcagaaataagttgctattatatatgattgatttgtaagactagtagttctcataactgtagggttcttaagaatcaactgagtgacttgttatgaatgcagatttccttgggcccagtccagagattctaatagtgcagttgagaatgggtctcaggaatctgcagattacaagcacccagttaattttgaggcaaaagcttatgaacctactttaagaaacagattgtttctatgacctctttaaatttaattcttaggacactgtgtgtttcatatgaaccatgtttcagtatactgcattctgtattgagattatggaaatgcgtggataacatttaaatgtgtgattccattgaccagtcattgggtgcaggctgacagtgggaaggaggtgtgactttgggcaagtaggctccagtaagaggacttggctgagagctgtcagcaaccagcactcccagcagcagcagtgggggctatgaatgccttggtcctgaatggggagtgccagggagatctgggcagcatactgcaacatccactacagatgaagccatggttttgaatatcgagtgtatgaaagagtaatggtatcaaatcattttattattacatatctagtgccaggtgacttgttaggtgtggaggaatggtagagagaagaaaattgggaaggatttttggtttggtggaaaagatgagattggttttagatccgctgaatttggcattgaggtagaactgccctgtagatcattggagatatgatagtaaagctgaaatctaaaataaggaatagagatgatgaggaaataattaaaatgacagtggtaacagtgatatttagctgataggctagcttttagttttatgctgtaattcaggtactctgaatattgtactttgctaatgtaatgtaacagttttgttatagttatgaagaaccaagtagttaacaagagtgactgccaaatcactgtcatatataaatatgtccccaatctttctaggttctgggaagttctggattgtttaataaccatggactccaagtacagcagcaacagcaaaggaatctctcactacatgaatacatgagtatggaattattgcaagaagctggtgtctccgttcccaaaggatatgtggcaaagtcaccagatgaagcttatgcaattgccaaaaaattaggtactaaattaagaaaagcttttgccaccttgacatgagagctctgagaagatttgaagtttgtttttggtttgataacaacttttagcttttttttaaaaaaaatacattttctttgcttaaaatagaaggtagaactttattattattgaaattctaaaattattattattattattattatgagcacccataatgccagtgacgtgggagtcacttacattggcattaggaagctgaagtcctgtttttagttggaatataattatggggaagggaattctactactaccactctaactactctggagcttaaaggatggcagttgtgatgattcttcagggaaatggtgaaggaaaatcttagctgtttatgtgcttataaggagaggtccgtgcttccccctccatttttttgtcatgaaaaatatggaaccaaagaggaacaaaaagtagagtgctagaatgtaaactccttgagagcagagtttctttttcttttctttttttttttttttttgagacggagtttcattcttattgcccaggttggagtgcaatggtgcaatcctggctcactgcaacctccgcttcccgggttcaagggattctcctgcctcagcctcccgagtacctggtattacaagcaccaccaccatgtccggctaatttttttgtatttttagtagagacgggttttcactatgttggccaggctggtcttgaactcctgacctcgtgatctgcccgcctccgcctcccaaagtgctgggattacaggtgtgagccaccacatacagcccgagtttctttttcttatttgttcactgatatatcccaaaatcttagaagaatgcctgacacttaggtaatcaataaatactaaatgaataaatattaaatgaatttaatagttgcccatgtttattagcagattcctttattgataacagccttaatagcttttgtcaatttgaattaatctcttaatcaaaaaataatttttgatttcagaaaataagcttacatttttaaagatttagcatgaaaaccatgagctgatgtactagctatacactgcagtttctttttagcaatattttaaatcccaccaattttacgtagattagcataaataatctctcttctatgtacatttaattaataggctttaaatatgatttggtgaatactttgcttttatattttttaagaaagatgagcattttcaaagtgattgaaattttaaaagtattcatcttgtgtagtacttatttgtatctagaatggatttttctttcaaaattaaggatatatacaagttcagaaaactgtcatataagctatgtttttgaatgagatggccatgatttccttgacttggaagcatgatttttcatttatagttttgttgtttttattgttgttaatcagaaagaattattttaaatcagattacaagcaaactttttattaagcaaaagctttgtataagttcatactaattgtggtgaaatttttgttaattaatggtgacctataattggaacttctgcatggttaatgttaatgggacctgatttatatataattacgtcggtaaaaatggttttcctcttgtttccagattttaaaattccaaaaaaaaattttttttagagatagggtcactatgttgcccaggctagtctgaaactcctgggctcaagtgatcctcctacttaggcctctgagtagctggaactacaggcacatgccactgtgtctattttttgagtattataattggtttctttaactagttttccgtatattttctcatttagtgaaattccattgttttgtcagaaaaaataatttgcatagaaactttttcataaaatgaataggattaattcagatgccaatctgttttgattatgccttataaaaacttaatgattcttaggtacagaagaaagaaataatatgtgcaggataaactgtaactatgagtatttctggcaagttctctgggaccagaactcacaagtaataagaagcaggtaggcagctctgattttgagccccttggaacagataccttgttcatttagaaagtgtgttttttgtcaaagaatattgcaaatgatgattatagtgtgggagggagactaataattaacaaggaaatttaaatctagaggagcagaaatgctagtttttaaaagataaatttagaaacgtctatgaaaatatggaggacaatttcgtggttttttttttttttttttttttgagacggagtctcactctgtcgcccaggctggagtgcagtggcgcgatctcggctcactgcaacctccgtctcccaggttcaagcaattctcctgcctcagcctcctgagtagctgggattacaggtgcccgccaccatgcccagctaatttttgtatttttagtagagacggggtttcaccatgttggtcaggctggtctcgaacccctgaccttgtgatccacccgcctaggcctcccaaagtgctgggattacaggcgtgagccaccgcacccagcccaattttgtgtttttagtgagtcattgataacaaaagataacgattatgggatctagttgcacaaggtgtagaatgagggaccttagaaatacacttggttttgttcatgtagctagcaattcccaatgctgatttttcattacttcagggtgatttttgctttttgactttctgcaaaattcataaaatgctaattttcatttcataaaaactctttttttttttttttgagacggagtttcgttcttgttgcccaggctggagtgcaatggcgccatctcagctcaccgcaacctccgcctcctgggttcaagcaacctctgcctcctgggttcaagcagttctcctgcctcagcctcctgagtagctgggattacaggcatgtgccaccaccccggctaattttgtatttttagtagagacagggtttctccatgttgatcaggctggtcttgaactcccgacctcaggtgatccacctgcctcaccctcccaaagtgctgggattacaataggcgtgagccaccatgcctggccttcataaaaactcttaactcagcgctttgctcaacaaatgatataatagaacataaatgctttacaggtgtgccaaactattgtttcttcccagtcctgtggtggcaggagaagttgagttagcatggggtttggggccactgagcctctttacccagtatttcctaccatgtccatcattttctgtttgtgtgatgatgtgaaaaaagttgagaggcattgtcctgtaggcaagttttacctgctgtgaataattgaggttaggaatggaggaatggttagaaagaaatctaattctaatattttaaaagactatatgagtccccaaaatgaaggttggtgagcttgaagatcatgaagtttctggaatagattatcaaagggatggttattagcacagataaatgtagtagatattatttggggtcagttctgagagcaaattatctctaacagttcatagttcaaggaaatatgattttagtaagggtttggcagaatgtttgttgttttgtttctgagacagtgtcttgttctgtcacccaggctggagtgcagtggtgtgatcatggctcattgcagcttcgacctcctgggctcaagccacttctcccgtctcagcctgctgagtagctgggactataggtgtgctccaccatgcctggctaagttttgtattttttcttgagatggggtttcaccatgttgcccaggctggtctcaaactccggggctcaagccttccacccacccttggcttcccaaagtgctgggactacaggcgtgagccactgcgcctgggcacagatttggcagaatttttataatttccctattgactatagaaagatagtttggcttctagtatatttaaggtggaatccctatctggttgaatagatacatgtaaagggtgctgattaatgaatgtcagcctggagggagatttctaatggcatataataggactttaccttctttctttcttttaaatatttattagttagatacctgtatacaaggaatgcttaaaatgtttgtgagtgactaaaggtagctgggatagtgattgtgttttagagacagtcttgggatccaaaaaagatcttgtctgactagagcagtgccaaatgtaataagactgcaggttctatgagggcaggagaggtctcactcactgttgtatctacaacgctagcacagtgtctggtatgtagatgaacctgttgagtgaattaatggaattgaataaaatgtttgtttcgaccagttgtcctcagacttctcttctaatctttcttcctttcttgatagttgatgagactgtatttcatgaaaaatttttttttttttttttttttgctttcgttgtgaagggcttttttttttagaaggaactttcgaagaatcatcttttgcccttaaagactttatattcctaaagaaaggaaattgacactttgcggggaagagaagaaccttctgtcttgccaagtgtttttgaaaaaatagagcttcgttactcttaataggtcaatgtgttaagttcccagtttaatgaataggaatgattgaatttagctcagtaaagcacagtgtaactatgaccattttttacattacatttgcactgtttgccttgtagttctcttcttcggatataaacaaatatttaaagtgctggaaaatcaggactggacaggtaaacagaaacaagtggaataaatagtggctgctcccttccgtttgggcacaaactctaatttgccatggttcagagacaacctgtagtattctcaataagaacgttattgttggttttaaggaaatttctgagttgtttctatttgttacctaatattagttgtgatacatttgtgaatagtagagacagggtaattgaaaagggtttgtcttatctaaacaagatactttttctaatcagctctagttgtagtactgtgcacccagtttttcccattgggagttttcgtaagagcagtgaagaaatctagatttataagaattctgttcatatttttaaatgttcctttttttcaacattcagcaaaatattatgtgctaggaactctcccagacgcttgttaacatctatgaatacaacaaagattctgccctcctgggcctcttttctgatggggaagcaaaacaacaaatgatatatgtaagagaattacatatgtacgaagatgatgaattctatggcggaaagaagtgtagtaggtaagggggattggtcacaggtgggcaggttagtagggtaagcttcatgggcaacatgagatttaaagagaaacttgaaggatcgggggcttttcccacatggacacctggtgaagagtattctaggcagagggtgcattagagccaagtcctgaaggcaggaacatgcccaggaatagtgaggggattagtgcagttggaacagagtgagcaaccaggagggcctaggagataaaaagtgtagagggtattataaggtcttctaggccattgtaagcactttggcatttaactgagtgagactggcattcagtgcaaggttttaagtagaggaatggtgtgcctgctttggctgctgccttgagaatattctgtgggggacaaaggtcatatagttaagagatagtggtggttgggatcagagtctaaactgcaggtgatgaggaatggtgaagattctggataaatttgaagatagaaccagtatgatttcctggctgaatggaagtggggtttgagagagacaagttttttaaacactctcttggctgactacgcatagggtcatcatctggtttaaatagcatgtatttctggtgaaggcttacatcagtaattttctaaatgttcttttaaaataattgttaatgtgtaaactttaggttgtttttgtttggtttcaaactccatttcctacctcattgatttggttggttcatctgattaggtgggagcttcctctcattctgcttgataaatgcatcgtggagtgacatcctagttgtagaggactctacttcagtctgttcaaatccatgtttatggagtagttgttatatcccagagacttccttgtgcttgggatataatgaatacagtgagacctttagccctgatctcaaaggttattttgccataatgtatagttggtgccaccctgccagtgtgggcaaaatgctatgagaggcaaaatgaggaggctctgaattctgcctgtctggtacacagagaatgcctttctaagaggtattactctttttttttaactgatacataatatttttgtggtacatgttatattttgttacatgcatagagtgtgtaatgatcaattcagggcatttaggatacccatcacccagagcatttactcttttgagacagccttgctctgtcctccaggctggagtgcaatggcacaatcttggcccattgcaacctccgcctcccggattcaagtgattcttgtgcctcaacctcccaagtagctgggattacagacatgtaccaccatgcctggctaatttttgtatttttaatagagatgagatttcaccatattggctagtctggtctcgaactcctggcctcatgtgacccgcctgcttcagcctctcaaagggctgggattacaggagtgagccaccgcaccgggcccatttactcttgatcatgaatgatgagtactatctaggctaaacagccagtttgctggttttccacagcaaattagaaaggagaggaaaagggataaatagtaatcagtctacctgttaaagaagaaaaattcagtccatttatttaaaaatatgcataagctttgcaagcatagaattctgaaatcttttgatacagataccttaataactcctgatagtactactcatgcagtactgctcaataatgtattttaatagaactttctcttagtgggacagtataaatcagtatcaatactggtaatggtaatatcccccaaatcatgacatattcctgctatagcgatataactcagatgttctcaggacagcaagtttacatgtgaatagagagggagggacgtgttaggaagacatgaaattcaattttgtacttttgatactttccaaagttctagatgacactttccaaagtgtcaagaaatggttaaattattttcagtttactttaagaaatggtttaatgtggccaggtgcggtggctcatgcctgtaatcccagcactggctcacgcctgtaatcccagcactttgggaggccgaggtgggcagatcatgaggtcaggagatcgagaccatcctggctaacatggtgaaaccccgtctctactaaaaatacaaaaaaattagccaggcatggtggcgggcgcctgtagtcccagctactcgggaggctgaggcaggagaatggcgtgaacctgggaggcggagcttacagtgagccgagatcgcgccactgcactccagcctgggcgacagagcgagactctgtttcaaaaaaaaaaaaaaagaaatggtttaatgtaagtgacgaattttgaaaattgtgggccttttagacagtgattattttagtgttctaatctagaaaatctacataaagagaatgcctcatttttggacattgtgaataaattagacttgatttaataacacctgtcaatatgtatgttaaataacaaaatactatgtctggcatgctgctccatgcttcatatttaatagaagtgtttttcttctaggttcaaaagatgtcgtgataaaggcacaggttttagctggtggtagaggaaaaggaacatttgaaagtggcctcaaaggaggagtgaagatagttttctcgtaagtcatattttttaaggaaaaatcatccttgttaaagactgattaaagattacttattgaattgatgaaaatactgaaatttaaatattagatgagataaaattttggctattatgtggatttgctttttctcaactggaggaaagaaaaatttgagttctttttcttattttagtccagaagaagcaaaagctgtttcttcacaaatgattgggaaaaaattgtttaccaagcaaacgggagaaaagggcagaatatgcaatcaagtattggtctgtgagcgaaaatatcccaggagagaatactactttgcaataacaatggaaaggtcatttcaagtgagtaattgtagacatgatacatacgggataaatttatgacattcaatttcaaaagtccattattgtttctatttatgtgggaaagattttaaaagtacaaattataatctgtttgtatgtcatgagcatgatatttatgtcatttaaaaaacagcttctttaatgccgtaaaatttgatatataatatcatgatcttaaaattataggaaaaattctgctgtaataaatttcatgggattctcaaattgttaattcactaaaagcagcttaaatcatctctggatcatctccagattgagaaaattatatctagcatagtaaaatattctaatgaaagagaaagttgctgaacccactagaagaatgtgtatccattgcctcatcttctgttttctcaacttcttgggtttgtttttttttttttaatagtttggggtttgtttcactatatgattcaatatttggtaaattgagggatgacattaagtagcaaacaatatggttttaaggagtattacattagcacagctctcctctctttatggaacctaaaatgttgaacataaagcttctggtgaagagaaaatccctttatagacctggtgtttggaagagagcattgataatcattttatactagaattatctgtttttcgagggtattaggttttacaagctgaatctgtgtgttaactagcttgttttttgaagcaactgggtatatatttgaaagccccagtacggatttcatgtagaacattaattgtgtagaatttagagtaacaaaaattttaagagtcatgaaaataattttcttatgtagaacaactttttaaaaaatagcaactttctgtattgtgatttttcttatttacaattaaatctattaatgtttgaatgatatgtcttttgcaacttttaatttttataaggaagtatttctaaagatataacactagatggtagtaaaaatccactcagaatataaaattaagaagcattgttttattcttaagtgatattctatgtgatagaatttagtttgtaagttattttaaaaatcccatgacagtaacctcatatattacccaaaatttacataaattatatttttacacattcacttattttcactacattttatttttcttttcattgacattatatatcggcatctgtcattttgttagttatgtttttactttttgttacagtagccagaaacaaggtataaatacctggatgaattgagataggagttctatccatagtaattcatctttattgtagtaaaggtaggatactgaatatgtattattaaagatatgtttaaggcatttgggaaaaggatcaaatttgagttcatcttaagaacttgaatttcctgacaactacttaggtcttgttgaggataaaatgtttttattttaatacttgcttactaataatacgtggttataattcaggttaaaaatactgtagtaccagtaaaactgtttgaccgaagacattataaattctttgatattatcacattagaccaatgtagagttggttggtgttactttttggggtatagccatgtttttgggaatccctgtggacagatctctgttgaacaacaaaaattagtcacctatttaaactacaaagagcacttgtgattgagttaatgtcccatgcatgggaattaactaatcattagaaattgcttttgttaaaatggggaaaggatttcctatttaataaatggtgctgggagaacaggctagccatgcagaaaattgaaactgaaccccttccctacaccatatacaaaagttaactcaagatggattaaagacttaaatgtaaaactcaaaactataaaaactctagaaggaaatctaggtaataccattcattcaggacataggcgcgggcaaagattcatgatgaaaacgccaaaagcaattgcaacaaaagcaaaaattgacaaatgggatctaattaagctaaagagcttctgcacagcaaaggaaactatcatcatagtgagcacacaacctgcagaatgggagtagatttttgcaatctatccttccgacaaaggtctaatatccaaagtttatgagaaacttaaaacaaattttcaagaaaaaaagcaaacaaccccattaaaaagggggcaaagtacatgaacagacacttctcaaaagaagacacaggctgggtgtggtggctcacgcctgtaatcccagcactttgggaggccgaggtggacgaattacctgaggtgaggagtttgagaccagcatggccaacaaggtgaaaccctgtctctactaaaaataaaaaaattagttgggcatggtggtgagttcctgtaatcccagctacttgggaggctgaggcaggagaatggcttgaatctgggaggtggaggttgcagtgagccgaggttgtgctactgcactcccgtctgggcgacagagtaagaatccgtttcaaaaaaaaaaaaaaaaaaaactatacatatggccaacacacatgtgattaaaaagctcatcactgatctttagagaaaagcaaatcaaaaccacaatgagataccatctcatgccactcaggtggctatcattaaaaagtcaaaaaacaacagatgctggtgaggttttgcagaaaaaggaatgcctttacagtgttgacgggagtgtaaattagttcaaccattgtggaagacagtgtggcaattcctcaaagacctagaggcagaaatactatttgacccagcaatcccactactgggtatatacccaaaagaatataaatcattctgttataaagatacatgcatcggtatgttcactgcagcactgttcacaatagcaaagacatggaatcaacctaaacatccaccgatgatagactggataagaaaatgtggtacatatacaccatggaatactctgcagccataaaaaaggaatgagattatgtcctttgcagggatatggatggagttggaagccattatcctcagcaaactaatgcaggagcagaaaaccaaacaccgtgtgttttcacttaaaagtgggaactgaatgatgagaacacatggacacaaggtggggatcaacacacactggggcctgtcggggtgggggtggagggagggagagcatcagaaagaatagctagtgaatgttgggcttaatacctgggtgatgggatgatctgtacagcacaccaccatggcacatgtttacctatgtaacaaacctacacatcctggacatgtacacctcaacttaaaagttgaagagaaaaaaaaagaataagcaaagcaaaactaaaacaaaacagaaaacaattacttctattactgacttgtttttaggagatgtatcataggttctactggtctttagtacctttcacatcctgattccgggaggtaacttctatggggttggcttgccagaaagtgaattcaagtacctactctctgtgtgatacctttgttaaattagatttcttaacatttgcctagtgcctgttgggtacttttggtctgagtcaagtctatttaataaatcacatttactactttatttttctggtaaaacaactgcagtcttctgcaaatgagtgggacattttcctgtgtcaatttttgactttacctgaaatagttataaaatgtgcttaagaattctaattttacttcgtgtgattttttttaaatacacatctttattttttatttttatttttaatttttttgagagtcttgctctgtcgcccaggctggagtgcagtggtgccatctctgctcactgcaacctccgcctcccaagttcaagtgattcccctgcctcagccttccaagtagctgggattacaggtgcattccacgatgccctgctacagatctttattatatcatgtggctgctttctcatttaagccttttacatttaagcctattttaaggcaaatttaaaaaaataccaacaagagaagaagaacttaggttaagaaagtgaaaagtagggctgggcgtggtggctgacacctgtaatcccgacactttgggaggctgaggcgggcggatcatgaggtcaggagatcgagaccatcctggctaacacagtgaaacactgtctctactaaaaatacaaaaaaaacaaaaaattagctgggcgtggtggggggtgcctgtagtcccagctactcgggaggctgaggcaggagaatggcatgaactcaggagacggagcttgcagtgagccgagattgcaccactgcactccagcctgggtgacagagtgagactgtgtcaaaataaaaaaaaaaaaaagtgaaaagtagaattattaatatatttgaaatttcagctacttgcttgaaatgaaattgttttgaaagtttattactaagatttaaaagtgaagccaagtcgtttgaacatgaaatagctattcattctacagtgttgactaaatgtggaactatagtcattgtttaacgtttacccatgcaagttggtttctttctaattggttgtggaattaagacaaatagagactccactttcttctatgtattattgtttccttttttttctaacttataaccaattgttgacttaatttttactttagtgagaatttaatattaacttttctcctcgtgttgccttctctgtggcttttcatttcttttaccagttggtataaaaagagagtaaaactaaaatgaaaagaggctgggtgcggtggctcacacctgtaatcccagcactttgagaggccgaggcgggtggatcacaaggtcaggagatcgagaccatcctggctaacacggtgaaaccctgtctctactaaaagtacaaaaaattagccaggcgtggcggcaggcgcctgtagtcccagctactccggaggctgaggcaggagaatggcgtgaacccgggaggcggagcttgcagtgagcccatatcgcaccactgcactccagcctgggcgacagagcgagactccgtctcaaaaaaaaaaaaaaagggaaaagaaaactaaactaaaatgttagaatattttaaagatttgttggtctgtacctctcctgttgaataaaattatattttatggttatctgtagatttaatttgtctatattctatttcagtggcatgactaaaactgaaccgcctcttcttcaatcagaattttttcctgctctttagatctttgtaaaagctaataattatgcactgccttgctagagagaaaacgaagaataccctttcatttgaaatttatagaggaactgaaaattaaaccatcatttcaaacatttctctttacttagacttgctaatgttctcttctttagcctcagaaggctctgaattcttttatttaaaaaagttttttttttatattgaaaggagttctaatactaagtgcccatagtttagctaaacttcagaggctaagagcatagtcctgcacttgattgcccttactttagacaccagtctcaattttggtggtccccaggttaccctcatttctgactagctagctacaaatttgagggttaattccttagaacgactcacagagctcaggaaaatgttaaacttagtattacagttttattatagccaaaggatataaaaatcataaccagccaacaaggtctgggagggttcccaaacacgaagtttccactgttctcaggaatgttttgtcttgctagcatcttaatgtgtggcagtatgcagaatattgccaacccaaagctccccaagcttttggtgttcagagatttttttttttttagattgtcaaaaatataacaaaaaatttaccttacccattttgagtatgcagtataatagtgcattctcagaaagaaagaaggaaggaaggaaggagggagagaggaaggaaggagaatgttaatttctcttttggtaaaaggaacagagtaaaacaatttgtgcacagtttgtgcaacatctccagaacagatatccaaatcttttttttttctttaatttttctagaactttttttgtcttacaaaattaaaactattcattgaacagctcccttttccctctcccacttccctccagctcctggtaatcaccattctttgtgtttctaaaagtttgagtattttagatacctgaagtagctgtctttttgtaactggtttatctcagcataatgtcctcaaggtttattcatgatgtagcatatgacaaagtttccttatttatggctgagtactattccattttatgtatatactgcattttctttatccattcatcttttgatggacattcagattgctttcatctcttggctattgtcagtaatgctacagtgaacatagatgttcaaatatttctttgagatcctgttttcatttcttttggatgtatacctagaagtgagattactggatcatatggtaattctatttttaatttttttgagaagcttctataatgttttccatagcagctgtaccgttttatttaattaattatttttttgagacagagtctcgctatgtctcccaggctggagtgcagtagtgcagtctcggctcactgcaaccccagtctcccgggatcaagtgattcttctccctcagcctcctgagtagctggaattacaggcacccaccaccacaccctgctaatttttgtatttttgtatttttttgagacggagtctcgttctgttgcccaggctggagtgcagtggtgcgatctcggctcacagcctccgcctcctgggttcaagtgattcttctgcctcagccttctgagtagctgggactacaggcgtgcaccaccatgcccggctagtttttgtatttttagtagagacagggtttcactatgttggccagctggtcttgaactcctgacttcaggtgttctgcctgctttggcctcccaaagtgctgggaatacaggcatgagcccactgcacctagctgagccgtaccattttatattccaactaacagcagacaaagcttccagtttttctgcatcctcgccaatattcattttctgtttttttggtagtggccatcctaaagggtgtgagattatatttcactgtggtttttatttgcatttcccccgttattagtgatactgagtatcttttcatatgcttacaggccatttgcagatctgctttggagaaatgtctatttaagtcctttgcccatctttaaatttttttgtttgggttttttattttttacttttttggttattgagttgtagaagatcttacatattccgaatttcagcttttaactagatatatggattgcaaatattttctctcattttgtagattgcctttttactttgttgattatttcctttgctgtgaagtttttaagtttgatagagttccatttgtcaatttttgctttttttctgcctgtgcctttggtatcatgtttaagaaatcattgctaaatccaatgtcataaacttttttctccctgttttcttctatgagttttatagtttcaggttttatgtttaggtctttaatctattttgagtaaatttttgcatatagtagtattggtaagggtctaacttcattcttttgcatgtggatatccaatttttctagcaccgtttgttgaagagactgttctttttgccctcttgtgtagctttcgcaccattgttgaagatcatttaatcatataccttagggattatttctgggttttctgttctattccattggtctatatgtctgtttttttatgcattatcatgctgttttgataactgtaaccttgtaatatattttaaaagaagtgtgaggcctctagtttctttttttttctcgagattgttttgactgttctgggtcctttgagattatgtatgcattttagtgtatttttctatttttataaaaaaaagccattgggattttgatagagattacattgaatctgtagattgcttagggtagtatgcacagtttaacaatattaagtcttccaatctgtgatcacaagatgtctttccatttgtttgtgtctttttatttttattttattttttatttttttttgagatggagtctcactctgtcacccaggctggagtgcagtggtatgatctcagctcactgcaacctgcatttcccgggttcacaccattctcctgcctcagactcccgagtagctggaactacaggctcccgccaccacgcccagctaatttttgtatttttagtggagatggagtttcaccgtgttagccaggatggtctcgatctcctgacctcatgatctgcccgcctcagcctcccaaagtgctgggattacaggcgtgagccaccgcgccctgcctgtttgtgtcttctttaattcccttcagcagtgttttgtagtttttggttcataagtcttatgcctcctcgattaggctatccttaagtattttattctctttgattttaactggaattatttccataatttccttttcacattgttcactgttactgtattaaaaggcaacttatttttgtttgttgattttgtattctgcaactttgctgaactgatttattctaagagttttttttgtgtgtgtgcagaatctttagggatttctacatatgacaacatctcatctgcaaacacagaattttacctttccttttctctttggatgctttttatttttcttacctgttttctgtgtctaggacatctagtgctgtgttgaatagaagcggcaagagtgggcatccttgctttgtttctgatgttagaggaaaagctttcagcttctcatttttgtgtatgatgttggctgtaagttttcttttttatttttattattattatactcaagttctgggatacatgtgcagaatgtgcagatttgttacataggtatacacgtgccatggtggtttgctgcacccatcaacctgtcatctacattaggtatttctcctgatgctatctctgccctagccccccaccccccgacaggccccggtgtgtgatgttccactccctgtgtccatgtgttctcattgttcaactcccacttatgatgagaacatgcggtgtttggttttctgtttctgtgttagcttgctgagaatgatggtttccagcttcatccatgtccctgcaaaggatatgaactcatcctttttatggctgcatagtattccatggtgtatatgtgccacattttctttatcccgtctatcactgatgggcatttgggttgattccaagtctttgctattgtgaatcatgccacaataaacatactgatttataatctttgggtatatactcagtaatgggattgctgggtcaaatggtatttctggttctagatccttgaggaatcaccacactgtcctccacaatggtggaactaatttacactcccaccaaaagtgtaaaagtgttcctgtttctccacattctctccagcatctgttgtttcctgactttttaatgatcaccattctaactggcatgagatgctatcacattgtggttttgatttgcatttctctaatgaccagtgatgataaactttttttcatatgttttttgactgcataaatgtcttcttttgaaaagtatctgttcatatccttctcccactttttgatggggttgtttttttcttgtaaatttgtttaagttccttgtagattctggatattagccttttgtcagatgtatagattgcaaaaattttctcccattctgtaggttgcctgttcactctgctgatagtttcttttgctgtccagaagctctttagtttaattagatctcatttgtcaattttgtcttttgctgccattgcttttggtgttttagtcatcatgaagtccttgcctatgcctatgtcctgaatggtattgcctaggttttcttctagggtttttatggttttaggtcttacatttaagtctttaatccatcttgagttaatttttgtataaagtgttaggaagggatccagtttcagttttctgcatatggctagccagttttcccaacaccatttattaaatagggaatcctttcttattgcttgtttttgtcaggtttgtcaaagatcagatggttgtagatgtgtggcgttatttctgaggcctctgttctgttccactggtctatatatctgttttggtaccagtgccatcctgttttgtttactgtagccttgtagtatagcttgaagtcaggtagcgtgatgcctccagctttgttctgtttgcttaggagtgtcttggctttatgggctcttttttggtaccatatgaaatttacagtagttttttctaattctgtgaagaaagtcattggtagcttgatgggataccattgaatctataaattattttgggcagtatggccattttcatgatattgattcttcctatctatgagcatggaatggaatgtttttccctttgtgttctttcttattttcttgagcagtggtttatagttctctttgaagaggttcttcacatctcttgtaagttgtatttctaggtattttatcctctttgtagcaattgtgaatgggagttcactcatgatttgactcttgtttgtctattatttgtgtataggaatgcttatgatttttgcacattgattttcagtttctcattattgtgtatgatgttggctatgagttttcttatatggcctttattatattgaggttgtttccttcagtctttgttgagtatttttatcgtgaaagggtattcaattttgttaaatgccttttatgtatcaattgagattattgtggtttttgttcttcattctgttaatagcatgtattacactgaatttttgtatgttgaaccatccttgtattctaggagttaagtcccacttgatcatgatgtaaagtccctttaatgtgttgttgaattcagtttgctagtattttttgagtttttttttcatcattattttttcagagctattagcttgtagttttcttttaataccttctgattttggtatcatggtaatgctggcttcatagagtgagtatggaaattttccgtccttttcaattttttgaaaagagcttgggaaagattggttcagttctttaaatgtttgatagaattttccagtgaagccatttggtcccgggcttcctgttgcttagaagtttttgattactgattcagtatcattactagttatagagctgttcatattttttatttctttatgattttgaagattgtttctagcaagttatcagtgtcttctaggttattcaatttgttgatacataatttttcatagcagtctcagactctttctgtgacagctgtaatgtctcctttcacttctgatttttgttatttcagtcttttctatttttttatagttaaagggttgtcaattttattcactttttcaatgagccaatatgcagttttgttgattttttttttttctgttccttgtttcttttatttctgctctaatctttatgattttcttccttttgccaactttgggtttagttattctttttctagtttcttgtggtataaatataggttgagcatcccaaatctgaaattctgaaatccaaaatgctataaaatcctaagctttttgagcactgacatgacacttaaaggaaatgctcattggagcattttggaattcagatttttagatttgggattctccaatggtaagtataatgcaaatatttcaaaattcaaagaaatccaaaatcttctggtcctaagcatttcagatgaggagtactcaacctgttaaaaaatcaggagctgggtgtgttttcttagttgtagcaagctgtgtcaacttccctctgggatgttacacattttctggtactgccatgagcctgtgtactctcctttgttctcgatgccccacaggcatccagagtatgctggttccccatcagcacccatatcagttgagacaggaaacagtcccttggacagccctccaagaagctggaatgttgaacatgtgttctactcttctctttctctcccaatggagaagcttcttaatcccaaactatgttagtttggagtggtggggggaaggatgctgatgtggataaaatgaaatggcttttcttactgatttcattgcagatgttcttggctttgagcttacctggggtactgtgacttcctaattggttactgtcattgtcataaaaggtttttggatcatatattgttgctaaagtcagtgtttttgtcagggagcaaggtcttgggcttcctattttgtcatcttgctgaccttggtgtccagagttttcattggggttctatggtgtaggcattaaacaaaaatttttttttaattttaaatttttgtagagacaggttctcactatgttgcccaggctggtctcgaactcccggactcaagcagtcctcctgcgttggcttcccaaagtgctaggattacagatgtgagccaccacacccagcctgggtatcactgattgaatcattgtctgtgcagttgacttagcccatttcttctatgcagagtgggttgatacaatttgactgaaagccccaaacctctaatcacattgtcaatctttctggcatggccattgcccacctgagtcatctccttagtgtaaactgtctaggggcccaccatgaggctccttggtagcatcaactatcagatgtggttggagggtttagaagttacttccaagaccctggggacaaaagtcatctgaattccttgttacaaatgtatacagaaatcgaatacatggtacaaaatcatttttttcctaaataaaagtttaacactcttaaaaaagtgatagattcttcttctttttaatttttgttattgccttattttaagtatttgaaggactgtttcgttctctaaacagtaatgaatgcaatcctattcctttaatttatactttaaatgagtatgttactaaaacactaagtgctaggatagaaaagtggaattaggctgggcatggtgggtcatgcctataatcccagcactttgggaggtgaatcacctaaggtcaggagttcgagaccagcttggccaagatggtaaaaccctgtctctactaaaaatacaaaaattagctgggcatggtggtgcatgcgtgtaatcccaactacttgggaggctgagacaggagaatcccttgaacctggggggcggaggttgcagtgagctgagatcgcatcatttcactccagcctgggtgacagaacgacactccatataaaaaaaaagaaaagaaaagaaagaaagaaaagtggaattagtcttttgattaaaaaaaaaagttgtcatgcctgtttttttttctggatgtaagagtagtatgttcattgtaaaaaaattttatttggaaaatagttgcatttaaaataacaaaagtcttttaatgttttatttcccactcttttattgtttctgtcaatatggagcacttgaaacgcactttatgttaaaaaataatacaattgagaaaacgacctagggctttgtatcatttttttcatacgtaacactacatgtacacatacactacattacccactacagatcagtagtttcctgtcagtaaacaatctttaaatgcagttttactatttctctttttttcatgttaacattatttctagtttaatgcataaattagtagatctattagataatttatgattttttcttgattgattttcaaggccttaaaggttaataattgttagtattgataccttaccttctcatattgttcatgacaatagccagagctattctttcaaactagttagctttctcttttatttattgtattttactttttttttgagacagggtctttctctgtccccatgctggagtgccatggtgtgatcacagctgactgcagccttgatctctcagtctcaagccatcgtcccatttcagcctgctgtgtagctgggactaaaggggcatgccaccatgcctggctaatttatttgtattttttgtagaaatggagtcttactatgttgcccaggctggtcttgactcctgaactcaagtagtccttctgccttggcgtcccgaagtgctgtgattacaggtgtgagccactgtgcctggccagctttcttttttattgtcttgcagtagggctagagcttagactttcccttttcttaggctttttctttcaaatatctgttttcaggattttctagtgtttatgctttaagcaatacttttaatgtcccctcagtttttatgaaaaatgcataggttatatttcacatacatatgtttacatatttggtgttaagttttttttcttttttttttaattatactttaagttctgggatacatgtgcagaaagtgcaggtttgttacatagttgtacatgtgccatggtggtttgctgcacccatcaacctgtcatctacattaagtatttctcctaatgctatccctccccttgccccaaccccctgacaggccctggtatgtgatgttcccctccctgtgtccatgtgttctcattgttcagttcccacttatgagtgagaacatgtgatgtttggttttctgttcctgtgttagtttgttgagaatgatagtttccagcttcatccatgtccctgcaaaggacatgaacacattctttttttatggctgcatagtattccatggtatatgtgccgcattttctttatccagtgtatcattgatgggcatttgggttggttccaagttgttgctattgtggtataagtttttgtgtatattttaaatctattttccttgcaggcaagccattattttcttctttttttacttttttatccattgctttaattgaatatttataagagggcactgtgctggagatgtgaggataaattctcaagaaaattttaaaatgtgggtagagagtaatagatgcttacatctgatattatgcacgggtaggttttaaagtttcattgatgagtctaaaataaatctagagttttggttgtttacttcccttgccagggtcctgtattaataggaagttcacatggtggtgtcaacattgaagatgttgctgctgagactcctgaagcaataattaaagaacctattgatattgaagaaggcatcaaaaaggaacaagctctccaggtatgttgtattcctgaaaaatttctagcttatgattagagaattatgatacttaaagataaccgtacaactgaagtaattgtcaaaacttatttaaacattttgagtgtcaggaaagttaataacttgtttgaaatagctcattttggaattatttacaattttttcatatctctataaatatttcaatgtggattcttttaaaagagtcactggccaggcacggtggctcacgcctgtaatcccagcactttgggaggccaaagtgggcggatcatgaggtcaggagttcgagaccagcctggccaatatggtgaaacccccgtctctactaaaaatacaaaaaaaattagccgggcatggtggtgcgtgcctgtagtcccagctactcgggaggctgaggcagaagaatcgcttgaacccaggaggcggaggttgcagtgagccgagattgtgccactgcactccagcctgggcaacagagcgagactccgtctcaaaaaaaaaaaaaaaaaaaaaaagaacatgaaaaggaagtcacacgctgacacacacaaacacacacacacatacacttccacaaatgcccagtcaacagatgaaagctcaatcaacattaaacaggacatggtttttgcccattggaattagcaatacaatgttatcaagtatggaaatattattgnnnnnnnnnnnnnnnnnnnnccagcctgggcaacagagtgagacttatctcaaaaaaaaaaaaaaaaaaggagtcactataccattaccctatctagtaaaattaacaataatttcttttcttttctttctttctttttttttttttttaagacggagtcttgctccgtcacccaggctggagtgtagtggcgccatcttggctcatcacaacctccgcctcccaggatcaagcaattctcctgtttgagcctcccaagtagctgggactacaggcacctgccaacacacctggctaatttttttgtttttagtagagatggagtttcatcttgttgatcaggttggtctcgaactcctgacctcaggtgatccacccgcctcggcctcccaaagtgctgggattataggcgtgagccagcgcgcccagccaacaataatttgttagtatcatcacttagtcattcaaatttctctagttgtttcaaatcaatttttcatttacaatttgtttgagtcagcatccaaatacggttcttcattgttattttatttattttctttgagatggagtcttgctctgttacctaggctggagtgcagtgttgccaccttggctcactccaacctctgccttctgagttcaagctattctcctgcctcagcctaccgactagctgggactacaggcgcacgtcaccatgcccggctaatttttgtattttgttttagtagagatggggttttgctatgttggccatgctggtcttgaactcctgacatcaggtgatccaccctcatcggcctcctgaagtgctaagattacaggcgtgagccaccgcgtccggtcccttcattgttgttgactgataagtctcataggtcttttataacttacaggtttctcttttttgctgtcatcttttttctttcagttcagttgttgaagaaactgaggtgattattattcattgtttttcgtagtctggattttatatctccatggtttaagtggttaaacatttaaaatattcctgtgtcccctttattttctgtaaattgtgtagaatggatgggacactgtcttatatatctccataatagagctgtggtttatgaatgattttaagaattcgatgaacgctgtggtccttctttcaattctttcaatttgtatgtgttcacaataaaattttgcctacagttttactctattgtccttgtgtgctgcttcccctccattcttccccccactaaaaaaaagcccccattgagtttaatattaaggcctgtgagagttgcttggtaatatttgtaatgctgctatcgaattaaattgtttgctttggatataaaaataagtgactcatcttttcgtttgtttgtttttgagatggagattcttgctctgtcgcccagggtggagtgtgcagtggcgcaatcttggctcactgcaacctccgcctcctgggttcaagcaatcctcccacctcagcctcccaagtagctaggattacaggcatgcaccaccatgcccagctaacttttcattggtatttttagtagagacagggtttcaccatattggcaggctgctccagaactcctgacctcaagtgatctgcctgcctgggcctcccaaagtgctgggattacaggtgtgagccgccgcgcctggcctaatgactcaccttaaaagaagaatttgaatattggactttgaagttaaacatttctttttttttattattgatttttatttttagtttttttttgagacggagtctcgctctgtcgcccaggctggagtgcagtggcgcgatcctggctcactgcaagctctgcctcccgggttcacaccattctccttaaacatttcttaatgagaaaactatgtcagaataagtttgtggtattgaagtacagcaagtgcaagaattattttttttttgagacggagtcttgctctgttgcccagactggagtgcagtggcatgatcttggctcactgaaacctctgcctcccgggttcaagcgattcccctgcctcagcttcccaggtagctgggattacaggcgcccgccaccatgaccagctaatttttgtatttttagtagagatggggtttcaccatgttggccaggctggtctcaaactcctaacttcatgatctgcccacctcggccttccaaagtgctgggattacaggcgtgagtcaccgtgcccagccaagtgcaagaattttgaccggcacaaagttttaaggagataaatgtttctgatggagaataaagcaaattgattttggcaaatgaatgatataaatgtttaaaaggcatggatttgatttattaggtagttacgtgaagatgatgactggagagtgaaatttagatgaggaagaaaatacttgatttacaagaatacatggaggaataatctaagattatagcattttgcatgatggtgatgagtggaaatagagcctagcattagaaaattgatgtcataatggattgatcagaattactttgtagttttcaaatgtttaagcctaaacatttggttttagtttttgtttttttaggtgagttgtgacatagtgaaaaactttcataataaaatggtactttcatattattctttatttgaaataggtcaaaacaaaagattacattccttagtgcttttttttttttgtgggggggagacagagtctcactctgtcgcccaggcaggagtgcagtggtgtgatctcggctcactgcaacctccacctcctgagttcaagcagtttttgtgtctcagcctctcgagtagctgggattacaggcatgcgtcaccacacctggctaatttttgtatttttaatagagacagtgtttcaccatgttgcccaggctggtctcaaactcctggcttcaagtgatccgccctctttgtcctcccaaagtgctggtattacagacttgagccactgcgcccggcctacattgtttagcttgatcattcactttacttattggcatttgactctttgcaaatatcttcttcatcttcaaagaatttaagattttttgttattgaaaatcaaaagaatgtgttacaaccttagatagcaactgaaaaagaggaaagaattctctatagggttcctgagcagtggcagcactgttagaataaacacatagacatgtatcctctgtaccagtggttcagaattgctcatggaacttgaaacatgatagatgcttgatccagtaaaaaacttgtcaaccagaacttctgagttgggaccttgatattgtattgtttaaaagctctgtgggtatctctatttgggaatccctcaagactgtaaactcttttattataaagttaaacatctttatcttttgggcctagcacagtgcctggaatgtaataggtgcttggtagatttttgaataaatgggataacactcatttgactgtatgacatgtattcttattgcttggtagacactctttataaattatacaaaaggtaaaatagggtcttctaatattttggcttttctttggaccataagggttgtcagtccacattttatatttttagtagagatggggtttcactgtggtggccaggctggtccgtaactcctggcctcaagtgatctggcccctcagtctttcaaattgcaggcattacaggtgtgagccactgtgcccggctcacattttatatatagttttaataaaatataaacctcttctttcagcttaggttggcagtaaagcttaggcagtatggacactatggaactggaatctaggccaatgaatggcaagttacttgatctctctgaatctctttcttatctataaaatgggcataatatctatcttttgaagattttgaataaaaagttttgtttaaccatttagtaatggtagctgctatttcagtaatgtttgactataaatgactcatgtttatcatttaagtgataaactacaaggctttttatttatagtaatgttgattagacatatgcaaactacctataataaaaagacatattgatttcagcttgcacagaagatgggatttccacctaatattgtggaatcagcagcagaaaacatggtcaagctttacagcctttttctgaaatacgatgcaaccatgatagaaataaatccaatggtggaagattcagatggagctggtaaagtatcttcttttgtctaacatgattatgcatttatttctctaatatgcttccctaaggaagttaaatcatagaagttaaagtagttaaacttctacctatgtagaagctttttaaaaaaaaatcagatagaatgaatatgaacaaatattaaacccattaaaacaaaacactattagacccattaaacaaacaaacaaaaaataaaacaaacaccttatagagacgtgcacagaggggtcggaactgtactgtccaatacagtgactatcagccacacgtagttattaaaattaattaaagttacataagatttaaaaattcatttactcagttgcactagtcatggttcaaatactcaatagccaaatgtggttaccatattaaaagagcacacacacagaacattcccatcattgcagaaggttttattgggcagtgctgggttagtgtatgcagtgtggtggtgattgagctgtaattttatggaattagctatctggatatatagattgcatactatatacattttgcatctttctttattcacttaataacatatcctggggaactctttatgtatatggggtctttatatattagggatgtcaatcttttttctgacatttggtgtgaatctttttctgagattgtcctttattgtttaatgttatttgatttttggggaaatatttttgtttttgcatgtactcaaatctcattactttttttttttttttttgagactgagtcttgctttgctttgtcgcccacactggagtgcaatggcgtgatctgggttcactgccatctccacctcttgggttcaagtaattcttctgcctcagcctcccaagtagcttggactacaggcatgcaccaccgcgcctggataatttttttgtgtttttagtagagatgaggtttcaccatgttggccacgctggtcttgacctcctgaccttaggtaatctgcctgcccctgcctcccaaagtgctgggattacaggcgtgagtcactgcgcccagccgagttccattacttttatgctgagagatttttttattctccatcttaagatcagtaaatattcatcctcaatgtgttctgtttttttcttttgggtcagtttagttagagatgttctattttttaaattgtttcatttttacttttaagtctttaatcaattaatattttactttagctttacttttagttttttagagtatcttattctacttttagtaatgctaaagtaaaggttctgcagtgagaactttattttctttttttaagctttctagtaaaactaaaattagattaaattgccttcactagatgttccttatgcccctcttcccccaactttttaaaaatttaatgggctacccaacatttagaaaaacacttttttaatccaaatactgatttaaaaaaccttaatactgagtcacaaattaaaaagtttcagcagatatccaagaatttataacacagataatgatctgtaaacacaaagcaataacattggaaattaatataaaatattatatttttaaattttttgagacacggttttgctttgttgcccaggctggagtacgctgacacaatcacagctcactgcagccttaaacttctgggctcaagcgatcctccctcttcagcctcttgagtagctgggactacaggcccatgccaccaccatgcctggctaattctttttaaaattttttgtagagacgggccctcaatatgttgcctaggctcatccaacgcatgtactcaagccatcctcttacctcagctcctgaagtgctgggattaaaggtgtgagccatcacacccagcctatttttttttttttatttaaagaaaatacttgaaaataatttctgaattaatgaagaaataataatggaaatgagaaaatatttcaaactgaacaactgcaaggaatgtaggaattgtgaggaatactcattatcaaaggggtcagtttcttaatatttaggttggtgcaaaagtaattgcagtttttgcctttttttttttttttttaaaaacggcaattacttttgcaccagcctatctaacttaaatgtaattatctaaggattaactaaaaactgtccaagaaccatccaagagtggatccttatgcaatttatatggaaagtaaaaggataagaattgccaatttttttcctattcaacagcattaatttaatttaatgggtgatgttttgctgaactaaatcattccttactatgaatatggtaccatgtgtgcttttttccccttacttttaaattttgatacagaaataaatactataaggaactcctaaatacactttagtcaacattgccggttgtttacatttcaccctgtgttttattctctttctgctctctttctgtctgtgtacacatgcatttgtgtgtataaaaatacaaatatatttggaaccattaagagtaagttggagacattgttcttctagtgtctaaaaacaagaatattcttttcttttttgagacagagtcttgctctgtcgcccaggctggagtgcagtggtgcaatctcggctgactgcaagctccacctcccgggttctcaccattcttctgcctcagcttgccgagtagctgggactacaggtgctcaccaccgcatacggctaattgtttgtatttttagtagagatggggtttcaccatgttagccaggatggtcttgatctcctgacttcgtgatctgcctgcctcggcctccgaaagtcctgggattacaggcgcaagccaagaacgttctcttatataacctgactacatttattaaaaccaagaaatttaatactgagaaaatattatctaattcataatacatattcaaatgtagccagctgtcctactgatgtcctttatactatttttccccaggaccaccaggatcacacattgaattgagttgtcacatccatttgacctggaacagatctggaagtttgatttatttcttgaccttattttttgttgttcctgtttttctttgttttttttttttgtttgtttgttttttttttttaaagaaggggtcatttatttcatagaatgcccttcagtttgtgtttctctgtttgatgttccctcatggtttttttttccttcatagtgcacaatgtcaggaggtacattatgttggtttgttccagtattgataatgttaacttggctcacttgtttaagatcgtttccagaagcttttttcattatagagtcattagtttttcccgttgtaattactatgaaatttgtgggaaaatattatattccttgtcaaacttttacccattagttttggcatctgctgatgattttctaactacatcattccctctatatttactagttggctttgtattatacggaagagctttctcttctgccccattcgtttgtatcaggatgggctcatccattctttaatcaatgagttatccattttaatccttattttgttacgcagactgtcccagatttggccagcagaggccactttcaggcttgctcctgtggcctcttttttttttttttaaataaatgaaaaattataaataaaattataatttaacttacaatattgaaacaaatacagactttcaggaggttgttaaattaatagtcttgcatgcccttcacccagtgatgacattttttttttgagacggggtcttgctctgtcacccaggctggagtgcagtggcacgatctcagctcactgcaagctccgcctcccaggttcatgccgttctcctgcctcagcctcccaagcagctgggactacaggtgcccgccaccacgcccggctaattttttgtatttttagtagagacggggtttcaccgtgttagccaggatggtctcgatctcctgaccttgtgatccgcccgccttggcctcccaaagtgctgggattacaggcgtgagccaccacgcctggcccaatgatgacatcttatttagctgtatatacccaaacagttagttgacattggttcattattgttagctagactaaatattttacttagttttcaacattttttttaacattttaaacctgcagttatttgtgtgtatatgtataattttatttaatttattccatacatagatttgagtagccactaccacaatcaagatacagactgttccatcaacacaggagacctctttgcattcacattgtctaccaattctttcctaccctgtccctgtgccctggaaatcactagtctattcttcatcctctatagttttttttttattttgagaatgttatataaatgcaatcatataatatataaccttttaaggttgacctttttactatacataatgcctttgaggtctatccaggttgttgcatctttttctttttcattgctgagtagcattccactgtatagaagtacctgatttcattcaaccgtttacactttgaagggtatttgggttatttccggtagttttctattaccaacaagctgctacaaacatttgcaaggtttgtgtgactgtaagtcctccctttgtccttttgatatgcccatatttttatttgagcaagccttttacattttgtgcaacaagatattccaggattatcttcagttttccttgtcacagttcggcaatccaccttttctccaaaggaccctggcttctttttgtggaaaacaatatttattaataggtaccaagatagacatactacttaatgcatattgctaatcttgtgtcattgcttccaggccttttcaacaaacagaaccaagaagtatgtgtgtgtgtatgtgtatgtatatgtttgtacacgtacataaaaacacacctatatttatgtctgttttttttttgtttgtttgttttgggacagagtctcgttctgttgcctaggctggagtgcagtggcgtgatctcagctcactgcaacctccgcctcccgggttcaggcgattctcctgtctcggccccccgagtagctgggattacaggcacgtgccaccatgcctggctacttttttgtatttttagtagagatggtgtttctccatgttagccaggctggtctcaaactcttgacctcaggtgatccgcctgcttcagcctcccaaagtgctgggattacaggcgtgagccactgcacctggccttctatctgtgtttttaaaaatctccaaatttatactgataactctaattccacttgagttcttcaaggttcattctagctttaccactttctatgtttataattttcttattcaacatttacataaatggtttttattagcttcaatatagttattcctttcgttaccaaaacaccaggggtttggtcaaggtcctgctgcacagaaagccaatcactgagaagtattgccaaagaagaagggtttaattgggtgctgcagctgaggagataggatctcagtctcaaatctatctccctgactaaaaccaggggtttatatggcagggaagaaacgtaacaatgtgtaagaaaacaagaactagggaggggcaaggaagcagtcatgatgaatacgtggtaagagtctcattgtctggatgtggtgatctggtgagttgcagttcttcgatacatttttttgagaggtcccaaggtcccttcctgaggaaaaactcctaagttttaagctttaagaccagaaaggtcaatttctgtgtttatccaaaagaacagtctatgggactgttgggtcagtttcagtcttccctttctatttatcagttcctcaatcatgaggaatccagtcattggtctttctggctgcttcatgctgaggaagggtgtcataggcagctccataccataggtgaccatgtagccacccaggaatcaaagtttcatctaatagagagtttcttctgacacataatatttctctctctggtgtaccacttccaccaaagacaaatcacagcaggatctacctgcaaaataagcttctaccaatctacctgcaaaataatcttcagtcccatatacttggcctgattacccacacacagtgcgacaagaatcattgcccatagattcttccaaattggctttgctggaacatttcacaaggtcatttgagtcaaagtcctaggaaaatagccagttcctctggctgtgtcccattacaaaagaaaacaggtttttattaaatatatgcaaataaacacattttccatgaattaagaatattcacagtttccaaattctggagaaattaggcagagagagaaatatgcctcaaattctacttattaaagtatcctctactcaatacacttaaagtatatatcaaggctatatatagctcaaaaggaacatattctccagactctgaaaaacaaaaaacaaacaaaagaatcatcaatatttcaaacaaaaaaagccataaaaattatttcagtcttcattatttcagtccatgcaatgaactcctgctctgcttcatattgggttagcaatctttataaacacatcagctctttaattagagtcctgaaaggtctctctaatccaggggcacaaactgcaaagtttttagaaacctgcattaaagaatccttttcatgaactcctccaaagaagaaagccctggaccataggtgattataagtcactttttgaggagattaaaagcaatatatcaattgtggatgttgaaagtcataagacagtcataaagacacagttgataaggatatttggttacttgtgtggcatacaacaatttaacataatcataattactactgacaacatatattaagacacatcagaatttcaggaatgtcgtagaatcctggaatgcatattaacaacatatctaaataaatataacccaaagacagttaaatactacctcacatttgataatgcttcctgtataattctaacataacaagcctaataagcctgatatatctctcttggatgtcagggaacctaatatccaaaaaaatagtttgaggtcaaaaagactgaatttcgatcttgaaattttgcttatagaaagtttgccaaatatcaaagttttaagacacttgttatcacaaaatagaatcacaaagtcactgtaaaatgtcattcatttagccaaaattatacaaaaacatttactttttcatagagaggagactaattttcctaagcaataagatgtaataaagatagcatgccaactaaacctgtctggccccccccactccattttctctttgcaacttactcagaaggcaaacaaaatcttttatctcttaatattacacaaacattttgttcaaaagcaaaaaccaaaattttcctttatatattattaaagttaataaaactgtataaacaaatctatctaattttaatcagtttgaccataaggtaagatttccataaacttttaataactggccccaattttctttttaaagagcatatcagtgctccaagaaaaccatgttcttctaacacatagacccagatgctggccttgcatcagtgtgcttttggtattaatgtttaatttatagaaaaactctgatcttatccctcaaaatcggcctttacagtcttacatggctacctcttccgcagtgatccctgggcctagagggattgaatcgttttaacttctggccctgtgtctcataaaagcagttcattatgagtgttcatcttcaaaccagtgcgacacctgcacatattctgtttacaagtacagatgaaagcccatcattgataaacttcttgggatcaaaagtcactagaaagtctctcttttttttttttaactacttaattcaaatgaatgtcacttaattttaataatggtccacacaactaaattagtttgaagagaaatcctaatcaatataatttccttaatgacagggcccgtcttttctgaacattaaaactttgtacccacatcacagtttttcttcattaaattattgattgaattgaattatcttggatataaacatttaaacatttttattctcccctactttttccaaataacagaatatataatgtactgttcagaacttgtcttttattattatttttgtgtgtgtgccagaaatcttaaagctcttgtagttctttagatcattagaggtaagcaaaatccaccaaattttaaatggctggtgtcctctatcaatttttaaaggcttgaccacagtagcttaggaactttagataaatagggcaaattgtagaaccaaacaaaagctttccattagaaacttaaaaagtttacggttttatatatatgtatacacaagcaaaacccacaggagaacaacagcaaacaaatgaaaattagaagcaaaaaacaaacaggaaacccagccctcaatctttcccctactcagtctaccctggaggctacagtgttacccagaacctcccaaaaaaaccacatgatgaatattttattcctggtacacaattcaataaccttaagtccaccaatatcaccatacatcttgtgcaatcaagaaattcactctaggcccatgatcagtaaatactccagcagtatccatgcaaaacagctaacatagtgtgaagcaatgtaagcatgtatgtgaaatatgggtccacactagatctggcttcatgcttaactattaagaattgctaaattgctgatgcatttctttacagtatttcttattttactttcatcaagactaagagctttaactatgaaatgttaattagccaaatttctctcattctcaggttttaaagaatctattgtctaaactcttctgtgttctgttttctctttttgtgcatgaagatagactatacactggaaaaccagaaaagctacatatgacttacacagaccatccatgacatgcctgggctttccaatcagtaccagatttttttcctcttcctcctcctccttctcctgggctttccgatcagtcccagattttcctcctcctcctcctcctcctcctcctccccccgctgcctttnnnnnnnnnnnnnnnnnnnnaaagaataaagctccccctcctcctccttctccctcctccttctccctctcccttcttctttcttatttgtttaaataacatcattttactccaggacagcaagatcttttcacatacaaaattattatctttataaccttccttaccaaaaatacatgatcatcatatacataatttttttcatacctttctcccccacttgtttccttactaccttgtttcataaaaaactttttcaagcccataatttgaattaacttttagataacttctgaattaaacaaaattattatttttctcataacattttttggggcacattttttaaacagaattatatcttatccttagtaaccttaaatgttagtgaaaccctagaaagcaatcctgaactatattagcattttatagatgagaacagttccacaatttttagaaacgtatttccctatatcacaaccctttcttaactggaaatgacccagatatccaatgagcatcaaaaataatttcaaaattttaaattacacaagaagtttacctaaaacatttatcccaattacaagtattcagttctttcattttaaacagtttatctagattacttctgaaaacatatattagatgccatcatttaaagttatttccttattaaccattttataatctatgaatatcagtcattcactgaaataataactttaaagttaactacataggcattttcaccaataactattttcattaaaccaataacttaattactcttttcaaaaaatttgcacaaagatcattttgttttggctgggtttatagttttataaccttctatgccaaaccctgacacctcaaaatacctaccagagacaaatataaaatccaggcaaaaatgtatgctgacaattctgaggacgttgctattttcattttactaactattttaaagctagcttgtttagtaaagatttacttaactcacatgaacttaaaaattgcttggacttaatttatgagtgctcttttacttataagccaatttggtagacacaacatataacaataagtgttcatacaaataaacacatctagacatgtatgtatacacacacacaaatgaaaatccagtagtgtttaccttggaactctagccatgagatagcaatacaaactcactgagtttacatggttacactttgtttactccaataggtaattcactgaaagctgtgaaccaaaactttgggtaaagcagttttcatggcagtttgattttctaaaggccaaacctccccagactccaaagaacactggggccaaacatcagcaaaggagaacatcacatactaaccaggctcaaccctgcttagcgtagcagcacaaaagtctgggtaacacacaactccatcccactttttcattcagcagcaaaccccagattccaaacaacactgggaccaaacagtattgcaaaagtgtatcattttaccaaattctaatttctcatgactatatgaaacacaatcacccaaacacaatccagctgctacagcaacaaacaagccccaaaagtgtccaaactgacacacttgaggtgcttcctctctccattagttgggcttggtcaactgcaaacaaaaattccttaggaatttcccaaattgagaggagctgatccaactgtccggtacccacaaaggacgctcacttgcccggacacaacacgcaattacagaaaaacctccaagaatgttcttactgaaacagttagggtgcttccctctctcagtcatttgggcttgttcaatctacaaatgaaaattctttaaagatttcccaaaatgagaggagcaaatccttatgtctaggcccataagggacacttacctatatcgatgcaatgtcaagtttcaaaggcagttctaatgaggcaatcaggaatgtggttggggccggctgtggtggggccagagagagactgacactcaccttcagccaaaactgggtgggcagctgcttaggatggcttctgagactccctgcccacatcagctgagtcacaagcaacatgttccctgtcaactaaccaaaatctgttacggaatcactaggggtttggtctaggtcctgctgctcgccacacagaaagccaattactgagacaagtattgccaaggaagaaggctttaatcgggtgctgcagctgaggagatcggagctcagtctcaaatccatctccctgactggctaaaactcggggtttatatagcaaggaaaaaaatgtaacaatgtgtaagaaaataggaactagggagggtcaaggaagcaatcatgatgaatgagaggtccagagtctagtctcattgtctggatgtggtgatctggtgagtttcagttctttgacacatttttttgagagccatgaaggtcccttcctgaggaaggaactgagataaaacaaatgtaagcttcaagctttaagaccagaaagatcaatttcactgtttatccaaaagaatagtctgtgggactattgggttggtttcaatttgctcatatatttttgttgttctttcctacccatagatgaagatttaccaacattggcactattgacattttagggtaggttgatttttttgttgttgttatgggaggctgtcctgtgcttggtcggatgtttaacaggatgtttatccagtagcattcaggtgccagtagcaacctccatttgtgacaaacaaaaatgcctccagacatttcctgatgtcccctgtgggacaaaactgccccttcttgacatttactactttagattcagatttccacgttacatcccttgagcctgaagaactttctgtagcatttctcttagcacaggtctgctagtgatgaatattgtttccattattctgcaaatatctttattctgtccttcttttgaagtatattttcactggatgtagaatcttggcttgatatatttttctttcatcacttttttcctgtcccattctccttttcttccagtttcacattagacttcttgatattgtccaagaggtcactgaggtgcagtttcttttttctttttttttcttcctgcagattggataatttctctttgtcttcaggttcactgacccatcaccagtctgctgttaagttcatccagtgaattttttatttcagatattatactttttagttctggattttccatgttgttcccttgttttattctctgcttagattacctgtgtgttcatttattatgaccatattttctcttaaatccttaaacatgttttaaaaagtttataatagtcttctgattattctaaatttgggttactgtgggtttggtttcagttgactgtttcttctctttactagtggttacatttccccgtttcattacggatctagtaagtttgactcatacactgtgcattttgggagctatggtgtaaagactgaattctgttatcttcctctgaaagaatattgacttttggtattaagggtacttaacttagctgggctccaaactttttctcctgtgttgggcagcagctgaaattgcttgcttctttcaaccctgtatcttttcaggagctgcaaggagaatgttgtggttagattggagtgaggaaggggtagggtactgaaaggtgaagtcagagaggtgacctttgttaagagccattttggtagagtgctgggagtaaaagcctgattagagtgggtataagagagaatggcaggaaaaaaatttggtacaaggagtttaagcacaggggttggcatttaataagtattttaggctttatggatcacatatagtttttgatgctgctgttttgcttcttcttcttctctttcttttccccttttgacttcataatcctttaaaagtgtaaaatccattcttagcttacaggccatttgaaaacaggcacaagttgggctcagttgctcacacttttaatctcagcattttgagaggctgaggcgggtggattacttgaggtcagcaattcgagaccagcctggccaacatggcaaaaccctatctctactaaaactacaaaaattagctgggtgttgtggtgcatgcctgtattcccagctactcggaaggctgaggcatgagaattgcttgaacctgggaggtggaggttgaagtgagctgagagcatgccactgcactctagtctgggtgtgagaacgagaccctgtctcaaaaaaataaaaaataaaaacaagcacaggccgaatctggccatagtttgctcacccctctatttcttttttttccccagaaacccttgttctgagacccctcttttaattagacaaatcttcaaggagttgctatgtagtaaagagtaagggggagataggagttaaaagatttttttttctttttattaaggtgaggaaataaaactgttttagcaagtcggcaagatttagccaatagaaaggtaaggggtggggggaggcagatttataatgtaggggagacagaattgctggaacattatttttgagtagaggagaggggatgggatatggggcccaagtgatgggattagctacgaacaaggatagttaatttttgacaatttttaaataatttaaaatatttttgaggttttctttttctttatgtagtgcatagcatggatgtagacccaataactttgatggggcagttttaattcccaaatattcttttttaaagaacagtttgaattcatagtgaacataaattgaaatattttcattaagtaacaaaattaaaatgtgtcttttccctaaatgaaagaccatttgactatttgatactttattgtatctgtcttgaaattaaggtcatttttctctttttcccttcaaagtattgtgtatggatgcaaagatcaattttgactctaattcagcctatcgccaaaagaaaatctttgatctacaggactggacccaggaagatgaaagggacaaagatgctgctaaggcaaatctcaactacattggcctcgatggaaatataggctgcctaggtaccatgtgtttttatgttagaattggattcactaagtttaatttggatttactaagtttaatttattttctctgtgtttgttgcttatacaaatcattttcccctatatagtaaatggtgctggtttggctatggccacaatggatataataaaacttcatggagggactccagccaacttccttgatgttggtggtggtgctacagtccatcaagtaacagaagcatttaagcttatcacttcagataaaaaggtaagggcagggcttgatatatttttatatcatgtaaatatataaaataaatacttataaaaatgtatatttttatgttttagaatttagaattcacatatatgtcttttaatatatattttgagtctttttttgctatcatatcttgaagatttttgcaattcaccaagagactcttctgaaacactcattttaatgtttgtgtaatctgtcattatagatgtgccataatttagaactatgtgtttattaatgattatcaaagtacaagggatgtgaagtatcataattcaaaagacatatatattattaatcactagatatttgttaaggagtgtatctattgtgtggccagtgtagattttgtaaggcttacaaaaaagatataatctctgtggaactattcttactggatttaaaccgagaattcttcactgatagggatgatatcttactaattgttgcttctcgtagtgtctggtataatgcccagtacatatgtaggtcattaatcaatatttattattgatgatgctgctggcaatgtatatttttatttgtggtgttagaccgtaaaattgtttaaaatataaatttatttcaatgccttttcctttgagcctacagccttattttccatatttattaattttgcaaggaggattaaactaaatgagatgtaaaatgtgcattatttcccttgttcagtaattactaaaacaagtaaacattttattagaactatatttctatagcttcttttgacaaactcgagaagcagagtattaaagacaatctaattatctaactgttgagtacttactactagaattgagttgagtacttacaactagaattagaattctagttgtttatttttctaagcatggcttttagggcccaggtgcaagaatggagaaaagtatatgaagagttacagtgtaggggactgacatgatgggcatcagagttggaaacagaatggaaacccagggtgtcaatgtggatagcattgaagtggccatatattttgtgatggtcactgtgcttggacttggaaatacatgggcccttctcttaagttacttatagttttactggggtgattgacacaaagtagtgctgtggaagaacagaggacagaggcaaaaactgggagaatcagggtggccttcactgaatggatgataccttaagctgtcttgaaaattaaatgagggcaagaggaagaaaatgtacaaagacatagaatccagagagggccattatgttcatggggtggtaagatgcttatgtgtaagaatatggcattattgggataaatgataagagataatgttggcaaattgtgaccacatttgtgaagatccctattatctatagttaaggagtttggattttaactccctaccccagcacatacacaagagaattcataatgaattctcttgtggaagagatccctgacaaaggcaatatcagtaagaataaattagaggcatttctgagatagggtcattaaattcattttttttcttcttttctgggagcctcatagaagggttggttaagttaacattaggactttgggctggggagaatcattgggtggtgatgactttcatgctgtcagaggcaaagtcgaggaataggtatttcagaatgaatgtcaagtttggattgtggtgactatatctagtagacagttcattgaaaagatattgtacttcttatattggagaaaagttgaagtcttaggagttggtgaggtgatctgtgcaagtgagatgaggaaccaagaatggaacctggcccctccatttttgttgaagggttgaatagagaaggaaaacccaaatgaaaaacagagaacaaatgacagagataagaacagatcgggagagagtggtgacatcgaaggaccaaggtgaagagttttgagaagtaaggcattgggaaacaatgtcaaatgttgtaggactattcagacagagtaagaactgaaagaggtgagtgggaaccttcgtaagaatagtagaagagatgggggcataggccagattgtaatggattgatttgatgaggaattgagggaatagagatatccaggagagattactcttccaggactttttttttttttttttttacaaaggcatggaagggatgcagtgctatcagtcaaaggcagtaggactgaggagagttttgtggtgtatgttttcttgcttgtttagaagatcaagaagatgagctctttctagttggaggaagagaagagatttgaaaataaagagagtgaatgtagctagaggggtgaagacctggaggaaatactatgtagtaaatagatggagataattatctggccaggtcagctttggaaaggtggttactcctttcttgaggtgccactaaagaaaggaaggttgtatgctaaaagttagagagcttgcatgggatagaaggcttatgaagagagttaaaggtatgaggccgactgctaagttgaggattgctgatgaattattattttattgctcttcaggttatgctagtgtttccagttttgttttcagtttttacttttttacttttccctgaataagctatggctggaatcatccaaagatgcattgtttgaagtaggatggcagaggaataggtatgacagaattgagcatgcaggtggcagtgacactgaattgcttagccatatgtcccaggctctatagtgaagaaagtcagttccattgagagctaatagagtagaagattagagagggattgagggactagaggcttttttttgggagggggggcggggtggcggactagaggcttttaagaggaaaagattgtgtttgatagagctagaggagaaaggcattaaagtgaaaggggaaggaggttgagcagagaatgagatttatacatttaatattctagagacactcattctggcctagtccaggatttatccatggtagtaattcgtttaaattgactacaggtgaaagtggcttggtagagtaaagatccaagaactttaaggctggagtgttagatggtgcctggtggtgaatatggaaactatccagaatgaggtgagagggagagagatgagagatgccaaaggctgctatgagttctagtctgttatgaattccagagcttcatttcttaaaggtctgggaataatagtggtaaggtaaagaatgtatagtatagctcagtgtgtctcaccccttttcatgtcatggcattcacagaaggtatttcaatggggccttggaggtagatggagaagattgcttgtagtcagagtccactggccctgaggctcctgctgccccagaacattactagctgccccaagaattgaggggaacgatattttggtgtatctacaatgcattttaatctcattgtttgagaagccctggtatagctgagtgaactaaacctctttttttaaaaaaagagagattatttggaaaggataggagaacactgattcagaactatcattgtgatgttgaaagaatgctgacccaaacaggtcctgagatttggatgtgaaatgtacccaagagagggccatacaggagaagctgggtgattcttagggcctggtttgtgtaaaacgttgattacattgatggggattgttttgcagtgagcaggtctatgcatatgtacccccagaggccaggggatctgagaggccagagaaagaggctggcaaatccagttctcagaaagaaactaaatttatatagggacttagaaacagaagctatggcttgggtggctgcgagatggtggatccccacactagccctccagaaattatcctttatgtagtgagctttttttcttggtaacacttgcacagctggtcacatctcagaccctcttgtcaaacttgtgaccattgaggaagttaggtaaacatctttatgagttgtcatttatgctacaggcattgtttctttataagggttatctatgttacaggcagtatttcttgaccttgctgcagaaggccttgctctgcaggagtcaaacattagtcattatgacagttttgcttcaagatggtgttactcttgccacacaacacgcccttttcctacagggataaatgaggaaatgataggtgacaaacactaaattggagatcttgcacatgagactatcttacagtatgatctgggggtagtcacgtaggtgaatggccaaatttaacaggagaaagtaaatggaattagatggtcttgttcatatgggatatagtagagaaggaaatgtgaactaggtgttgaaattacccaaggagatggaaataagttctggtgggcagtggactacatagacttcaataaagagagctagaagagggtattgtggtttggtctgaaaatctttctatcaagttaatgtttatcatgaagcacatatactagtattttttggggaaaagaacttaaatttcttttaaattttaatctatcagaacactttattcataggtactggctattctggtcaacatttttggaggaatcatgcgctgtgatgttattgcacagggtatagtcatggcagtaaaagacttggaaattaaaatacctgttgtggtacggttacaaggtgagtataaaaggtatcttgcagttgttcctaattctttaaaagttcacatttccatggagttcagtttgttaaaacatagtttttaaatagctgtgtctttgaaagcattatacaatatgaaattaaaactatagtttttaaaacattttaacattggggcaaaatgtttatacttttgcttggtataatttgatacactttttatttgttgtgatttgtcttgaattctgacttgcctgaattactaagcaagtcagaattattgtaaggcaaaatattttataagataacctgggcttttacagtgttttctttggtttagaagtgtttatactaaataatggaagtctcctctgttgaggttttattcttataccatgttttggcaaacattttaaaatgcttttgtgtgtgtatttaaaacatttatatttgcataaatcatttacaggtacacgagtcgatgatgctaaggcactgatagcggacagtggacttaaaatacttgcttgtgatgacttggatgaagctgctagaatggtaaattggccatgttcatctaaggaggatttataaacacagattctaaaatgaacctaattattaatacagctaataatttgtgtttcagctaaatattatgagtgtaatgaatggttaaagaaaacgattattcatgactcttgctgaaagatgttaaggcagactttattcagagggactgttgcaataagcatagagactactgcagtggagttttgcagtaggggagaaagattgggcccaactccaaatacagcaaggaaaagtgggaatttataaccaaggaagagggtcggggcagtggatgaaaaattattaaaaggatacattatgggtaagggaggatcctggctaaactgacttaagcaagattcttggtaaaattggactatgcagggacaaatacagaagtccaaaagttagggccaagttgagaagagagttcagagtagcctttgggaggctgaggcaggaggattgcttgagtccaggagtttgagactagcctgggcaacatagggagaccctatcttcacacatgtgcgcacacacacatgcacgcacacacacatgcacgcatatgtatgtatgtgtgtgtatctatctatatattcgataaatatatattgaaaaaacaaaagagagtttggtcaaggagagaatctttgtcagaacgtcttatatctgtgatcatcttaaacaacggtcagctcctgcccaatcttgtttgttgttttgtctgtattcttacttcctcccacaactgtgattattttcaagcaaatcccagacattatatcatttcatacatttcatcatgcatctgtaaaagataaaggtattgataatggtataaaaaaattactgttacttgttttaggtggggtaatggtattatggttatgttttataaaaatacagtctgttgaaatttctgagtctcttatatcttttgtttaagttctttgtaagggtcagaataagtctctgcattgtagttggttaatatgtcagtaagtttcttaatctgttggtttccccttttaaaaagaaaagtattttctgtggtttatttgttgaaaaatccaggttgatggtcttgttaagtttctcatagtctggattttaatggttgcatctttaggctgtcattcatttactgtgttctctgccctctctgtgttctctgccttgtgtatttcctgtaaactgggagttcaatctgtaggcttgaccatattcatatttgattttggggagcagggaacaagaatatttcatagtaggtgtttaatttcatcaaaacgtatacaatgttaatctttttgtggtattactagccattgacatcatagcttagatccagtattttgtttgtgttgcaaagcgttgctattgtaattctgtcattcttcacttattatatgtaatgcttctaaaaagtaatacttccacgtgtcaaccatttgttaccatggagtacattttgcataggaaaagtaggataattacctgattgtttgcctttattgaccaattttcaaaataatgtttgttctattatgtccaataaaggtgacctagggttttttttgttttttgttttttttgtattttgtttactttttgttttcaggtgtgtgtgtgtgtgtgtgtgtgtgtattgtgcgtgtgtgcatacacatgcatacacatgtgtgttccactggcatactgttttgaacttatgacttaaaacattgatgtagttcagttcatgtaagttgtgattgaaattgtccaacctttggtctttgggaacctcttcaggttaactgttgcatccttctgagaagccctctatctggtatgataaaatgtttcaggctcatctttacgtttcttgagtcagaacttgaatgggccaaatggtatttagagagcacaatttggccttatgagtattcatagatactgggttgattattgtttctgagctttttaagtggcaagtctgagaaaacatgtattttttaaagaggtaatacttgagttcatactgatattttcaatgcaagtccaggagtatagatttttttttcttatctgacatctgtttgtaccttcgttcatgccatactatcataattattcatttgctttgtcccttagtacagatatgacagttttataataagaataccaacagtctgattactgaaagcaattatatctgcatttctttctgtcctttagggtatgtcccacaacttagtggattttaaaattcatgtgaaataattctctgtgtgttttgtctcagctttgtatagtttcattgtttttaaagggattgctttttttttaaaaaaaaaaacacaaccttttgttttttattttgtatttacatgattccaaagtggaaagtatagaacaaggtattatcagggaatctagcttttatatatttccctctttacttcttccccaacaggcaacctttttaccttttttgtttgtttgttttttaagaaagttttggtttatctttccacttcttaaaaacataagctaattgtatgtatataactatatgtatgtgtgcagtagtccccccttatctgcagggaatgtgttgcaagacccctagtgggtgcctgaatcacagatagttccaaacctgtatatactgtgcttcttcctgtacatatattcctttgataaagtttatgtattagacatagtaacagattaacaacaactaataataaagtagaacaattataacaatataccgtgataaatgtgaatgtggtctctcaaaatatcttattgttctatactcacctttgtggtgataatgagatgataaaatgcttacttggtgagatgaactgaggtgaatgatgaaggcattgtgacatagtgttaggctactactgacctaatgatgtaacagaaggagaatcatctgctttggttcatcctggatcattgagccatgatgttgattgttggatgtcaagagtagataatgttgatgactaatggaagagtagtttatacagcgtggatacgctgggcaaagagatggttcacattccacttggagcaggatggtgcaagatttcatcacacttctcagaacaacacacagtttaaaacttaatgacttttttatttctggaatttctcatttaaaatttttggaccacagttgactgcaggtaactgaaactgtagaaagtgaaattggataagggggggactgtgtgtgtgtgtgtgtgtgtgtgtgtgctcccttttcccactttagattaatggtaatctatactttgtttcttttacttaacaataatgtgtatcagagaacacttcatagtagatacagagagatgagaattttttgtcttcccttccattatgtttatagacatttcattgaacactcgaacactctttgggctctatagcttaatcaatagtagattcttgattttttttttttttttttttttgagactgagtcttgctctgtcacctaggctggagtacagtggcgtgatctcagctcactgtaacctttgcctcctgggtttaagcaattcttgtgtctcagccttctgagtagctgagactacaggtgtgtgccaccacgcccagctaattttttttttttttttttttttttaagacagagttttggtcttgttgcccaggctggagtgcagtggtgtgatctcggctcactgcaacctccatctcccaggttcaagcaatcctcctgcctcagcctcccaagcagctgggattacaggcatgtaccaccatgcctggctaattatgtatttttagtagagatgcggtttcaccatgttggtcaggctggtcttgaacccctgactttgtgatccacctgcctcggcctcccaaagtgctgggattcaggtgtgagccactgcgcccagccttgtatttttagtagagatagggttttgccatgttgaccaggctggtctcgaactccagacctcatatgatcctcccacctcggccttccaaagtgctgggattacaagcatgagcccccaggcttggccagactcttgaatttaccgagttaatgtgatgtcatttcacaaaaataataaaagtcttatgtccttctttgggaaagtacttactagtaaacaaaatttaactctagcttggagacagaagaatttaaacttaaacctgaattaaaaataaagaatttgagcaagggaatagtaggagaaagtatttcagaaagcctattttgactttgagatgtgggatatattgaagggaaaaggggagagatagtaggagtccatctagtgcaatacttagatatgagaaaaggtgaaggtaataaataggttataacttgtctctgaaagtgcacttttttggaatgaaaacttaaattaaaaaaagcttggaggacatgaaaagaaggagaagaaccagtaggaccttgatcaaatagatcatgagaggtaaaagtgaacagttgatttaaattatgactacagtgtttttattgactgggagattatagaagtcataacaataataatattgaatgagatgatgatgatattagcagttactactgtttattgagtgtttactgtgcatgcaatgctaagctgttttcttcaaggattatctcatttaatatgaatttggtgataaaatttccatttttatagatgaagaaacaggctagataagttaacttattcaaggttgtatgtcataagcatcagaggggggatttgcagccaaagatatctaacttcaaagccttttcttaactaatttactgaggaagagagaagctgagtttgtttttttggtcttagacatgtctaaatttgtatgatgttttgtatggtaactggtggatatttttagacagattgtagagagaattggaactcaggttagcaattgttaacttactgacaaaaagtaaaatactaactagtagacccaaatttctatcccaacattttaagttaagattgtatacttatttcaaaacaaatttttacttagatgtgctttgagttgtggagtatccaacaaagacactcactgtttctgtctttaagataaaatttagaataatatatatatatatacacacacacacacacacacacatacatacacacacattttatacacacatatataatcttatgtaatacatatgtgtaatcctagcaggtggtataacatcttaatcagaaagtatttaattgaagtttggactatgaggagtgtcagacttgattatcctttgagaatgtcatttgcttataagaacgtaatgtgatttatagcaatgtcagaatagtccagatgttttaaatggaaaaaattgagtgtacattaattttgcactgacctgtagttctgaatttacctttttgtgaaaattcttcgttcttttcttttaggttgtaaagctctctgaaatagtgaccttagcgaagcaagcacatgtggatgtgaaatttcagttgccaatatgatctgaaaacccagtggatggctgaaggtgttaaatgtgctataatcattaagaatactgtgttctgtgttattgttctttttctttttagtgtgtggagattgtaattgccatctaggcacacaaacatttaaaaggatttggactgcatttaattgtaccattcagaatggactgtttgtacgaagcatgtataatgcagttatcttctttcttttgtcgcagccagtcttttttgcttctcctacaaaacgtaacttgcaatttgccagtttattattgttggatacaaagttcttcattgataagagtcctataaataagataaatacgaagataaagctttattctttagtgttaaaatacagtatatctaataactagcctcattagtagagcagtatattaaaacaatgttttatgtaaaaagtgtttatcttcagcaccaaatacatgataaatgtatcaatcactatttataaacagagctttcaaacactcctcagaatattcttctaagtattttgatgaagtaactttgtaattatttgaacattgttttaatcattaggaaacactgattaactgcaagtcttcatgattctgtcatattaagaaacacctgtaggtttgcttcaaataaaggcatatataccaaggacttacagacaaaattaagaatgtcaatttaagttaataaaaatctcccaatatgatttgggttcatggcttttgtttgcttgttttgaggtaaacacagtagaagttgatttgttcgttattgcagtatagaggtctaagcaccaattcttagatcatatacttgccatgacagtgatttgtttttttttttgagtcagggtctcactctgtcacccaagctggagtgcagtggtatgatcatgctcactgcaacctctgcctcctgggctcaagcagtcctcccacctgagcctcctaagtagcagggactacaggcacacaccacaaaaaaacatatgtgtttttttttgtttttgatttttgttttttttttggtagggacagggtatcactatgttgcttaggctggtctcttactcctgagctcaagcaatcctcctggctttgcctcccaaaatgttgagattacatgtatgaactactgcacccagccaaccatacatattatacagctacttatagatagatagttcactggaagtctgctatttatgtgtatgccatctagtatatcctctaaaggaaacagaggggagaattgaatccaagatgcctaacttcaaagccttttcttaactattttactgaggaagagagaagctgagtttattttttggtcttggacatgtctaaatttgtatgatgtttttgtttttgtttttgttttgagatggagtctcgctctgttgcccaggctggagtgctgttgcacgatctcagctcactgcaagctccgcctctggggttcacaccattctcctgcctcagcctcccgagtagctgggactacaggcgcctgccaccacacccagctcattttttgtatttttagtagaggcagggtttcaccgagttagccaggatggtcttgatctcctgatctcgtgatctgcccgcctcggactcccaaagtctgtatgatgttttatatggtaacaggtggatatttttagacagattgtagtcacatggttctttttgtccatatatgtaaatatatgtgtgtgtgtatatatacatattgaccttttgctcactgcataaaacttggtagttaactaatgccatggaaggaaatgttgaccaagcagtagactatttaaccatactgatggatttaagaacttctacctattgtgatgttcttaaagtgtgatcagatgtatatactatgagaggcagcataacgtagtgatgatgagcacagactttgaaagtagactgtctgctttgaatctggatccactacttactagctgtatgagggcttcttttgttttttgtttttttgagacaggatctcagtctgtcaaccaggctggagtgcagtggcacaatcatgactcactgcagtttcaatctcctgggttcaagtgatcgtcctgcctcagcctccttttgtagctgggactacatgtgcatgccaacatgcccagctaatttattttttatagagatggggtcctgctacattgcccaggctggcatcaagcagtctttctgccttagagtaagttttaatgctagtgtccctcagtttacttagctcttttcttatcagtgaagtttatttagtaagggaagagaacaaaaatatgtgagagaatttatatgtagaaaacaatatgtatttttagccaaatatatatttggtagtttacatatatatgacacagagtatcagagccataaaccatttaaaattgtagccaggtgcggtggctcacgcctgtaatcccagcactttgggaggccgaggtgggtggatcacctgaagtcaggagtttgagaccagcctggccaacatggttaaaccctgtctctactagaaatacaaaaattagccagacatggtggcgggcgcctgtaatcctagctacttgggaggctgagagaggagaatcacttgaacctgggaggcaggcggaggttgaagtgagctgagatcacgccacagcactccagcctgggcaacaaagagcaaaactccatcttaaaa

SEQ ID NO: 15677 - DNA, 32958 bp, Human
ttaactttcttttgttgagtcatggactctcctcctccctggctcctaagttttcagggtcaacgggcaaccttttctaaatcacaagactggatttgctatgtttggtcttgctccagcgtctttattatccctgctgttgtgcactacacagttctgtagacacatgagataaaatggagaaaaaaaaccaggagattattcccagaccggttgccaactgattttaaactgttgctcactgcaagtacacaaaataatgaatggtcttttattcatgagtctttcaaaatagaaatcctggggcggggaggatttctagttttgtcaacctcatttgttcatcctttgcctcagcttcctagtctgttcagtagtgttgttcacgaagaattttgttttattttcttctgtaattccttttttccccccggagtataatgacagccagattcttctctatcatctactgcaaaatgccttgagtatttttctaccatcttattttaacacagaacgaagtaggatgtacatataattatttataatcctccagatcttgcttccagaaatacttagtcttcaactgtaatgtctcagggaacctattaaactagggagctggaagcagtcgttgactttgaggaattagataacattagatactatgaaagtccagtccatagagtcaacctcacagagccgatgcctgcacaagggcgacccaggagtttaaataagttgctgcaagtatggttagctactgttaaaactcaccagaactggaacctaactcatcctcctcttggttgagcagatttcattttgacaggaatttctgaatacccaaagcaaactcaaagtctggcctgggtttctatctcagcccaggatgcttctgaaatacatgaacagaaggatttggagatcttgggctgtttccctgggacttatgatctgacattctatggaaatacccaactccctccttgagcagggccaaatccccaaagatctcagactgaacccacttttttcagggttggcccaaggcagagctgacacagctgtaacattctagagcacacccacaactctggatgaaccaggacagaatggggtggaaggatacaagataacacatttgtccaagggggccgtctgttgacacagtaatgaacgcaataacgacgggagccagtattctacctcgcattagttgtaaatgaaacgtcttcaaaacatgagaattttgcgttatccttaattattttttcattttgcagaaaaataaagggactcgtcatcgagtactttgagtcacaaatcagccaagtgtgcatgtggtttttttccaagtacgcacaagagtggaacatttcgttttacgagtgtgagatgtttgaaatacaaatctgccaagagcttcctccacattggtctgggactaggcagaacaggccctgacctcctgagagagggaaggaagaccaggcaggtctgagccaggtaaacgcccttgggtgaggtccgtgaaagataaagtcagatctcaaggacagagagctttaaacatgtttgtgctccactgagtcggttacctaataagtgagaaaatgaagatgtggatgcacaaaaattccatggcctttaggctcgcggtggggacagggtacagagaagcggcggtctggtgctgccaaaggttagtcccttgtacccggcgaactcaggaaagttcactcgatttcgctacaaacctgcagcactcggcctggaggtaacctggttgggagcgaattcagaactggaaattccaggcggcccagagggacacccatccctctccgaggcgcgccgggatccggcgcccagctgcggggcgagggcagggtcccgcgcagcaccccacccccggccgctggctccgcccccgcccccgccccgcctcccaggggatgtgcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggcccagaaggaggccaagaaggacgagcccaagagcggcgaggaggcgctcatcatcccccccgacgccgtcgcggtggactgcaaggtccgagcccggggaggtcgaggaagcgggtgctgggcccggccggggagggctgcgcggactgcagcggcagtgcgccccgaggtggcgggcgcggggctcgcgccgcggggacaagtccccgagagagcccggcgctcccgtttcctgtgggtccgcagctcctttgtaaggaagtgcgtgtgctggaagcggtgcctgacgcggggtcgggggcttgggaggcctggagagggaacgattggctaattgtgccgaattcccggtcgtttgtgcagtccggggagcgtgcgtgcagccaggacttggcttgttcgatctggggaccggcagcgacaggcacaacaacaacaaccgagtttggcacttccttcccagtataaataatgtacctaaaatggctgacatcattacaagcctaaacctctgttgtttcccactttcgtttctaggcttgaacagcacttggactaagtccagcaactgtaagcgtcttaattttaaaagcgtttctttacctcctttttccacggcccttcggtagtggcaggtgaacttcacctggagaggggacgaagggacagtccgcccgaagtaggtttgggctgtctcttaccattactagtaaaggccagtaatgactatgtggatgttagtgaaaaaccaattgttggcatttaaattgtatcagcgtctttgtgaggactcctgctgcgtgaaactaaacatgagaaatttgcccccgggtccctaataaaattctcctttattttacaaaatctccctttaatcctaggaaaattcatgaagtggggctgttactgtgttgacttttagtaggttacgatcatatttacttaaatatgagtgtaattgtctcataagttaaaaaagcccacagcctcttacccagaccctttttaggctgcaaaaattagaaattaactgtaaagttatgttgcttatcttattttttgttgttgttagcatttttcaagacctattatcagtagggtaaatttagttttaacttaaaaaaattggtgtgccacgtatgaataatgggagtttttatatggacgaatgaaaattattgctgaaaaacaggccactaatatactgtaaaaaattcacaatataatggtaatctagacatcatattataatttattatattctgaatataatctatcttcagaatataatggtaatcttactttctggaaatgttctgataaaaacagacacgtcagaggttgatttctaaatgacttgccttgccttgaaataggaacagtgaactgattccctaaaaggattaaaggttttggttttcgtattggtattgttttcctgaagccattgcaaacaatcttggtctttaaagaaaatgtttggaatgcacagatgaaaattgcagtagcaaattattatgttagctctttgtttatctaacattcgttgtacctaaaatagattgagagtcaagtatccagtcacaacagtctcaaatatatgtagtcttaatgctatcacatatatatatatatatacacacacatacatttaaaaatcctattaacaaatataactgctcccatttagaaaggagagagtgagcgagcattggatgatgtcacttcagacagcttttctctgttccgctgtagtggagatttgaaactctggacaaacatcagaattacatttgctgagcaccattaaatctgacttctgacaatttttgtcatttctgaaatagtgactctgccagattctcaaaattgctcacgagttcaccatatttaaattttgtggtcattgcagctataagtaatcattggtagctccgtgctttgttttccattttttattttctcagatcctccatatccaaagaaaaatactactgggactaaagagtgagggccagagtcgtctttgtaaaccacccagcagtcacggatgagttggtagataaaaaatgactaattctttttccagctataagctgaaagacttctttaggggatgacaaaatatttctctacattaaaagtagaatccttataatcagtcagtcgcttaacgggaaaaggaaaaccttaatgacagacttttgtgaaagaagttctgatctcttcatttcagagcttgggcagtgattacataatgttctctggctccttgcgggtggctctgtggcagccaccttgtctgactgcctggactgggaacagaatcagccttaatgtgttttgccgagggcatttcctttgcctggttggttgaaagaatcaaaccaagctagttaatggcctagaactcctgaacaagaatttttcttatctttaaccctcccagatcacaatatcccgcagaccattgttttccaaaatgtgctcttagggaccacctgctctggttttaaaatgcagattctgttaccttatgccacaagaattctgatcactctaatcagctggcttatataacatgcattccagtacttttacattgctcctgtctttctatttttttcttctgcagggtgagaactctccagaaacagttctattaccccatttttcagtcttatcttttcagcagctattaatcctaacagccatttctattgatagttttatctcaactagcttgctgtttattcttttcctgcattttccccttaattgttttcaccttcctcctctcctagtaggcataaagctcttagagctatagagacagcaaagatgggatgtattttgggtagcagaagtgaatttgaaattatatacatgttttatgctataggcaacaattcatatatttttgtggcaatactttgaaccttgggaaattgttttatatttgcagataacaaaatacttgatgtactgtatcagaagtcccagttttgtcattacataactacttgatcttgggcttaaatttttaggttttctgtctgtaagatgagagggtaggaccagatggcctgtaaggattcttccagtttcaaaaatctatgaagatgctaggattacataattatatttggcagacattaaattgttttaattgtgaaaaatagcaactacctcctcactctaaccagactattccctttcttccttttggtgtttaacatgttacattcttccctcatatcaagtagtagtgggtcaaagagaaaggagatgggtagaggtattatgtaataaagcacattgtcacttctgtttacctcacagtgaacagtgaagttgtcagcacctctttgttgcaatgcctgcttatgaaaccccttttccagtatcaggccacagaatagcttaagcttgcttcatatgtatccctgcaagttgttttgctgacaaatagtgttgctttctctctaccccactttgtagatattctttaaaaggagagagaaaagtaaagtgctgatataggagagaaaatagtggcagggtgagtgcaagagagaaagtgaaggccgactcacccagtaaaagttttgagttacccatgacaaatggctgtttagaccctggttctttaccctttctggttttccctattcacacaatcaagactgaaggttttgataattaagcttttcgtttgtggtggtggttttgtttgtgtgttttttggggagtgaggagaagggacataaaatgcatggctggccatttactataatgttgatataatgctctcaagggattgagagcttggttctctttaaccaaagtgcatcttattacctagttatgtaattccgtgtttgcagatattggccagtgaaacttttacattacattttggttctccatgaggatattaatatctgaattgagggtttagtgctgggaaataaatgaattgcgtctgtgcatcccaaatgccttggcaggacctcctgtgtacacatccctgacaggacactgctgtagcatattgggtgtgcaaggttgcatattgcacaggattgtagtcttcccaactagacagaaatgagtataatatacttggcataataagcctgagtgacctcatggaattcaactctgacatataaaaggtttatgtgactggaagtattttttaagcagaaatatctcaaatacgtttatgttacaggcctatttaaattaatttagaatttgacttacaaggtgtttattatgcatttccaaatcttgacttgtgggtaaatgtacatagaaacatgtactaagtagtcattgggggagattttatttctcttagttttatcataccataacttaaatgtctggcgtgtctattcaaaacccacattctttttccaaaaggaaatactacttcctgaattcctagatttaactaaagcttcttgtactgctttgtatgtcagtgtcagtaaaggaagactcagaaaaaaaaatctttttgggttaccagtaaaatcatcctcttaaattttttggcaaacgtggcattttattagagcttaaagactaaaggaaaagaaattaaggactttagaccgttactgaaacctgttaaaggatttgacaattctgaatttctgaatgaggtgatttttgcctaaatgatatacaaaatattaacactggagctgtgcttcacaatgaaagtcttttccaaagtagacagctgaaagttgaaaattggaaattataacactaaggacatcatttttgaaaaatttccacttaattgtgattatcccttttaattagtacttacaacacatatttttaatagctttaaggagatctacaatacaacctcattttataagtgttatcaacaattgaatgaacaagattattttaaattattgtgcattctttaagctcttttattagaggaaaaaactttttgcagtatttctataattgtacttggggaaaaatcaggtaagaatgaacgtagactttttattcttaaacagaaaagtttgaatcttgagttgtagcgatgaggaaattacccttgtttttatggtagagatatattctgatttttcacttaatgttttatctttcagtactgataagttaccagcaataattttatgatgttgaactaacataagtacgacaaaagagaaataaaattttcacagcttatatataataccacttctgagttaaatatcctggacgtttatttgggaaagtgatactaagtatggtggtggatattttgtactttgaaattttgaaatatttgcataaaccgtttttggcatagttgaatttcatactttaaaaaacaagtttggtggatttttgtgtttatttgaatgattaactttaaggctcaaattattatttttttttagtgaaagcaagtttattaagaaagtaaaggagtaaaagaatggtactgcataggcagagcagtcaagatgcaaattatttttaaaagttgtttgttttcagaatgagttaaggataaagcttaagtcttaactattttctctgcttatatatgattataatgttttaaattattttatataaaaattttaaaagatgcattgttaattaaatcacttgaatctctgcagtatccaaaagcagacccatttttatgctggggaaaatgatttttgagagctagtctatttagctttgcattatcagttttcagtttttcattttatataactttatccaattcattttttcctccctttaatactgggacataaaatttcctgtctatcagttttacctagggccgtgctaggcatcttaagcagagaaggcaaattcagtgtctcctgggctgaagcagatgaattgttgaagctggactttttgcatatgaaacaagtaagaatattcttggttttcctgccaggcgcaagccaccgcctgtaatcccagcactttgggatactgaggctggtggatcacctgaggtcaggagttcgagataagcctggccaacatagcaaaattctgtctctactaaaccaaaaattagccaggcgtggtggcatgcgcctgtgattccagctttttgggaggctgaaacaggagaatcgcttgaatctgggagatggaggctgcagtgagctgagattgcgccattgcattccagcctgggtgacacagcaagactctgtctcaaaaaacaaaagaatattcttggttttcatttttaaaacatgagtccagtgttgctggatcctccaattttccaaggcaagctaaaaatcagtactattttaatttatacaacaattttagcccaaaacactgaaggcatgggccactattttataatctcctttaaagtggaacgcaggactggcaaattatagcctatatcttcaaatactgcctgcctgctgtttttctgtagcccatggggtaagaatgatttttatattttttaatggttgggaaaaatatcaaaggaatgatatttctcctttttgcccagtaccctcactgaattgttggggaggggctgctgctattcaggaagcagcagcactagcagaattcaggttatacagtcattcttcaaaagatttaaattttgtctctatcacttactttgataccttgggtaagttacttcagttctctgtgtctcagttttttcatcagcaaaatagggaaaataataatctgtaacaataatagcacaatgcctggaacagagttaaaaattagtagatttcagctactgttatttttatttatttttttgttgagaaacagtcttgccctgtcacccaggcaggaatgcaatggtgtgatcttggctcactgcagcctctgcctcccgggttcaagtgattctcctgcctcagcttcccaagtagctgggattacaggcacctgccactatgcctggctaattttttgtatttttaatagagacggggtttcaccatgttggcccggttggtctcgaactcctgacctcttgatcaactactattattaaagtcccagttttctctcctcatcattcttgttttggaatattacttcttatattactgttactgcttatccctgcctcacatgtcagtaacaatattgttggtacttttttcacagcaaggcattctggtaaagattgattcctgcaacataaaaacccttaggattcagtagctgtaccgatttcatttaaaaatgttatttattcattacataataggtgttaatagaatttgagttttaccaaagtaatactaaattttaatatgcaaatatatagtcctgccctatgtcagaggaacatactttaaaaaaattgtagcatcattgtatacagtaaaatgcatagatcatgagtgtacagttagataattttaagtctgtatacctgggctctaactcccaatcaagctgaacattgttatcaactcagaaagttatcttgtgtccttttacaatttgttctccttagaggtaaccactattctaatttttctccccatagattaattcaaagcaatcatattcacttattagcttcttatggtcttttattaccatggtgaccactagaccctcttctgcctttgtgcaatttagaaaaagatcccctctctggtggtttggagaatagagcatcagttggtttctagacctactgattcccttggcctggcatccttgtactggaaacaacctgcccaaccatacatggcgatcttaactccatgtttctcactttttgccccagtagggcgtggtgcggcgggcagcagagtcttgctctgtcacccaggctcgagtgcagtggcatgatctcggctcactgcaacttccgcctcccaggttcaagtgattctcctgcctcagtctcccgagtagctgggattacaggtgcccaccaccactcccagctaatttttgtatttttagtaaagacggggtttcaccatgttgaccaggctggtctggaactcctgacctcaagtggtccacccacctcggcctctcaaagtgctgggattacaggctgagccatagcacctggccctccatgtttctcttttaactccctatttctctaaatcagtggttgttaaacattttgctctgagaactcctttatagtcttaaaaattgttcaggatcccaaagagcttttgctttatgtaggttatatatatttccaaataaccaaaaagatttaagaagactaacagtaacattgttttacattcggcagtgccctttattgaatagcttaatagaagatagccggattttcctatcaaattcttcattcagtctgttgtgatatggtgcttagcttctggaaaattgcactgtacaatttttattgtatataaacatagcgagagaatgaaagtgaaaatgacagttttattatttaaactaacacagtcttagttttattatgaaaaaagtttgaccttgtggaccccctgaacgggtgtgttcctggaccacatttgcagaacatctattctaaatatttgcttatactgctgtttcatggtttgttttcatttgttttattttttgcagttttagataatacctattgataatagctacatggaaggtgaatatttagctttttctgaatatttacacactgcacacatgatctcttctcctgttctagcaatttctggttaaattgatatttagtgttttttattataattaacataaacattagttacatttgagtattgtagtatacttttattttacttccattcttgtataacaactttttattttccctgaatttgatcatgcttcttggggcaggagagagggttccttaattttctacatacttactgctcattcattcctcagactctgacagcagtataattgtctttctgtgtcttcaaactcaccaggtaacttaccaagtttctttctttctttctttcttttttttttgatgatttcttgcccatcattcattagttttctattccagactggttgcactcatacaaatgtcctgagagtcataatcatcttggaagaattgcctttgtctttatcacatgctagatctacagtttcataaatctgaagaaaaagataaatttttaaaaaatcttacgtgtctcagaatcgttattccatcctcatatttgataatttatctgggtgtaaaattctaggttagcattcatttttctctcagcattttgatggcattgctccattatcttctaatgtgatgccattctgattccttgtttgtacatgactttttttccccctttggttgtctacaggctggtgattttctccttatatcttttttttcttttttcttttatgctttcagctttcaacatttttattgacatgacttgtctgctgtcattcattttcattctttgtggcttaaggtttatttgttttatccctttactgtcgctttattgagctttcaggaggaagtaaacaaacatttcactggaaatcaatattagaacttcaacttagctatcttgatagctttttaaagatttgttagaatatttccttttacattaaaaattgacttaatgataattaataatggataataatggaaaccatctgaattaccattagcattaatttaagatcagacaggatggtctagaaagattgatgaggcatcctctgatcgtcctcttcaaagttccaagattgtctccttcatgaggaattttagaggcaactcattaccaactttgtagttttgctttgtggcattattactccaactaacttaaaaaagtttcatttttgtaattaatattttgcctttttcatttatgttgaaatgcttatgtgctggtgtgccttagttattttcctttattgttttaagttcacatgtatgtgattttaatactttttgctaccatcctttgtaatttgttgaacaacagagaaaagccctattaattttgacaacatattaaaagtaatattactgcctttgtaatagttcacacatgtagggcttattagtgtgggtcaatttaagtaaaccttttacaacagtagaaattcatgctgtgggccgggcatggtggctcacgtctataattccagcactttgggaggctgaggcaggagaattgcttaagaacagcctgggcaacatagtgagacctccacctccacaaaaaaatttaaaaattagccatgtgtggtggtgcacatctgtagtcccagctacttgggaggctgaggtaggaggatcacttgagcccaggaggttgaggctgcagtgagccgtgattgcactattacactctagctggggtgacagagcaagaccctgtctcaaaaaaaaattaattaattaattaaaaagtatatatatttaataaaaaaaatcaggctatgtggtttctggttaggagtattatccaagtgtgacatggtgtctgtcacttcatttattaccagagttaatttgcctaagctgtttgagtcagtttccttaagcagcacatagagtcaagataatattcagactttattagctctgtgatattacataaataattttacttctctgggcctcatatttatctgtaaatgatgtattggattaaactaccttcatggtacttccataggggatctattcctgagaactgtattgatcatatattcagaagcacctactggatagccaggtactatacctggaatttaaaaattgctaaacaccccagctttcaagaaacattgtgtagctagggaagaccaaccagttatgaaaaccaaattagtcacaacctatttaaatgcctatatttattcttagaagaaaatcacaccgctggatccaagagccaggagagtggtggaataagggagcaacattcaatattaccactgagtttttactgcacatgccttcagtgctaggcagtagggctcataggatcaaagcacttctcacatgtagagagacaagtattcctgatctttagaactattttttctagtagtcatcttgtttaacatttagaattccaaacttggacagaaattttctcttaactatccacatttaaattatgttatactttcagatgaatatacttggaattttcttaccaaaagttctgcattttaaatgaaattacccatatttgaatatgaatgtataattatcttgttgaaagacattaaaagccagcatttatataaaagtgagtctagaacaggtttgttcttttttttctttaatcttgacactgaattttataatgaattatataaaattagagcattcgaattgtgcttaaaatttttagggaaactgttgatactggtaacaatgtggagtttcattcagccagtggtagagaaaatctgtcttcaccaatttatcccggtaaaggatattattaacaataaataacatttgtatataatgctgttgtttatgaacatttacctgtttgtgctaatctaggctttttgctatcccagtgccttttactcaccaatatgaatttgaaattctgctaaaatttcactttataaaacggatacaaggccgggtgcagtggctcatgcctgtaatcccagcactttgggaggttgaggcgggcggatcacttgaggtcaggagttcgagaccagcctggccaacatggtgagatcccgtctctactgaaaatacaacagttagctgggcctggtggcatgtgcctgtaatcccagctactcggaaggctgaggcaggaaaattgcttgaacctgggaggcagaggttgcagtgagctgagatggcaccactgtactccagcctgggtgacagtgagactccgtctcaaaaaaaaaaaaaatggttacagttctgttcagcatagattgaataaacacagtagagaaatgatggtcattttttaaactatgtagaaaaaagaataagagattttaaacttattattcatataaatattctactttgcactaatctgcttgtctctgatacaagaatgtgggaattttttttaaaaaaacgggccttattttaaattttgggaaaaaatttttccccccccccagttctaaatgcattgcgttgataatctgcctgttgttttttttttcaagttccaacctatttttatttaacctaaaactgtgctagttttatgtgatgctaataatttggttcaagtttcatagatttctgacagtagttacattattatgcagtggctttaaattttaattttttttcattctatattactgcttttatattgcaggattttttaacaaaaaagtatgttaatgaggaatctgttttatagaccttgtagtttaagttcttttttttttttttcgagacagagtctttctctgtcgcccaggctggagtgcagtggcatgcagtctctgctcactgcaagctctgtctcctgggttcacgccattctcctgcctcagcctcccgagtagctgggactacaggcgcctgccaccacccccggctaattttttgtatttttagtagagatgggttttcaccgtgttagccaggatggtctcaatctcctgacctcatgatccacccgcttcagcctcccaaagtgttgggattacaggcgtgagccactgcacccagcctaagttctcctttttaaagccttcccctgttcgaattccagtacagaataattccataacttcattaatcataacatgttggtataattcccaattttgactgtaaatactaatttaacttaactaaatgaaatctaatattgacagaaggtcagaggcctttgtgaaatagagtactcacaaatatagagagcagctttctgtgtaatgccagacactaggaaaactgcttcctttttatgtgtcaaacatttatcacgtggacttcctcactacagtcaagacagcagcaatctcatttcaaaaggcaaattaaaaagcaaaattcagatactgatttaagtgaataagaaaaaatgcaaacaaatgtttgatgtcctcatggattgttaacttctcagccagagattttgtgtcttacatataccagatatatttgataatcagtgcagttaataattagcggatcaccacatcatgtccttttgatgctttcatactgaggaaagaaacctaatgtagaaaccaaatgaatatgtcccagtgtacaaaacccagaactcaaaaccctttatatggagaagtagtttagattgattatttaatataaataggatcccagaaggaagtatacccagtcatagctggaagtgaagatcagaattcaaaacctatatttggtctccaagtagagagaaaaaaaagataagagagaagttgaaaatactagaacattgatgggaaatttagtttttggttttgttttgtttgagatggagtctcgctctgtcaccaggctggagtgcagtggcatcatctcagctcactgcaacctccgcctcctgggttcaagcgattctcgtgcctcagcctcccgagtagctgggattacaggcacaagccaccacacccagctaatttgtgtatttttattagagacgggtttcaccatgttggccaggatggtctcgatctcctgaccttgtgatccacctgcctcagtctcccaaagtgctgggattacaggcatgagccactgcgcttggccgggaaatcctagtttttaaaagtgcgaatcactaaatttttttaatgtcccagctgttttgctgttttggaaagcattataccagccaaacaacacatctgtgggcagctgtcctatgcacccccatatttacctatgttacccagcatgtttctgagtaactaaatctatttctgaaggttcagtatattttgagttgaataaatggtattggttctttttttatatatattttttgataatataatttttaacactaagagttgttttcctcattagtatcctgattcctaaagcactgttgttgaatttgatacagaaatgtaaaatattgtatctgagcactttgaaaaatgtctcttaaaagcttcagtcatcctgtaaaaaaatgttcaaatagaggtgcctaagaatataaagtgatttgttagtttgagaacagaattgaaattatacgaaaaaatatacattttatttaagtttataattgaagcacatttactaaagcctcttagggaactgattgaggtgacctaattcttaactaattgaagtaccagaaaagaatttgtccttcattttgtttaagatataacttcttaagtaattttattttattatccaatgctgagatttatttgaactagaaattagtactgtgccagagtgagagtgctcctgaaagccaggtctttctatatctactgttgcaaggtggttataggccagcgtgtgctgcagtgtcttcttttataaactgggctaaaaaacttgaggtttaggaagattaattagatgataattgtacagcacctgtgggagttctgttaccttttaagcgcgatgcaaggtgcaccagttttattgcagtagaagggaggaaacgtctcggtgacttgttttaaattaggccaggtaaagttatataccccagtgaagaagctcttacttgttagtggtttttttctttttaaaattatgaaatatttcaggcacacaaaatacagagaacctgaagtatattttatatgttttgaaagtcttaaatatcacatacttacataatacttaaatatgtggtgttatatgttgtgcaacgtgccttttttgggggggtcagcaattatgtttcttaggcttatctaaaaatcagcagtgctagtactttttttttttaatttttattttttaaaagagataggatcttgctatgttgcccaggctggtctggaactcctgggcttgagcagtcctcctgcctctgcctcccaaagtgctgagagtataggcacgagccactgggcctggtcactagttgaatctttttagcagtattatatgaatctataataatttatttcgaattttttttttgttgctgacaatgtagtgtatattcttggacatatttccttacatattcaaaagtttatccaggatttatacctaggaatggaattgctaggtcataagataaatgtatgtcagaggtgtccaatcttttggctttcctgggccacattggaagaagaattgtcttgagccacacataaaatacactaacaatagttgatgagctgggaaaaaaaatcacaaaaaaagtcataatggtttaagaaagtttgtgaatttctgttgggccacattcaaatctgtcctgggccacacacggccatgggccacgggttggacaagcttgatgtatgtttattagatactgccaaattgttctccaaagcagttggacctaaatttctgtcaattgagtggaagttcccaagttccctttgttacacactttttctagcacttggtgttagacattcttttattgcctggtagacaggaactcagttgatttcttccccaccctccatatcaaaatataatttacatggaataaaactcctgcattttatgtgtacaatttgattgaatttatggtaattgtataaagtcatatatccaccccaacaatcaagatacgaaagatttccatcacccaagtaattagtttcctcatgcctgtttgtagtcagtctccccttccccagccagtaagctgcttttgtcattatggttttgccttttctagaatttgataaagatgtgatcatatagtgagtaatcttttgtgctaaacttctttcacttagcatgtttttgagattcagtcccgctggtgtgtgttattttgttcctttttattgctatctatttcatggtatgaatataccacaatttattcatcagttgatggatatttgggttgtttctagtttggggctagtatataaataatgatgctgtaaatattcatgactaaatttttgactcagttgatttttgattattgatctttaaaaatcttgccaccctctaattagtttaaataatttgactttcttagattttctacatagacagattatttacaaataataacagttttttcttttttctaatacctaatctttttattgtttgtgtacttgctgtaggatctctagtacagtgttcagtggaaacagtcaattttagtgggcattcctgtattcctcaattaaaagggtatggtgaagtattaaagtttcaccattaagtatgaggctttctataggcttttgattattagccttactgatgttaaagaatttcaccctttgctagtttgcaaagatttttttttaatggaagttgaattttgtcaaatacattttctgtatattttgagatagtcatggggtttttcttcttaaatctcacgtggctttttctttaagtaaagcttactctttgaagtgttaaaatttaatcactctaaaaacacttttaataaatctcttagattaaaaacttttaaatcttgagcatactttaatcccttctccatgactcggattgtattatggaacatcatttatctatcatacgtgatgttaattcttgactataaatcgctcaaagtacgagccatgtcttaatcacatttgatttcccacaggatctagcacagtatattgcaaatagcaagccttacttaataaatgctgaactaggctactgctcttgctaaatagccacagtttgttttacgttatgaattatgttgcatctctcccttcccttattatcacgctggctgctggtataacttttatgaatcataaaaaattaaataaccaggctttttaaaaaaatagatctaagttggccgggtacggtggctcaagcctgtaatccgagcactttgggaggccgaggcgggtgaatcacgaggtcaggagattgagaccatcctggctacacggtgaaaccctgtctctactaaaaatacaaaaaattagccgggtgtggtggcgggcgcctgtagtctcagctactcgggagacagaggcagaagaatggtgtgaacccaggaggcggagctttcagtgagctgagatcgcgccactgcactccagcctgggcaacagagcgagactccatctcaaaaaaaaaaaaaagatctaagttttattcactcatcaaatatatgagtgccagctaatgccaagcctaagcttggcttggagctaccagtaatgcaaaatgaatatgaatggatacttaaaagatcttatagcctagtagagagagataagatctttatgtgaattattctcatgaaagaaaagtgataattaggaatttagagaacaaagattagatagactttgaagattaaacagctcttctatgaagtacatgatggtggtgcataggtttggggtctataatttggctgaccaaagactcttgtttatttcctgattcttaagccacgtttcacgttgttgaggtgctgaataaattgacctgtggataagtgaagtatttgtaagtgaaattcctcaagaaattgaattttaaaaaaatattcaatagtgctgagaagtgatttttgaatgaacatgagaagtcaaactctagcatggtttacaaaggtcttttgtgacctgcaccagcttcttgtccatcatttctcatactcatctccaccatattgggcactccagccaaagcacatgtggctcttggaaatgtcatgcattttagctccataaattttgaaaaatcattgccatatataaaatttcctttaactctatcttctgctgaggtaatgagtatttgtcctttaacattccactaaagtattttctcccttgggaagtcttcctgaaactcatcccctcttatgtgctctctgtgcattttcctattagagtttgtatcatatttattttctttttgtatatttatctgttttccggactgatctaacaggtctctttcttggcagagcatacatttccagtgcctagcacagctcttggcacatagtagacatttataatttattctcaaaatgattgttgaacagttaaaaatgatatattacaatgccttgaaacttgtcatcaatttgccagttggggctgcgtattcttttacagatgtctgcctgtgctgtttggctattcatttatgtactattggaagagaaagcctgccaaatggggtgggtgtgtgcgcacatttggctgtcccagcagctgataccaaatgttggaaataactatttccatctgtcattttcatcccccccactctccttccactctaaaattaattatgttaggaatgatttcttacctccttagatatttatgtcagacaagggctcaagcaaaagatgtatacttcgtcattaaagtttcataataccttatgactccatggaattcttgtagctttcttttcacagctgggatatcttacatggcttgctaaattcttcagacttattctcattacatacttttcttccttgcaatacgctcattgtctttcacacatagtatattgacaagtgctacagaaaccatgacattctcatagcaatgcactgattcttagaatacacattgtttgttgttcagtgttaaattctatgtttgaaatctcaacctaggaacacactgtatcgtatcacattgttcttggttgcttcaacatctgggattagacctttttcagttgtatcatgttaaagttcctcattttagaattaaaaacatataatcttaggtttcattcgtaactgaattcttgcttcaaccaaatctatgttctaataccggggtccccaaccgccaggccacagaccagtaccggaactggtcttggctaggaacttggctgcacagtgagcattgctgcctgagctccgcctcctctcagatcagcgggggcattagattctcttaggagcgcaaaccctattgtgaactgtgcatgttagggatctaggttgtgcgctccttatgagaatctaatgcctggtgatcttctgaggtggaacggtttcaccccgaaaccatatcccaacacccctcagtctgtctgtggaaaaattgtcttccacaaaactggtccctggtgccaaaaaaggttgtgtagtgctgttccaatgaccgatcctgtttttgtgcatcattcatagtttttctttgtaattttatatcctattatataggtttaggtgaagtctgctttctgccttaagcctactccatagtgggttttccaagtaaaggacagagtcatgtacttcaaagaggctgttcatgtatactatgaatttttgcagtctttactatttattgagtgactacttatttaagtatctttgttttcttagctctttgcacatgaacttgggtacaaatcagaaatttgctgtaattctaaagtgacagattagagggatcaggttagaagggcacagggagggaatatctaggaattatgaatgtcatgaccccaaataatgttctaatgctaaattgttttcttaagtggatagaaatgaaaattttataaaattctgtgctagttttgtttcttgaatttatcagtaaatttttatcattgaatatgttctcatttttttctactgcttctatctttaaaagaaagtgaagaattttatcagaccatggtttagggtagagcagtggcataataggattatgtatttctatgtatataattttgtcctattttttgaaattctaattgtttaaataattttagtatcattgtttgttcttttccttattttcctgtaattttttcttgtggatggtttagaatagttttatacctggtatgaaatataaaccacctgtagcaggcctaacacataatttcataaatgatcagatagagagatgccctggatttataatgtacaaggctcatcatcatattatgtgactaagttgtagcataacctcttctaaattattaaattatagaatatatcaccaaaagttgtgcatggaaagtaaaaattatggagtgtatcattgcttgaggcagggttagcaggtagggtgttgagattagaagtagacaactctcctagagaccaatgtcccagtccaagaaccattaagatgagccctggagctaccacttaatcattcctgggttgattttgatgagagacacaactcctttggtctttgtgtcttcatttattaaaatgataatcattaaggtttttctagtcctgagccttctgttattctgtctggagataagatatttaactgtctttttcatattttaggacccagatgatgtggtaccagttggccaaagaagagcctggtgttggtgcatgtgctttggactagcatttatgcttgcaggtgttattctaggaggagcatacttgtacaaatattttgcacttcaagtaagtggaaaaattattttgtgtctctgatttttttttttttttgcctctcccgatgtgcattacaaaattgtttacaacttgcgctaagcttgtactttttatctgtgaccttcagccagagtggtagttctattttaaagctgtgtttaaacatctctccatgatatgtttgctgagcccatcacacacagtcactaaaagcagagtaacttgaaatgttggtgactaagggatttatttaggtcattgggtgattttactaacctttattttcctactataattaagggttgagaggaatagtattatcaattgccagttgaataaatacatcagccacaaatgttttcatgttgataggccataacttgatagtcagcttggactcccctatggtcctgctgtacccttgggcccagaatacagtaagaccatgtctctgcttcttttccagtcatggtttcactaaagaactgggtgacttcagcagtgatattgaaataacataggatgaaagttgtttataactttgagtgtttaatagtaatcccagtgggttaagacaaaggtcttccttgtgattgattataatttacaatctattttgtaatatatttctcttggcaataatacacaatttttttttttaggagttttgaaggggaaattactttcaaggttttatgactacttcagctgtttcaaaatttggagaaacagttgacaactagacttattaaaataatttaactaattttgaaacattctcaatttcatgctcattttctgtgttgttcaagataatcaatcacatgttgatagacattaccaaaatactagtcatctttttaaatacagttttatttacaagaaatacatatagtatagaaaaaatcatcgcaattccattttccagagataacatttggtgcattaacttttttttttttcttgagacagagtttctctcttgttgcccagactggagtccaatggcgcgatctcggctcactgcaccctctgtctcccgggttcaggcaattctcctgcctcagcctcccaagtagctgagattacaggcacctgccaccactcctggctaatttttgtacttttagtagagacagggtttcatcatgttggccaggctggtctcaaactcctgacctcaggcgatccacccaccttggcctcccaaagtgctaggattacaggcgtgacacaccatgcctggccctgtgcattcacattttgtatacccttagtctttattgtgtgtgtagtgtgtgtagtgtgtgtgtgtgtgtgcgcgcgcgcgtgtgcgtgcgcgcacgtgtacatgtactgtgtgtttggctttttttgagatggggtctcactctgtcatccaggctggagtgcggtggtgcaatcacagctcactgtagcctcaacctcttgggctcaggcaatcctcccgcctcaacctccccaggagtagctgggactacaggtgcgtggcaccatacccagctaatttttttattttttgtggagacagggtctcaccatgttgcccaggctggtcttgaactcctgggctcaagcagtccatctgtctcaggcctcctccccacaaagtattaggattacaggcatgagttactgcacccgaccttatgtactgttttttctttttgtaaaagtgagacagtagcataaagatttgctgtaatctaatattttccactgaattgtgatataaagggaaaagtagaactacgtatatgcatatagaaatttcagaaaaattatcccttttttggctaataagaaaaaagtcatttaattagtagaccatatcaaaactttttaatatattctttcagaaaaacttgactagttttggaatgtattcttctataaaaactgcttacaggtagagtaggtctgttgtttctttatatttatttgttactggatagctaattatttttatgttctattttcacctaccaggaaaagtaaagggaaaaccagctgcctttcttctgaagctgttcttttacagtgcttcaaaacctgatcttaaagaatatgttaactctgtaattaaactgtctgacttgtcatctaaaagcaagagtttgcaagcaaaatgctatttagatagaggtggcagcttaagtaatgcttatttaaaaacctgtctcatgctgaattgctgaaatgagtctttaaactctctatagccagatgacgtgtactactgtggaataaagtacatcaaagatgatgtcatcttaaatgagccctctgcagatgccccagctgctctctaccagacaattgaagaaaatattaaaatctttgaagaagaagaagttgaatttatcagtgtgcctgtcccagagtttgcagatagtgatcctgccaacattgttcatgactttaacaaggtgagccaagtgtccagaattgtagaaagaatgcaggttctgtagtttatgctttttgtagttttaatttcaatatttgctcatttattatatttagagtttagtttaataaactgtcagcatttggtgggctctgctatgtctgaagcagaccctgctgatgcagccttctcatatcttatctctccttccccttgccttacctactcttaaagcccacctcatgactgttcctcctttgctggcaaactaatattttttatatgttcccacattttcttagataagaggtaatttatgttcctgtttcttggtagcattttcaaaatcaataattttgttaatctgtttttaagttctcattctatatttttccccagcttttgagcatttttatgtaatgcagaaaagttgaatacccaaaatcctccactttgttccaaatattgccatatttgcttcatctctttttctgtcatttgacataagtacttatgctattatctctcaagaatgagttgtcctcctacgtaaccacataattatcacatctaagaaaattaacatgatcttataggacagtagtccccccttatccgtgggggatacatgccaagacccccagtggatgtctgaaactgcatatagtaccaaaccctgtatatactatgttttttcctgttagtgtacatatatacatatgttaaaatttaatttacaaattagccacagtaatagattaacgacaataataataaaacagttataacaaaatactataataaaagttatgtgaaggtggtttctcaaaatattttattatgctgtactcacctaggtatttgtggactgtagttaactaaaggtaactgaaactcgagaagcacaacctcagataagagggactactgtatttaatatgtttacatttctgtttatgtttacatttccccaatttttgtcccaagaattttttgttttttcaaatcaggattcagagattcagaagttcatgtatcacctgtgatttttatgtctctctgtaagcttgccattttgaacactcgaatatattactgaagttagctttgcaaacatttcgtgcctgataaatacatctgatggatgtttataaaccagtttgaaaatttacttatttcaaggaaataaacttccaaagcaaatagtaaataataatagttaacacttactgagctcttaggaatcaaaatgttgacattatttgatttaagttattcttaaaaaccgttctatgagacagtctttctcaaccagcgtttctcatttgaaccacagaacacaaaatcatttaaatgactgtttttctaatgttctaaggatggtagtattcaagatacatatgagaaaatttaatctttacaaacaatggacagataaccttagagggcatttgagcttataagtggggaagttaaattgcttaattatataataagtatttgcagttaatttgaataggtattattacttattatagaaatataccctcgatgagcattttatttactggtagcaatattttttcctctcccattcccacttccaactttatccagccaaattctgaatttgttgaaatgcaagtgatttatacattctaaagccaattcattttaatgatacaaattattcttaaaaatccagttgctgcctgtttttgcaagtattactgtaactacactgtatctttttcttcccagaaacttacagcctatttagatcttaacctggataagtgctatgtgatccctctgaacacttccattgttatgccacccagaaacctactggagttacttattaacatcaaggtataagaatgttgactgtttttgatgaatgatgccttcatagtgttctggaattccctgttgagaaattagccctataggagcccattttatcagactgtagttaagaattttacaaagaggaactaatactcatggtttttgtttttaatgttttatatcttgaaattgaaataaatttctcaaataatgttttaagttttcctaaagagccagggagtaaatattagccaactacttaattctggtgccatagacaatacgtaaaacagatgaacatgactatattccaaaaaaaattctacttataaaaacaagccgggggcggtggctcatgcctgtaatcccaggactttgggagacctaggtgggaggatcgcttgaggccaggaatttgagaccagcctggacaacatagtgagaacataaacaaacagatggtgggtagtagtttggcaacctgttccataccataatgtgtaagaattttgtcttgtttctctagtctactcagtgtatgttctgagatagtcatgtcatgtattcttttctgaatgtaggctggaacctatttgcctcagtcctatctgattcatgagcacatggttattactgatcgcattgaaaacattgatcacctgggtttctttatttatcgactgtgtcatgacaaggaaacttacaaactgcaacgcagagaaactattaaaggtaatactttttaaatattaaagtgttgggcagaaaagttcattgcattaaactagatttaggtgaagcctagtcattgttaccaatatacctgccatgagtgaggtaatattgtgtcgttatataatatttccaggtttctatagaattatcttaattccatttagtaagtccactcttttcaggtggagagaaaaggtcaatgtgaaatgtcattgccttgagatgatggtacctcattttccatctagttagtcaccctgtccaacttcccatcctaccactttggttgagccatactgaaagggtttttattatccagagggtgtcttgggaccagctcttcagctgtgttttcagggatctggattctaagcaggctgtttgccttttggatcatattgggaataatcactgtcagggtagttggaaaggaatttgggtgaagaactaagagcattgatacaactaatgttgtagctttgccaaatcatttaacttttattttctcacctgaaatataagaattacagtatctccccatttccttttaagagcattgtgaaaataaaaagaaagtacatgtggcagctgtggaaagtaagaagtgccattcagatacactgtggtgtgatttctttggaattgtgtcacccagtaaaagtgctttcctggctttttgctagcattttaaataatactgttctctcatctccggcggttgagtcatctgaaaccagcttgatttctttttttttttttttttccaacttttattttagattcaggggtacatgtgcaggtttgttacaaagggtatattatctgatgtgaggtttggggtacagatgatcccatcactcaggtagtgagcaaagtacccaataggtagtttttcttttcttttcttttttttattatactttaagttctgagttacatgtgtacaatatgcaggtttgttacataggtatacaggtgccatggtggtttgctgcacccatcaacctgtcaccaaattaggtatttctcctaatgttatccctcccctaggcccccacctcccgacaggccccagtgtgtgatgttcccctctctgtgtccatgtgttcttattgttcacctcccacttatgagtgagaagatgcagtgtttggttttctgatcttgtgatagtttgctgagaatgatggtttccagcttcatccacgtccctgcaaaggacatgaactcatccttttttatggctgcataaaattccatggtgcatatgtgccacattttcttaatccagtctatctttgatggacatttgggttggttccaagtttgctattgtgagtagtgccacagtaaacgtacatgtgcatgtgtctttatagcagcatgatttataatcctttgtgtatatgcccagtaatgggattgctgggtcaaatggtatttctggttctagatccttgaggaattgccacactctcttccacaatggttgaactaatttacactcccaccaacagtgtaaaagcgttccccaataggtagtttttcaacccttacctcctccctccctccctcccttccttatagtcctcagtatgtatcattcccatctttatgtcagtgagttcccagtgtttagctcctatttataagtgagagcattgtaaggtaggtatttggttttctgtttctgtgttaattcatttatgataatggcctccagctgtatccatactgctgcaaaggacatgatttcttttttattgctgtgttgatttcttacattttaaaattctcttggttcataattttttttaaagtcagccttacacgtgccatgaaatttaccctttttagtgtgcaactctgagtttccacaaagatacacaaggtcttgcaagcaccaccatagtcaagatacagaacattttcaataccttcaagttcatgaatttgtaagcagtctggatagcattattaatgttgctgtgatctgtcaagatattaatacttggttcagaaaagggagaaaaattacttttcttcagtgtaaacattcaaactgtagaagtttttgtggaatatagagtgaaatacttctatatgtctaaataataactataaaaatgatgtgaatatttattattaaagaatcaaaattttaaaaaacttttttccctctccaacaggtattcagaaacgtgaagccagcaattgtttcgcaattcggcattttgaaaacaaatttgccgtggaaactttaatttgttcttgaacagtcaagaaaaacattattgaggaaaattaatatcacagcataaccccaccctttacattttgtgcagtgattattttttaaagtcttctttcatgtaagtagcaaacagggctttactatcttttcatctcattaattcaattaaaaccattaccttaaaatttttttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagttgtttaactagactgcgtgttgtttttcccgtataataaaaccaaagaatagtttggttcttcaaatcttaagagaatccacataaaagaagaaactattttttaaaaattcacttctatatatacaatgagtaaaatcacagattttttctttaaataaaaataagtcattttaataactaaaccagattctttgtggatactattaaagtaacatttaagcctcaaccttgaatgatgttgtttaatataaaatgcttttatttttgatggaaaggcaatcaaagcctaaagtttccaaggaacgtaaaataactgtgcttctctgagaatgcccgcctcacaagtggaacattttgagttaataatgatgatttttatgtttctaaggttgcttcctctctgaaataattcagaatccacccccatttaataaaatacctatgattcatttcacctcaagttcctaagacaaaaaatttcaattctgactttaggaggtcagagtttttaaagcttccaactcttaaaggatttagtctagaaaccaattctaattcaaaaggatattatttactcatggcttttcatttcatttcagtaatattgtcagaactttaagtcagtgagttgggtattcaggaattaacaattttagaagacaatatgtttcaataaaatgagaattggtttttcctactttccaggctctaaaattacatgaattttcagggagctgtgaacatttaggagcacattattcattcagcatcttttatatgcccaacatatgatattgtgttgaagatatatctgcaaagaagaaaaaaagccactgccgtcgtggagactcacaatctaggaaaagagagggacagcaaacaactcattacaatacattgggatcagtagtgtgagggagaaaaacaggtctaggttctttggaaaacatttaggagagtcaatgagactttcagaatgtgaagtgcatgggattaggtcatggaagaagaccatgtatgtcatcttgaggacttcattctgtagaccatgggccactattgaagttttgcattttggaaggagcttattagtttgttttcctgttgattatagtagtaatgcagtatcagggtagctgaactgcaataataatcccaacatctcactggcttcatgcagtaggaatatgctttcatcacagtccagtatggcaggcaacctccagactcccagggacccaaacttacactttactaaatgtaattctttcatttgaatttttaaaggtttttgtataatcatcttagtaaaacatttgataattcttcacaacatttgcaatcattgatttggccagattggtctaacatggtacccatgattttacttcatttccagtactattctgataatttcctttagagtcaattgagtagagagtacccctctcacctaagcttagtcatgtcccaggaattttggaactccaactgagatttcaggctcattattcattctagggctgaatgaataatgtgccctttgaacccttgtgccatgctggaaactgtggtcttggtgtggcatggaaaaaccagagggtgagggatgtggatgagaagatgacagagaatcagacatgcagagaggactgccaggtctcccagtgggttccagggagactcagctatccttccctcttcttgagttctgtcttagtccattcgggctactataacaaaataccatagactgagtggctttaaacaacagaagcttgtttctcacagttccagaagctggaaagttcaagatcaagtcacctgcagattcagtgtctgatgaggtcctccttcctcacagaaagctctcttctctctgtgaccttatatcacagatgactctgggttcctcttacaaggacactagttccattcatgggggttccactctcatgacctaacacctctcaaaggccccatttcctaatactgtcaccttgggggtaaggatttcaacatgaattctggggggacacaaacattcaaaccatagcaagttccataatgcaccccatcatatgtgtgtgtgtgtgtatttatttatttatctaagatagctctagtttgctgctttgcaacacattctgcccctattgcattggtttaaaaaaaaagtacagaagtcaagatgagactatataaatcttgacaagttgttggccgtgatt

SEQ ID NO: 15678 - DNA, 10333 bp, Human
cgaagacataggctggagcctcagcctcggcttccagagctcaggcctgggagcggggatggtatgggggatggaaaggggaattgtgtctccaggaagaggaggaagatgtttgctagatcaaaagttcgaagtgcccaccacttaacctcccacattcccaccccatcaggtctgcggacctcccctactgcccttctctcaatgattcggattttgtaacggggtttgcaatttgcttccggttgtatttctcaggaagtccgatgacactcggctgtccaggccaggcgctggaagtcccccaggaggaccagctcggtctcccacctcttgagtgcacagctccttggcccctgagtaccccaccacccccattttcagccttcttccttacaaacacgaagggtgggaggaaccagaaaacaggggatcccgcagccctaggctagttctgatcgctttcaggtgtctgcagaggcaagttgctggttgtcacctgtaaaatggggaggataaaaacacctcccagattttgttctagatcctagggggatgtgaggctcaagggagataaaggacactggcgagcaccctagaaatgacaggatgaaggcgatggtgacaaatatccgagcgaaacgcttgacaatgagaacagacaagtgcaggtctccaggagtgccgcgagcgcccgcgggttctgagagcgctcaaagccgccgagtcaggctgcccagcccgccgggcctcgccgcagtgatcctcattcccgaatctggcagcgctgtcaaaggcttgtataggaggtgaacggcggccgcaggcccactccacgcggttgctgaaaccgagctgggcgcgcgcgggggccgaatctcgccgcctccgcgctcctgtcggggcagctcccgatcccgggctgcgcggcttcggtccccaagacggccacttccagccctaggccccttggccgcagcgcttcccaaaccaagagagatcctttctcaactcagagcttttcattagcagtcgttaataatggccctgagttgccttatcatctcctggaaatgagaaataaatttcttcggagaacgtttccctttgtaaaggacagagagttttaaagatacaggtatgatgtaagacacataaatacctaggtaagcattagcagaaattctcttttccttatatttaagtataataaacatacaagtgtagctcaatgaattttcacaaactgacattctgtgtaaccagcagcctaagaaactgctttaccaacgatcccctagctcgcctccagttatgcacgccaataaccactagcctaacttctaccacatgcccattacttctgtagtttaaaacttctgattcttgaatgtaaacgtttaacaataaatcgcttgaatttaactcaaatttcaaatgtaagatgaagtcagagatgcagcctgaatctaggatcataatttgtcttgtgcggagggcgagtaatttccttgggcaagaaaataactggaggtgacagttgtttggggctgcagtcgtccgggccaggagcacagggcgggaaggaatggcccatctcttagggctctctgcttgtcacctaccaggttggtcagaaacgttctcatcaaagcaatggttctcttttcttttctctttgggacagaaggagtttcttgaccgccctcttccctgcaaatgcataaacaaccactgctcctgtctccaagctcagattcctaccaagatagccttttctcttcccctctcttttgtaagtctcttgatttcattctttgaacctgtgattggaggttaaagtgcaccaggttggaaggaggaagctcttaacaataaaggtttgaatatttagctgtgtcaggtcgctgccctctcacgagcctccctcccctttatcttttaaaatgcaaattatgtttcgaggggttgtgcgtagagtgcgcgctgcgcctcgacgtctccaaccattggtgtctgtgtcattactaatagagtcttgtaaacactcgttaatcacggaaggccgccggcctggggctccgcacgccagcctgtggcgggtcttccccgcctctgcagcctagtgggaaggaggtgggaggaaagaaggaagaaagggagggagggaggaggcaggccagagggagggaccgcctcggaggcagaagagccgcgaggagccagcggagcaccgcgggctggggcgcagccacccgccgctcctcgagtcccctcgcccctttcccttcgtgccccccggcagcctccagcgtcggtccccaggcagcatggtgaggtctgctcccggaccctcgccaccatgtacgtgagctacctcctggacaaggacgtgagcatgtaccctagctccgtgcgccactctggcggcctcaacctggcgccgcagaacttcgtcagccccccgcagtacccggactacggcggttaccacgtggcggccgcagctgcagcggcagcgaacttggacagcgcgcagtccccggggccatcctggccggcagcgtatggcgccccactccgggaggactggaatggctacgcgcccggaggcgccgcggccgccgccaacgccgtggctcacggcctcaacggtggctccccggccgcagccatgggctacagcagccccgcagactaccatccgcaccaccacccgcatcaccacccgcaccacccggccgccgcgccttcctgcgcttctgggctgctgcaaacgctcaaccccggccctcctgggcccgccgccaccgctgccgccgagcagctgtctcccggcggccagcggcggaacctgtgcgagtggatgcggaagccggcgcagcagtccctcggcagccaaggtaagcagaggctgcgccccttcggagggtgcttgggaaggcgcgggtcgagccagtggctgctgcgcgtcgcgcgtccagtgcgcacaggggcgtcccgggctgtctgggagctcggcgccaggaggggcacggcccggagacaaattcgggggcctctggcccgtcggggcttctctgacctactgagcctgggagtgaatattctgagtctcaacaccgtgttcaggcgtcctctttccaagagctcctcattcgcaaccccgggacaccttcgggaagctccggggaatgtcggcgtgagcactgctggacgccggcagaatcgcgtcctccggcacttgctgcggcatgcattccttgcgtggctcctggccgccgaggagagagggaggctcgaaccttcttgggctaggtctaggccatttatctccgctctctctttccccatctgagccatctaagaagagaagtgacctgggggggtcggaggatggctaggctgtgtgtgggaccgggtttggccactcgggccaattcaaggtacagcgagcaggcagaccagggagagctgctgtcgctgggaagaaggtgctagccccagctgctaaggcgacgggggcgcgccccgtctctgaacctctgacctgtgaaggggtcatttcaagcaaaagctggaaggctaggggcaagaagcctaggggcaggcgtctgcggagagagcagggagacggggaggaaaccctggtgggaattaagccgccgctccaggtaggggtcatttctcccaaagcttcctttcaagggtgtcagggatgtctgtgagtgtgtgtgtgcaactgaaaaagatcctaggtttgccggactgtggggctcattgactctgggtctgccccttctggtgttcgagtgtgcctagaggtggcaaggaagtgcggtggggagagtcctagttgagtgccccttttaaagtctttccccagccctcagcgcttccgcttttcttgcttcgctccttgctgccccaattgggcaggcacgctggttatgggcactttgcagaagtttatagccaattacaactgtataaatcaaagcgccctttgggggctgtctctgggcatcggtttctgcgtcactgtgcacatgctagggagagtcctggtgggaatgccgccgaccggggagaaggccacagatcagcctcgggtgagcctcagagctttggcttggtcccttctcctagaggaggcgcctttctcctagcaggggctcccagatcctggctcccaaagacccactttctacagcccctgtctggggcgcggttggcgggggtggcgcacgccctaaggaagacctttgcgtgtcccgggagagcggccgcggggtgagggccgggaagggggcgggagggaagccgccagagcccaggccgcggggtcagcagatgagaggccgctgtgaagtcctgcaccgaggtggcaaggccgcagtcggcgccgggtgcccttgtgatgttaatgtggggtggccgcagcccgcgggccggagccgggctcctctgcggagcgtcatctgtcaaggtgtgggggtggagggggggacgcggcctggcttgctttgatatacaccttcccagccctgccattgtctcttttagggcccggaaagagggtggtgactttcgcagtcaataatgaattctgacaagtccctctcatccctcccctccatagccccgctcctaggttcccagggggtgtggggcgcctccaaggcccttggggcatgggtcgaagagcgctcagggtctggtcatcgcgttgcccggcacgtccgggacactgaaggggcagcacccgagcaagggtctctccgagacacttccaggcgagtctccctcccggggtgttcggctgagggaactgccctgcgcctcagctccggaggtgtcctctgtggctccagccaggctccggtgccaaccccgcctgatactatctgcgtgacccggtctgattctccatttcctcatctgtaaaaaggggcgagtaccaatggcagcctggagtgggtttgaggcggtcacgcgtgtccgagcgtccaccgcggagaaagtcgcgttagttccctttactttcatagcaggcgcggggtcggggccgcagccccattcaaatgcgcctgcagggtcgtgtttatgttaatgcgcctggcggggagggggatgaaagccggggccgccatttgctcagtagtggtaattcaaacagaatgtggttgttattaaggcattgaaagggcttttctttgataagatcgccttgtcctgcattgtttgcggctgtgttcgcctttcagcggctcgggggagctccctctgatcaggcctgtatcttcccaggacgcttttgttgtggtttgcaaagggttttacctgaacaaagtcagcctgcggggcattaaacacctccaggcaactcccaggcccttcagatctttctgtgggattgggcactgggcgattgaacctgttcagctgcaagaagacccaaaagtgggacggagccagagagaacagcttctggccagggctctgccaagggctgagccaagacagacctggtggagacgccaggctcgggcctgctccaacattgtggacactatttgtcaaggcccttcagtaaaacaatcaatctgggatttaatatgttgactcaatccaatgagcatagatcactggtcaggataactctggccggatttgcagcaggaataaatggaggatcaaaaaagaaaaagtaccaaacgccaaacctggtctgggcaggtataaagtgtccccagcaggaggggttttctgcctgttccctcggccagagcccagctcagaattccacctgatgggcctggtgtgtctgggggatgattctggcgacttgtcagctcctgagccccgctttccacttgtagtaaagcaaagtagtaacccccacaccccctctacaacatgtgcccacaatgacagctgttttcggggtgggcttccatctctggtaggcctggaaatctggatgcttccaggatcccggccacttcaccctgccccctttcccttggtgtcaaatatatgccagtactgtatttggtttaccgaaagggtggttacattctgctgtcttctgtgtgaatgaggttttcactttccttaatttttaaaaaccacttaataccaaggttagtttagttgcctccactagcctcataccctccccccacaggaccctctggggggtcttgtcagacttggcaggaaccagccaaacccgggccccccagggtggtggaggaagagaaatgtccctgggttagggaggtttgtcattacccatgactgatgggctgccttgttgttctcagccctcacttctccttcctccacagtgaaaaccaggacgaaagacaaatatcgagtggtgtacacggaccaccagcggctggagctggagaaggagtttcactacagtcgctacatcaccatccggaggaaagccgagctagccgccacgctggggctctctgagaggcaggtggggaccgcctagctccctccgggcgggccactgcctggcagaggaccatgagagttagaaaatctggctgcaggggccatctaaatctgtggagagactgaagcaggaggatgcaagcattcgtctttggagtccttttttttttttttttttttaaacagagatggggtcttgctttgtggcccaggctggagtgtagtggcacaatcatagctcactgcagccctgacttcctgagctgaagggatcctcctgcctcagtcacctgagtagcttggactacaggctcgagccaccatgactggctaatgtttaaattttttgcagagatggtctcactgtcttacccaggttggtctcaaactccaaatgctcctcctgtcttggactcctaaagtgctgagattaccggtgtgaaccaccatgcctggcctggagtacatgcccccccacccgccaccgtcgaaacgcagtttcactcttgttgtgcaggctgaagtgcaatggcgcggtctcagctcactgcaacctctgcctcccgggttcaagcgattctcctgcttcagcctcccaaatagctgggactacaggcatgtgccaccacgcccggctaattttgtatttttagtagaaatgcggtttctccatgttagtcaggctagtctcgaactcctggcctcaggtgatccacccgcctcggcctcccaaagtgctgagattacaggtgtgagccactgtgcctggccctggagtacttttttaaaaagcctccttctacctttagtcctctttttttgatgttgttgattttttctgtctctctcttttgagggatataagaagtgtgaaaaacagccaagggtattagtttaatccagaattccatttgggtctataaagacatattaaagacctattctctttgtttccagcactgtacctaagaaaataaactgaataaagtactcagtctctcacaaaaactagagggacaagacttggttcatgaacattttatatatatagtctagaaaaacaggccaacttcacagccaggaagccacacaattaaatctcattttcagctctaaggtgaggaaaattacgttttagtttagccttgaggggccaaaggttgccatttgaagtataccacccagcactggcctccctttgctgtgtagaaagggccttgcagtttcagttttccttggttctgagactttaaacttttgcagtaaatacgtagataaaagttgctttgaaaagaaactcagggagcaaggaaggaggaagactcttccccatgaggctgaattgggcctaagaatggatccagggttgggctgttatggggatgcccgaggaaagcttctagaaggacttggagttctgtagctggagcagaagatgttgatgatactgctgggtactgttcctcttttccctcacatcttcaccaccatgtgcttttctccacctttccatttctaggttaaaatctggtttcagaaccgcagagcaaaggagaggaaaatcaacaagaagaagttgcagcagcaacagcagcagcagccaccacagccgcctccgccgccaccacagcctccccagcctcagccaggtcctctgagaagtgtcccagagcccttgagtccggtgtcttccctgcaagcctcagtgtctggctctgtccctggggttctggggccaactgggggggtgctaaaccccaccgtcacccagtgacccaccggggtctgcagcggcagagcaattccaggctgagccatgaggagcgtggactctgctagactcctcaggagagacccctcccctcccacccacagccatagacctacagacctggctctcagaggaaaaatgggagccaggagtaagacaagtgggatttggggcctcaagaaatatactctcccagatttttactttttcccatctggctttttctgccactgaggagacagaaagcctccgctgggcttcattccggactggcagaagcattgcctggactgaccacaccaaccaggccttcatcctcctccccagctcttctcttcctagatctgcaggctacacctctggctagagccgaggggagagagggactcaagggaaaggcaagcttgaggccaagatggctgctgcctgctcatggccctcggaggtccagctgggcctcctgcctccgggcaggcaaggtttacactgcggaagccaaaggcagctaagatagaaagctggactgaccaaagactgcagaacccccaggtggcctgcgtcttttttctcttcccttcccagaccaggaaaggcttggctggtgtatgcacagggtgtggtatgagggggtggttattggactccaggcctgaccagggggcccgaacagggacttgtttagagagcctgtcaccagagcttctctgggctgaatgtatgtcagtgctataaatgccagagccaacctggacttcctgtcattttcacaatcttggggctgatgaagaagggggtggggggagtttgtgttgttgttgctgctgtttgggttgttggtctgtgtaacatccaagccagagtttttaaagccttctggatccatggggggagaagtgatatggtgaagggaagtggggagtatttgaacacagttgaattttttctaaaaagaaaaagagataaatgagctttccagatttcagattctgtatttatcttcagattttgtctgcaactattttttattttttaaagaaatgaaatatcttctctgcttgcaagctgatttggaaaattcagagagggagtggagattatctggacagcctcattttaccccagagcatcagaagcctgaaagagcaggttctgagaccttccctgcccccaagcctgagcccagccttggaatgcgtggctctcctgggggtgcctttgggcaaaatgcacatctgaatggccaggtgcttcccagcagtcagaaattatggggggtgggggtgagagggccccctcatagcatctcaccaaatccacatggaggctttttgcaaacagcaggcagttcccttctgcagtgactccctcctaaggacgccccacaacccagctagttaaacgtgagcattaaatttttttaaaaaaaatccccctagtttcccaagacagcatttccatgaatttagtcttctgtaaatcactgggcatttccgtgagccctttctgcctccactctcttctctgtctttgcagtttccttatccccgaccgcgcccccccttccaacccaatcaccccacaaacaagatttctagacccagtataaaatgatccttttagtgacagtttcttgttatctggccgatccactggggaccgggctgcagcctttaaaatttttgatcctggaggccgccgagctgaactttccggcaggacccgggcgaggggggcttagcccttcgtttcgatcttcccaccaacatccgagagcctaatcagcgcgcccacggaggcgccttaagggcagttggggaagatgagcagagccgggaaacagcaagaggtatagaccctctgcagcacctctccaattccgcggcccttccgggtggcgtatacagctccaggattgggaaaggggctccggtggcccggcccgcgggcgcctggcctcgaagccagagggaggagtgcggggcgtggggtcggggggtgccgggcagaggaggaagccgtgtccgggtccgctgggcgaggggtcctgggtcaggggtcctgggtcagggccggtctgagccccgg

SEQ ID NO: 15679 - DNA, 33663 bp, Human
aggtgttaggggaatggacatcagcctttttttttctttttttgagagaaagtcttgctgttgtccccccaggctggagtgcgatggcgcaatcttggctcactgcaaccttctcctcccgggttcaagcgattctcttgcctcggcctcccaagtagctggaattacaggcacctgccactacgcccagctaatttttgtatttttagtagagacggggtttcaccatgttggcaaggctggtctccaactcctgacctcaggtgatctacccacctcggcctcccaaagtgctaggattacacgcatgagccactgtgcccggccgggcatcagccttttaaatcctcttggaagtcacttcagctcaagtggtagaggcttgcatcaaccgggggaggtgcaacaacaatggctgcctgcctctttgttgttgctctgtgatcaaagcagcaatcagtgacagagaacagatctctgatatttggaggacaggatcctttttgccaaccctagttcctacagctgtgagcaaggttctctgggaacagatgcatgactgcctgccatggggctagaagggtgaggtgtgggtaactgctactgtgccaagagcaggcattgatcaaaattaacctcaatttacaatccaagccttcccctagaagttgcaagctttcaaatgactgcaaagtttcataatagttacatcagacagattctgccagtgccatcgttgtctaggtgggaaaacagatgcctggtgcttccgactctgccgacttcccagaatattctctagttcttaagccctttgttggtaaattggttcttcggttgtcctgctgcctgctaggactcaggtctcctaaggcccttactacttttctgtaagctttaaatattcaaagttgtattcatgtattttttttttcattctccttggccttgtgggtttaattaagcctttattaaaaaacataagtatttattgtttttagtggaatttgggaaggaagtgaaaatagatgagtttgtttagtctttatctgggagtcttacctctttatgtacacttatcttcttcaactagactgcaaactctttgatttagctgagtcagggatataattctttttatccctctcagcaggtaatttattgctttccacatagtaaatcataatctgctggttgaacttgttaagtaaggcagtgatgctaagtgattgatacatgtcacaaactggtaatcattttaatcccagtgcaattattaatgtactgtgttcattgatatatataattatatataacattatatattatataatattactctagccatttatatatttctgtattaggtggggtttttttgtttatttgttttagcttatcagttatcattagtgttagtatattttatgcgtggctcaagacaattcttcttcttcagtgtggcccagggaaggcaaaagatttgacacccctgttctagctatgtagaaacacatgctgtactatactactgggctctaagtcaatgcttcataatgtgaaaaagtcctcagtatatttaggtcttcttaataataaatttcattatcttaattgcatgtatgtttcgtttaaccagggatttcttagggtaacagtcactaatgtgtagaagtgaagatggagattgagaaaaaacccagtcatgattatttattgccctttcttttttccttgttctctatgttaacgtattcttatcaaagaaacactaaacaaacttctctttatctcatgtaattctctatagtagttcatatgaattatgtaaggttcaattttaaaacaatagattcttaagatagtatatactctaaagtttgtctagacactaaatgaaaatgagtgctttgacagtttatgtcctaggctaagtcagggtacgaatatgtatctattaattatcttgtctttccagtccaaacaggagctttacagaaatgcactgtatgagtggccattccaattttgtatcttgtgtatgcatcataccctcaagtgacatctaccctcatggcctaattgccaccggtggaaatgaccacaatatatgcattttctcactggacagtccaatgccactttatattctaaaaggccacaaaaatactggtgagtataataatgctttggtgtttttctatttgaagttttatccctttgaaagtaaaatttacatatccattttctcaagtttttattatattttgttttacctatatctgtggtttggtaatggaaacgcttttgggctatcttagttccgtaaaaattctgttacaaatttgttgtgatcagtaaaggttgatatgcttatatatgtaaaaagtaatctgttcagttattggccgggagcggtggctcacacctgtaatcccagcactttgggagggtgagacaggcagatcacttgaggccaggagttcggaccagcctggaaaacattgcaaaaccccgcctctactaaaaatacaaaaattatccaggtgtggtgatgcccaccagtaatcccagctactcaggaggctgaagcacgagaatggctagaacctggcaggcagaggttacaatgagccgagatcctgccactgcactccagcctgggtgacagagtggagactgtctcaaaaaaaaaaaaaaaaaaaaaagtaaagtgttcagtaataaaagaggctatataatttgaatatacttcatgagtctggtttttaactatttcatgcaatgaatgcatttattcagaaaactaaaagtatttaattgaagacccagagcagtgtgtttagggctctggtattattgaggagtatttaatatatttgaatattattttctgtgatttgtgtatattcctgattctgtgataattctggatttctgtgtggcttaacagttctttattgtagaatgacatgcttaatcggtgcagtaagtgtacttttttaaaaatataaatgaaatagtttggaacatgtttcataaacacttaaattcctttaaacaatttgtataatgtgccaggcaccatggctcatatgtgtaatcccaacactttgggaggctaagacgggaggattgctagaggcaaggagtttgagaccagcctgagcaacataggaagactccatctctacaaaaaattaaaaaattagctggacatggtggtgcatgcttgtagtcccagctactcagtaagttgaggtgagaaaattgctttagcccaggagttggaggctgcagtgagctgtgatcacaccaccacactccagcctgggtgatagagtgagaccctgtctctaaaaacaaaaaatttttttttttttttttttttttttgaggcagagtctcgctctgtcgcccaggctggaatgcagtggcgtgatctcggctcactgcaagctctgcctcccgggctcacgccattctcctgcctcagcctgccgagtagctgggactacaggcgcctgctaccacgcccggctaatttttttgtatttttagtagagacagggttttaccatgttagccaggatgatctcgatctcctgaccttgtgatttgcccccctcggccttccatattgctgggattacaggcgtgagccactgcgcctggccaacaaaaataattttttattttaaattattttttaattttaattttaatttattttgagacggagtctcggtctgtcaccaggctggagtgcagtggtgtgatcttgtgatctcggctcactatagcctctgccaggactgcctcccgggttgaagcgattctcctgcctcagcctccagagtagctgggattacaggtgcccaccaccatgcgcagcttttttatggtttttttttttttagacagagtcttgctctttcaccaggctggagtgcagtggcgtgatcttggctcactgcaacgtctgcctcccgggttcaagcagttctcctgcctcagccttctgagtatctgggactacaggcgcgcgccaccacacccagctaatttttgtatttttagtagagacagggttttaccatgttggccaggatggtgtcgatctcttgaccttgtgatctgcccaacttgacttcccaaagtgctgggattacaggcctgagccaccgtgcctggcccatttttgtgtttttagtagggatgggatttcaccatgttggccaggctggtctcgaactcttgacctcaggtgatccacccgcctcagtctcccaaagttctgggtttataggcatgagccactgtgcccgaccaaaaacagaaagaattttttaaatgtttgtgtgcctgtatgtgtgtttgtgtgagaagtcttcaatacagagggatacagatttttaaaattttatatagaaatcaaatgtacacagaagtagagatatcttatttttgtttcatcttcccccctccttccactacatcattttaaaatttctgatattctgctgtttcatttataaatacatccttcattatgtggctctaaaacaggggttggcaaactttttctgtaaaggatcagatagtaaataaattttctgcttttcaggccatatggttgctctcataactgctcaactctgcagttgtagtgcacagcagctatagacagtaaataaatgaatgagcatgtctgtgtttcaataaatcttcatttgtgaacactgaaatttgaatttcatataattttcacgttagaagattgcctttgattgtttttctctcaattacttcaatacgtaaaaaacattcttagtttgttaggtatacaaatacaggtggctcaccagcattagtttgttgacccttctaaaagataaggacactcacgtcctcaaaagaataaccacaatattgttatcacacctaaaacaaaacaaaacaaaacaaaaacatccagtgaatgttcaaatttacccagttgtctcataaatctttttttacagttcatttgaattctgacccaaataaggtccacatctgttttgtttgtttgtttgttttgtttgtttgttttggagatggagtctcactcttttgcccagcctggagtgcagtggtgcaatcttcagctcactgtaacctctgcctcctggattcaagtgattctcctgcctctgcctcccaagtagctgggattacaggtgcccaccaccacgcccagctaagttttttgtagttttagtagagatggggtttcaccatgttgtccaggctggtctcaaactcctgacctctggtgatccatgttgtccaggctggtctataactcctaaactctggtgatctgcctgcctcggccttccaaagtggtgggattacaggcatgagccaccgtgcccagccctacatctttcaatctgtcagtttctttctttttttcttgttgcttaaaaccagattattttagctgtagaatttcccacaatctcagttttactggttaaagccttgtttcctttaatgtgttcttcagtcacctatatttcttgtaagctgttaaatagatctagtagctttatcaggttcagattcaagtttttggcaacagtataggtggtattctgtattttctattgtatcacatcaggaagcacacaatatctttttgtgatattaagattgatcagtgggttcaagtgttgtatctttctttcattataaagttcccatcagcctttcacataatggtaatttttagcagctactgataatcattgcctagattcaatattttattaaggtttacaaaatgattgtactgtaattctaatattatttctgcatttgatcgccaagacttttctgtatagatctttccacatcaactggttaccatgtgggacttctatacagaaaagacagaataaatgctttccttgacccttctcccaatttatttactggtttgcagaaggagttgtttcctgaattttttttttttttttcagttctcaaattgttccatatctggccattggaaacctctttaaattggctcctgtcacctttttataagaccttcagtagtcttccttgctttattacagaatgttctaggttcagtttgtacacttcttgctctagacctcaaaccagcacttttgccaagaagtcctgtttttttttttcttttactgggaaatggtattttatccaattatatcatactgatttgtggaagaatgtaaagagcacccaagttacaactattaagatctcagactgggcatggtggtgcatgcctgtaatcccagcactttgggaggccgaggtgggtggatcacttgaagtcaggagttcacgaccagcctgactgacatggtgaaaccctgtctctactaaatacaaaaaaattagccgggcatggtggcgcatgcatgtaatccaagctacgtgggaggttgaggcaggagaatcacttgtgcctcggaagcggaggttgcagtgagccaagattgcaccattgcactccagcctgggcaacaagagcaaaactcccatctcaaaaaaaaaaaaaaaaatctcagtgatgtaacatatgagtatttctcattaaccctacatgttcaacatggattaataaagggactctgttcatcagattttctcagggacccaggctaatggggctttctctccacacatgcttcagtagttgttggagcagtcaaagggcaacatggttaataaggcactggttggctgggcgaagtggctcatgcctgtaatcccagcacttgggaggccaaggcgggcggatcataaggtcaggagatcgagaccatcctagctaacacggtgaaaccccatctctactaaaatacaaaaaaattagctgggcgtggtggcgggcgcctgtggtcccagccactcgggaggctgaggcaggagaatggcgtgaacccgggaggcagagcttgcggtgagccgagatcacacagctgcactccagcctgggcgacagagcgagactctgtctcaaaaaaaaaaaaaaaataataataataataaggcactggcttttaaaagcatgtgccttccttgaatgtcacagtagtagagaattaaaaaaatcaattttaaaaaaacaccaaaaacatgtgtgtgactgaaagtgtcagctaccgttttgtctggtgactaatgcaagtatcatggctatgcctaacttcaaatggaggaggaaagtaccattctcccatgtgtccaaaaagggagagttaccacagcatgctttctggtcatcaacgattcagcttcatcaaacaatccaaaagtctcctctgagtgatgctaagtattctaaacatcagagaggtgatgcttataagtaagctgtcaaccatacccaatatacaattatggaaaaggaataggataatcagagcaaacactcattcagaagaggaagcagtgcaagacaacagtttttgatctagagccattctgaaatccaaataagtagctgtctcaaggatcctcagctcagggtagagagacttttgtgattgcttccttctggtctaggaaaaaggtttcccaatccaaggttctttatggctgtgcttcgaccgccaatgatactcttctttcctaagataatttttctttttttttcttttatcttttgagagagggtctcactttcttggtcataccagaatgcagtgctgctctcacagctcactgcagccttggcctcccatgctcaagcaattctcttactgggacgacaggcgcgtgacaccatgtctgactaatttaaaatttttgttttagagctggagtctcactatattgccccaggctggtctcaaactcctgagctcagttcaaaatgctaggattacaggcatgagccactccacctggctaatttttcttttctttctttttttttaaagacagaatcttgctgtgtcacccaggcgtgaagtgcagtggtatatgatcacagctcactgcaacctctgtgccctgggctcaagcaatcctcccacctcagccttccaagtagctgggaacacaggcgcataccgccacacccagctatttttttgtatttttagtagagatgaggtctctccacattgcccaggccggtctctaactcctgagctcaagcaatccgcctgccttggcctcccaaagtgcagggattacaggtgtgagccactgtgcctggcataatttttcatatttgtaatttttagcctgcataatttcacatcaagaaagtaagacatttaattaaccacttcattacttttggacattgagcttggctgcaggttttatggtcactgtcatgaaagcagccttaaatatttatataaacagtgtttcaaaatcatttacattatctccctattatgatttgttaaagctggaaggattgtgtagctcacttaagttccgctccctcgtttcacagacaaggaatctgattttgagtaatatttctgcagttacgtggcttgtaagtggcacagctaggccttgcgcccaggcagtctggcaccagagtctgctcttgaccactgtactcttatgcgtctctgctgaattgagccttagttagctaagatactgccacttcaaagagtgtttttaaaattggaatgctttagtaactttcaatgttgagcatttttctgtatgaaaatgtgttatccaatgatgttttttccttagtttgtagtctatcatctggaaaatttgggacattacttagtggttcatgggacaccactgctaaagtctggctgaatgacaagtgcatgatgaccttgcaggtacagtagttctgtgtaaatattctaaagaataattaagttgaatgattctgtggcaacttaaattgatactcattttactcacagggtcatacagctgcagtgtgggcggtaaagatcttacctgaacagggcttaatgttgactggatcagcagacaagactgttaaactgtggaaggctggaagatgtgagaggactttttcaggtaagatcagggtagacaagttttataatatcattgctttttatttgctcagattttttttctcagaagtttacaagcatgaaaatatttgaaaaacattagtatatttaagctattaatttgagttaatgtaatttttctgatgagttaatatctaatacatttaaaaagataatgaaacctctcataaaacagccaaatgtagactgataaatagctgtctgataagctatatataatatgcatatgtgcttctgcatatatgtatgtaatttttggtatatagttatatttttggttgtcattttaatacttttagcctgaaacttctaaacataagccttactgatggtcagtcagcagtgttatcttcatatatggaagaaatcattattagtgtctttatattgaagcacattgtttataacgaatttcaagctttgtttatgttgtggtttatggtgagtattctttttaaaccccagctattaaataatgccaatactgatgcatctgctatctaatagtaatatcattgatttatttgtagggtacttaagtatttactgttaattttaattggtgttgtttttcctttttgaattttttccttaaaagttggtaactaccctagataatatgcaagaagtccctttgtacagataaaagtatcttttggctgggtgcagtgactcacaactgtaatcccagcctttcgggaggctgaggtgggtggatcacttggggccatgagttcgagatcagcctggccaacatggtgaaaccctgtctctattagaaatacaaaaaaattcgccaggagtggtgatgcacacctgtaatcccagctattcgggaggctgaggcacaagaatctcttgaaccctggaggcacaggttgcagtgagcagaggtagtgccagtgcactccagcttgggccacaaagtgagactccatctcaaaaaaaaaaagaaaaacaaaaaaagtatcttttgatggaaagtggatgatgactaaacatccttctgtttctgcttcagtatatagtctatatatatgtatcaagtcattattaatctgtgatagctactcttaagtcaacagatactgaacataggaaatctgacttcacaagcttcagagaatgttttgttcttaaatttatgggctactctttgttatatatttcttttatatttgaatattatatattttataaattactcttgttggggaagaaaaattaaaaatgaattttcaggtgaaaacaaattattggggtcaaaatactatttctggaggtttttggagaaggtaggatgaatgtaaaataacttctgaagactggtgataaaaaaatattgctaaaccttaaatacaaattttggttatcaggctttcaacaaaaaaaaagatttctctaacttgaaaattaatttttactactcactgatatgttttataatgttagtaaaatgtatagagccatcagccaaattatcagttttattgatttgcattattgttttttaatgcagggcatgaagactgtgtaagaggtttggcaattttgagtgaaacagaatttctttcctgtgcaaatgatgctagtattagaaggtggcaaatcactggcgagtgtcttgaagtatattatggacatacaaattatatttatagcatatccgtttttccaaattgtagaggtaagattattttatgctatttatttaatgttttgtattgagcattattccatcccatttgtgagatggagggaggagagctgattacttaatttactatctatgacttgaataatttagtaaatttatttcattaagtatctttctcctgtttacaaagaagaaaattgtatggccatctttatattaattcagatttatgttgtgctgtaaaaagttcttgggtatctgaagaaacactttgtaagatgtgacatgaataaaaaatgtgattttgaagttgtatatgttgtaagtgacaaacatatgaaatttaaaactgtaattttgaaagtctctgggtttcaaaaagtcagtgtatctagaaagatggtatgtataaatgtacttaattttattcaaactaatacttcctatattcattaattttagactttgtgacaacagcagaggacagatctctgagaatctggaaacatggggaatgtgctcaaactatccgacttccagctcagtctatatggtgctgctgtgtgctcgacaatggtgacattgtggttggtgcgaggtatttatattctagtcaatcattaaatgttatatgtctaggccttcagtaggaactagagtgtacagagataagccataaggaatttcacgtgacttgaggagactatatggacacttcaattactaaacaaaacagtagtagatattatagctttcatactaagggatgcatgatataccagtattgtactgcaattgtgcagtcaatgatgcatgatataccagtattgtactgcaattgtgcagtcaagatattgactacaaaagaagttagagaaggtagagattggtgtgggaaaactttctgtagaagaagaaatttgaactggattttgaaagattatgagtgagaaaagatacgcaaatttttgtcaaagctaagagtataagtttccttcatgagaatgaatgcagcatgcataggaagtgaaggaaaatggtggagtactaatgctgagataataggtacaatggggcttaactgtggagaacctttagtgctttcatgccaggcattttttagattcattgcctggggttgaagggttgtagttcttgagcaagaaataggattgaagcagaacttatgaattactaaatatgtagattggatttaactgctggtgacaatggacaggaaagtaaattagaaagcaagtacagaaggagtgtgaagttataagacattggccccacaatgctaatgggtaggaaataagtaaatgagataatccagaaggaaaacaatcagaaaaagtatgaaagaaaaggataaagcttcaaactgttagtgattggaaatcttcattaataaaaatggagaagtgggagaattggttgggtacagaaggtgatgaccgtggccttagacttcctgaggtctgcagtggtggtgagccacactcatgccagtggatcatggtcatttgaactggagcttagtataagaactgaggctaagataaagatttcgcaaagcttccaaaagcaaagcatagaacaccattctctgagggaagaaatacaggggaggaacagaagactaagaactaagttttatgatataccattagtagagaaaaagaagttagtaggttaaacagaacaaaggaattcaaatgttgaaatttctgggagacagaaaaggagagattttggagggagattgtcatcagtgtcaaaagtgtttgaggagtcaaagaatggaaagtttgaaaagcatttggatttggtttgaaagatgttattagtgacttttggcatcaatcacattttgaatagaaaatgatagaaaaaaaggcaaataagaggaaataaagggttggaggagatggacgaaggatcatagactactctataatgctactctagcattgaaagcaataagaaggccagctgctgtggctcacacttgtaatcccagcactttggtaggtccaggtgggaggatcgcttgagctcaggagttcgagactatcctgggtgagctaccgagaccctgtctccatacaaaaaaaatatttaattagctgggcatggtggcatgcatttgtagtcccagctgctcaggagactgaggtgggaggattgcttgggcccgggaatttgaggttgcagtgagctgtgattgccgcccctgcactccagcctaggtgacagagttggaccctgtctcaaagaaaaagagaagaaaaagaaggtgacagctataagggatagagggtctaataaagtgggtgttttattttttggctgggacagaggctgatttataggcttagtttttttccctcctaagcatatgaagaaaaaccaatagaacgagtgatgtacatgtttgtggacgaataagttagaaacaggtttcctgtagaatgggccaggattaatacagttggaagtgtctaatttgcttctcctatctcagaatttcgaattaagaaatcatggagataaagtaatttttctgagaaaagaggttaaggacggccatctaatccaaacattaggccattttttttccttgattgaagttacattgctagttactggcatagtaaaggatgaccatatttgtctactgaacatctgctaattttaagccctacattgggtctttgagccctttataaactaaactagcccactacccttctctatatggtaataactaaaaaatattgactttaaaagtacatactatagctctagattcttatgatggtaaatatttaacttggaaattgtataaaatacatgtttctctgttctttgtcaataacttctctattaaatagttgacataatagagtagcatgtgctgaagtcagcacagtgctgtaatcagcaattaataacatgctaatatttctcatattcacaaacacagattatttttactatggatcattcaggtgtgataatgttaatgtattatggcaatgacttctaaaatcagtttatttttccttacagtgatggcattattagagtgtttacagaatcagaagatcgaacagcaagtgctgaagaaatcaaggcttttgaaaaagaactgtctcacgcaaccattgattctaaaactggcgatttaggggacatcaatgctgagcagcttcctgggagggaacatcttaatgaacctggtaagtattttattgtacctagtagaaaaaattcaccatatttggcttttggaacaattagaagaaaaataaatgttgttttgcttgtgtttttcattgctagatgctgatttttgaggatttttactattacatataatcactatgagaaaccatgttcttgcctctgtctcacagaagactttgaattaagcttctcataaacaggaattaaaaaataaatctcccaacacttagatcatttacagtagacactcaaaaggcactcatttaatactttttggttgattggattctctgagaggggttacaaactgaatattaaaatgagtttaaatacgaaattagccaggtgtgatggcatgcgcttgtagtcccagctactcaggaggctgaggtgggaggatggtttgagcccagaaggttgaggctgcggtgagccgacaccacaccattgcattccagcctgggtgacagagtgtgactctgtctcaaaaaaaaaaaaaaatgagttaaaatcaagcattgtctgtgtaatgagttgggaatcattcgagtttgaaatcagaagaccgtagtcatctcaaatgaaatcttgggttggatgtatctcttgattgcattattataccagtgcttctcaaagcttgattcatggacctctggggattctgagatcctttcaggatgtccatgaggtcaaaactaatttttgtaatactagatattatttgaatgttgtacattgtattaatgtttgcacttatggtgcaaaaacaatggtgggtaaaaccactggttcactagtatgtaaatcaagccaggggctttaaaccattctggtaagttactatgttctacttgcatgcagttgtagtttaaaaaaaaaaaacaataaaaacaaaaaaaaacagtttgccattaagcatgtccttgatgaggtattaatattaagaattatcagttttattacattttgacacatctttttaaatattccgggtgagaaaacctaaagtagacataaagtaagtcaaaatactgtggtgtctcaaagaaaagaacatgcgcagtcatttgagttgcaggctaaactaccagttttttcatggagtgctatttttatttgaaagaatgactacggttattcaggctttggtatttggcagacgttttttgaaaatgaacaaattgagcatgttccgtcaaggaaaataactgataatatatgttgccaaagataaaattcaagtgtttgagtgaaaattgaaatgtaggaaaaatgtatctccaccaggaacttagtagcttcccatttgtattgatactagtggtaataacattaacaaatgccattttttaatattgaataataaactgtatgaatatgcagaagatctgcgtaagttattgaaccattattttccatatgactagtatctgataccatctcagacatgggtaaaagatccattcaaagtacaagatagaccagtggattttagtataatagagcatgaaaaattcattgatgtggtttcagattgtacactgtagcgtttaaaaaactagtatttctggcctatccacattttctgaaaagacttgtcttctctttttcaactacctacgtgtgttaggctggattttctttttgtagtcaaccaaaataacaaattgaaacagattaagatggggtaagaggggagattaaagtatgatggactaggccagaactggcatatatcacatccacccagattccactgaccattactcagtaatgtgacatcatgtgactgcccaatgcaaggggactagataatgtagtctctggctagacaactacagctgtatctaatggaagaagagcatgattcttcggaggatggatagctgtctccgccactgaaggccttgttgagaacatgacatttgtgtaaagttgttaaagagggaaaggagcaaatactgccaatatctgtgtgaagagcatcataggcagaataaacagctaatacaaaggctctgtggctgaagttgggagatgaggggacagggggaatagtagaaagtaaggtcatgtaggatagtgtggacaatttatatttggtcttgtacactactcaagagtttaggcttttaccaagtgagatgaaaagcattgatgggtttcaagcagaagagtgtcaggacctacttaaacttttgaaaaaattcctgaagttgctgggtggaatatacactgtcgggggccaagagtacaggaaagaggccgttgaatcaacccaactgagaaatgatggtggcttggaccaagggatgatgatggagatattaaggagacagttttctagatatattttaaagaatgagctgatagcagtagctgaagggggtgctgagaagtagccgaaggagcgatggggttgagagaaaggtatcaggcttttctacttttcagtttgagccactggattaatggagagccatttacggaatgaaatgtgttaggaagatatattcactaataaaacttgttttatttttgatgggccagttgcttcctagtagaatcacgttttgttaaccttcctttgattaataatatttccttttaactgttattttcttttggccacatttttaaatcttttatttgatacaattttattttgaaacaaaatccatattctcttatgtgtaaattttaatgttaagaattttctatttaaatgtttttcaattttacattgccattctacctttgattcttaaaatttttattttaaggtactagagaaggacagactcgtctaatcagagatggggagaaagtcgaagcctatcagtggagtgttagtgaagggaggtggataaaaattggtgatgttgttggctcatctggtgctaatcagcaaacatctggaaaagttttatatgaagggaaagtatgtcgacttctactttctaattactattgtcttaaatattaggcaaattaaaggtttcctttgccccatagtgataaaatttcctttgttttgacatttaaaaatccattactgtgggaaactaatcttttttttccctgtcttgaaatagatattttaaaagtatctttccatgtagtgagagctgcatttgagagacaaattagcaattgtctgtcatgtagtagtttctatacaaaagctgttcccagccattttggattgggagcttctgtgccacctttcatcaaatgcctcatgcctggctatatttaacttgacaagacatgagagaccctgcagggcagtgcttaaaatgccagcacgttttggtgagtagggcacagtaacagctgataattttgatcttgatatcaaaccagttggaaactctgctttggctctagagttaatatgtagttgtaatccatccttcatcctcacccccatcccctaatgaaatactaattttgcatcacatgcagatgggggctgttaatctttatctgccaaaaacgaagattttagcactgcactttggagaaagtttaagtactgtaattattaaagaacacatctgtgttatgttgtatatgtcattaatatatgtgaacagataataagcatgtatctcctttttatattcctactttaggaatttgattatgttttctcaattgatgtcaatgaaggtggaccatcatataaattgccatataataccagtgatgacccttggttaactgcatacaacttcttacagaagaatgatttgaatcctatgtttctggatcaagtagctaaatttattattgataacacaaaaggtcaaatgttgggacttgggaatcccagcttttcagatccatttacaggtaagttagtgtttatattgagtcttatgtagttccattagtgttgattgatttttttgatgttttcaaatagtcatgtgattagctttttcaataaataccaatatctacagcagggttttacttcacattcatatgtttaagcctcaaatgatgaagtaattctgtattttacagaaataatagtaaattgttgtctttcaaaaatacaatcatactataatggaatttcagttatttgaaacaaaaataaacttgtaagttcttttatatagtgtttcttttaaaaaattatattttggcaaaatttagtaaatctttttttcacatgaggctaaattggtcagtcatgcatcaaatctaaaagtgaaccctatgggtagttttagtttatatgtgatgtgtattctacacgttcattttaagttaattgtttgtaacatcgtatacatcatatctcatgttataaatgcagttaggtgctcataccagtctgtaaattgtaatcctaatggtactagtccaaattctggcccctaggaagtggaatctaatcctagtaatattaacgtgagttctggagactggtgtaggaggaaataaaatgcctcctctaaataacattttgagataggcactttactgttaatgttttcctctcatcatttctgactcaacatttttcaggtgctagtgctcttccttgttttacgaggactttgtattatattcctgtctcaaatccttatgtagatccaccttttcttccctgacagctactccacattcccaaattatctcctcattctacttcaaaatttcattgcccattcataaaataaaactaatgttacctgcatgttgatttaaatagaattatcaggccaggtgtggtggctgacgcctgtaatcccagcactttgggaggccaaggcaggcagatcacaaggtcaggagttcaagaccagtctggccaacatagcgaaaccctgtctctactaaaaaaaaaaaaaaaaaaaaatacaaaaaattagccaggtgtgatggatgtgcgcctgtaatcccagctccttggaaaactgaggcaggagaatcacgtgaacctgggaggcagaggtggcagcgagccaagatcgcaccattgcactccaacctgggcgatagtgcaagattccgtctgaaaaaaatcaaaaaattttaaaaaaaattatcaaagtaacttactactgaattacagatgatctgatcctccaaatacttgcacttaaaaagaaaataattgtttagtatgtggatatttttgttgttggaatttcagactgtagttcaagagtgaacacagattgtagtactgtgtaagctattttgcatgtgggatacaggaaaggaattaaagcagctgactttgtctggaaatctaggaagcacttggcttgttttgcccttctgagactcttaactttttcagcatccttactgttttttgttttttgttttttgttttttttgtggacaacctgattatttccctagaggtactaacaaaacataggcacatacgccacacattcgtaaatgtataaatggaagtctctttcctttgtagttttcatcccttttctaattctcttctccagtaggttgtaagcttcagtggatataagcaattttgttcccttctggatccccagccctgagtccattgtttgacacatgaattaatgaacctagagctctaaatgattaacatttagtgcctgtggttttgataacaataacaacagcaggaactcttgtgaatttgtataggaacagggacaggaattgattgtatgtttatatatttaggtcagatattacctgcaattctcttttgatatttgaattaagttttaatatttaagtgctggggctaaggtataataaagcattaaagttaagaaaacaaaacttggagaatcattaaaatttcagttttttcccagttataagacttctgactatagtttctgtcattctatcatgtgaaagttttgctcttctgtttttctccaaatgtaggttcttctaaaacaagcattgtgctgtttgaaaaattcagaactttggtgcacttctgccttttctttattttgcatgcacaggtggtggtcggtatgttccgggctcttcgggatcttctaacacactacccacagcagatccttttacaggtgggatgtagttttgattcatgtatctttcttcactaaatgtatagcatcttgcatcacatggctttacatcttggagatgtcatccagtaattggtaattcccttatctgcatttccaattttgatggatttccttttctttaacttctgatttttgctttttcctggagtggttgtgtagattccctcgtgacttttaaatagcatattattagaattcattgttttctccaggggtccttcccaccaggagagcagtatagttaagaatataggttttagagtcagacaaaccttggttcaaaattgggctctaccacttacttgctatgagaagttggcaagttacctaacctgtctgagcctattttttttatctgtgaaattagataataggggaacccaccaaccaagacacagcatgagtgctatcactggcgagatgctaccaatcacgagcagagaaggagccatgtgagccctgatattggatggagcagtacaatcaagaagtctccccaggcatattttgacttaacatggaaggagacattccacccaactacccaggagtagtcttcctaatctaagttattaatgtccttcttgaagcccttgaagtgttggtgtatctcttcaaaatgaatttatttaccaaggtatgcatgcctcagcatcaacactactggaaaaagtgccagagttggactttaaggcagctgaagaagtctctattttcagaatggcttttgatatcttgtataatgctgttgttggatcttcagacagagttcctcgacagtatactcagtttgggaagagatcatagcgtttaggtatccactggccttgcagactggtactgtgagctataaaaatgacaacctacagtcctctctaagtcatagagattggacaaacatacaacgttaggtcagcatcatgaagttgtggattgctgtccgtgagcttcctttttcctgtgaatttattgatggcccagatggaaatggttgtaccatgtgcattgataacaagtaaatgaaaataattaactatcacactaaatgctgttatggcacagtggctgttaaggaagtctttgataacataatgtgatttcaaatggtagtaaggatctgaagagtagataagatggctttctctctatcagcagttcagaaacagtgatgccctgaaacttaataccaagtgagaatccaaatcactttggcggctttttttctggaacagaaagaacatatcaagcttcaactaataccagcaaaatcaagaaaactcctggggccattataaccagagcatatctcactgttccataatgtcagtaactcagaagatgcagtaattatgtagatatgcaagatagcatacacaatgtccaagagaattagggtatcaggataattgaatacacttttgtataaatatataacagcatctaccatattgaggtatgaaaataaaatagcataatatgtgtaagtgttaagcaaaatgcctggagtatatttaagccacggtatgtattagttgttgttgatgatgatgttttcccaactttgtcagtggcactggggccaaaagatttccctatctggctacaacttaaagtcagtcttaattcttctttcttttccttattaatttatgcagtccttaaactgctaatgtttattagaatgatctgggaagcttgtttaaattacttatcccagggttctatggccaagagattctgattcactagattaatgaggaggttaaaactaaaattattcatgctctgatctctcacccaaggattctaattaaataaatgatcttggtggtagtttgatcttagatttttttttttttcgagtcagagttttgttcttcttgcccaggctggagtgcaatggtgcgatctcagctcaccacaaactctgcctcccatgctcaagcaattctcctgcctcagcctcccgagtagccaggattacaggcatgtgccaccatgcccagctaattttgtatttttagtagagacagggtttatccatgttggtcaggctggtctcgaactcctgacctcaggtgatccacccgcctcagcctcccaaagtgctgggtttacaggcgtgagccaccatgcccagcgatcttattttttaaagttccccaagtgtttctaaagtggagccagtttggagtaaccctgggttatgggtggactctgggaatctgtgtattgaatctgtgattcattcaggtggtcagaaaaccatatttagaaaagtgtgagagtgtactttaccttttaacagcttaatgccttgggcaagttattcaaccttctgcttctaaaatattgtgaattataatggtatctatataatactttaatgaatatatgcatagaagatgattaactggcatatggttaaatttcaacaaatccatttattctgtgtttctcattattttaattaatcttacttttttttttttggttttgcttttttaattttctttggcatttctgtatgttttgcgccggttgtaacaactcctagagtataaattgagagaggctagaacagtagctcatttttcttcttcccataaaggctgatccattattctgaatatctccaaatcctgctgattctctctctatacttactctttaagtttccttctttctattttcaataggacagccacaagtattatctataataaaatgtgactgggctgttgtcatagtatctctaactcttacctgagtcttttccaattgtcttatgtgctagttagtcccacccctttacttcaatagaatagtgttcacattttattctggaaacttttatttctctccaatccacttacatttttgtagtttactaaacttctacaattataatatataaggcatgtaatgtttactttgtagctaacacttatgatatgctcaggcactgttctaagcacttttctgtattaaatttgtggcatatttattatgtatataatgacgccattgtgaagtgtgcttaatactggaaataagcgaaggagcagtttgaactttataatttacagtcacctttgcttactaggagtattattgtattgtaggtgctggtcgttatgtaccaggttctgcaagtatgggaactaccatggccggagttgatccatttacaggtacatactttttatttctttttcttttttttagattttaaaaattcgttggaactttaataaaaagagtaagaaaatttgtgtcattttcttgcttgagaactttttatatagtaaatcgagaccaaacttgtctggctttttgagttttctcagaattgtctgattactacattttagaatcatctggggagctttgcaaacgtacttcagccttatccccagagatgcttacttggtctaattctgctctgagatgggggcttggcaaagggtagttttataatcttccaatgtgattctaatatgcatctaggatcggaaactactgttttactgtcgtaaatctgctttcctcactactcttacaaagtctgtgtttattctcatctcttcattcttaatgtgttgagaatgttattcactggattatacattgttctctttaagaagactcaggaaagaatttgcttctgtgatttatgcctggaatagctatagttcttctgagcaactaatttttttttaatccttagttacctagtctacagtctgacatacctcacttgttcattgaatatgtgctggcatgttttcctctgtattggctgccagtaaaacacagagctaaatttgtggttcatctctttcaggtttgacagatatcttggcatatatttttttctagttaatttttatgttctttgtaatttatatgagagaaattgagtaacatatatgttattcagcattaaaataaacacccataaacctaccactcaataactaacctagcatgtgtttttattttttattacttttgagatgggatcttgttttgttgcctgggctgggctcaaactcctgggctcacatgatcctcccacctcagcctcctgagtagttgggtttacatgcgcacactaccatgtccatcacttggcatgtgattttgtaagctattttttaattgcaaaagtaacattggttagcaatactgaagtataacatagtacctgtaattaagattatggattctggagtgagaatctaaattcaaatctcagctctactactttttatctgcttgaccttgaacaatttatttgatgtgtctgtgcttttgtttttctcatttgcaaagttgaggtcatatctacttcctagaattaagaacttaaaattataaaatttatgtaaataactttttaccaaattaatgcttagtaattgttagctgtacttgttaacaaaggttaacagtgctccctcccattttccagaagttagtttttaacagcatggtgtgtatattgaagctttatataccttagtacaagctaatgtcacctctcgcctggaataatgaaataacttccaaattggtctctcgatgatccatattgcagacagtgatctttttattgtttactctgtttatgcacctcccttgattaaaaaactcttcagtggcttcccagtgaatatttttcttttgccttgccccacattcctcattgcctttcttctgtccagccatactggctggtgtcagtttcttgagcatgtaatagtattttctacctccagagctttgaactcactgttttcttttggcatacttatgcattgccctttgccttgtcatttagaccacaaattattggctgtttttctcccttttcttttttatttaattttgtaatacagtatttattagataagctcagtgaaacttttctgaacacccacatgtgtccttgctagatcgcctactcttatctttcattgcatcctgtacttttccatcagggaacttttcattatacttatttggatgatatttgattaatatttgcattcttaacacagctcctagactgtaatgaccaagaatgcaggcaatgtgtgtatggctcatttttatgtcaagaaaaatttattgtttataaacaattaattttgtacaccaatctcactaagtgtttcgtctttatctaccttcatccctttctattcctaatgtaatcagaatattaagataaatcttttattcatatttttgcacaatatcttaactgtacatttgaacaaaatagggtttaaattgattaagatttgaaatgtgagatgtaaattagatttaaattatactttagttgaaggtcactttatttattgaatattgctgaattttcatcatttgccagtttgttcatgatcagatactgagtttctgttaatataatagagacttaagatgtaaaaaaaagtataaaagactaggactcagacgggcctggtggctcacgcctgtaatctcagcactttgagaggctgaggtgagcggatcacctgagtcaggagttcgagaccagcccaaccaacatggtgaaaccccttctgtactaaaacaatgcaaaaattaggctgggcatggtggcttatgcctgtaatcccagcactttgggaggccaaggcaggtggatgacgaggtcaggagttcgagaccagcctggccaatgtggtgaaaccctgtctctactaaaaatacaaaaattagccgggcgtggtagctcatgcctgtaatcccaactattctggaggctgaggcaggagaattgcttgaactcaggaggtggagattgcagtgagccgagattacgccactgtactccagcctgggcaacagagcgtgactctgtctcaaaaaaacaaaagggctaggactcctcagcaaaccaccatggcatccatttacctatgtaacaaacttgcacatcctgcacatgtaccctggaacttaataaaatacttaaaaaaaaaagaaagactaggactcctgtccttcagggatttacaacttggggatttataaagatgatgcagaaaaagattagagaaaatgataatacctactacatcctttggaataagcagtaaaagacataaaaggagagatcagcatgccttagagaagatgaaaatggaaagtttcatataatcatatggtattctttgacttttttaaaatttataatttagatttaatcttagaccaggctcggtggctcacacctgtaatcccagcactttcggaggctgaggtgggaggattgcttgagcccaggaggtcgaggctgtagtgagctgtgattgcaccactgcaccctgtctcagaaagaaaaaaaagaagtaaaaagtgtgagatgatcttgttctacatttaagcttccattcccaaaaccaaaaaatattatatcaataaatataaattatacaaaatattttggatatttttccccttgaggttccttgtttattgcacgcactgaatagttgcatatctcaataattgtgaaaactaagtcatatagttagaaaaatctcatttttgatcactccttgtgattatcatcatcttctattctttaaatagggaatagtgcctaccgatcagctgcatctaaaacaatgaatatttatttccctaaaaaagaggctgtcacatttgaccaagcaaaccctacacaaatattaggtaagtttctttaattaatttattcacatattcacagactgtttgagatgtcatcaaggttgtttctcttgccaacatgtgtcaggaattgggtacttaatatgaatagatatttctattgcagtattaaacaactgtgtccaccacaaatatacagtctggtaaaggatccataatactttctaagaagtcttacacaaacataaagtaagtaatttatgatgactgtaataaaaaaaattaaaggtggaaaatgtaaattctacccacccaggctcttaatgttttcaaaaaaaattaatgaatatgaatgagtaaagcatttgaaaaattaagatcttatctttaaaagattagtggccctcagaaataatacaagttcattttaaattgcccattagaaatgaatctgctggcctggtacagtgactcatgcctgtaatcccagcactttgggaggccaaggcgggcggactgcctaaggtcaggagttcgagactagcctggctaacatggtgaaaccccgtttctactaaaaatacaaaaattagccgggcgtggtggtgggcgcctgtaatcccagctactctggaggctgaggcacgagaatcacttgaacctgggaggtggaggagttgcagtgagcccgagatcgcgccactgcactccagcctgggcaacagagcaagactccatctcaaggagaaaaaaaaaaaaaaagaaattaatctgctttagtgactttgattgctttttctgtttgtgttcctcaaaacaaaatacagtgttttgttgttgttgttgtcttggactaagagtacttattagctttgtttgccacaaagattatgatgagaattaattgggttaacataacgtaacatacttaccagagtataaggcagagtcagtattgtaaaaatttataaaaatcactcattaatattttcttaattgctttattttgaataatgtagtatatgcacacttttagattttttttaaaaaaacttgtgaaaatctaacaggtatttagacttttgcattccttaatgaacttgatttttatttattagagttaaagctgttaatacctgagattagtgaaacaggccctagtttccatttataattgatttcaatggtgtaaatttggataattttccttattatcggaatttggacttttttattcttgagataaagatttttaaagaaacacagtaactcaaagtcatgatacaaaggatactgatactaaagatacatgcgaaggatttgaaggaaattgtttcatgaaatgagaacatgggaagaaagggcagtatgtccattaaataaatttttaaaataatgtgacatcaaatatgcatatggaactaagtcataaattaaatgttatcagtaggcatttaactctttgactatttcattgacagctgtagaatttgacataaattggctaaaaagttgttataaattttctcatggagaaactaggttattgacttacacttgaatatatattacacatgatactgctttgaaagtcatccaaaatggaggccggacgtggtggctcatgcctgtaatgccagcactttgggagttcaaggcaggtgggtcacttgaggtcaggagtttttcaccatgttggtcagcctggccaacatggtgaaaccccatctctactaaaaatacaaaaattagctggtgtggtggtgcatgctggtagttccagctactcgggaggctgaggcaggagaatcgcttgaaaatcctgatggcggaggttgcagtgagccgagatcatgccactgcactccagcctgggcaacagagtgagactccatctcaaaataataataataaggccaggcgtggtggctcacacctgtaatcacagcacttcgggaggctaaggagggtggaccacgaggtcaggagattgagaccatcctggctaatgtggtgaaaccccgtctctactaaaaacacaaaaaattagccaggcatggtggcaggcgcctatagtcccagctactcaggaggctgaggcaggagaattgcttgaacctggggggcgagcttgcagtgagccaagatggcgccactgcactccagcctgggcgactgagcaggactccatctcaaaaaaaaaaaaaaaaaagacaaagctcataagccttatccttactttatggtgtttgataattgctgagtaaagtcttaactccccatggtgtacactagagtacttttattgaaagtcttggcatttatatattatctggccaattacagttagagaattttgaaagtttggttttgggttctaggtaaactgaaggaacttaatggaactgcacctgaagagaagaagttaactgaggatgacttgatacttcttgagaagatactgtctctaatatgtaatagttcttcagaaaaacccacagtccagcaacttcagattttgtggaaagctattaactgtcctgaaggtaaataaacactcttcaaaaatgtaaccagaaagcaagaagttttatcttcatttctatcaatattactggtatttgtggattaaatgaaagttaacttcggtagttctaaatcactatggaaaatcttcacgaaaagggttcactacactactggaattgatgatcttgtttccgttacatgccttttgagaatctgaaggtaatatatgatccccatatatgcaccagtttgtttttttgttgttgttgtttgttttctttgtttttttgttttgttttgtttttgtttttgaaatggagtcttgctctgtcgcccaggctggagtgcagtggcgtgatctcggctcactgcaagctccgcctcccgggttcacgccgttctcctgcctcagcctccttagtagctgggactataggcacccgccaccatgcccggctaattttttgtatttttagtagagacggggtttcaccacgttagccaggatggtctcaatctcctgacctcgtgatcctcccgcctcagcctgggattacaggcgtgagccaccgcgcccgggcatgcacctgtttgtttactgtttcagagcatttgtggattcctggccaggcatccaagatactcttagtgacctgttaaccctaggctacaaatatttactgtaagtttttttttttccaattatgtcagttaagtcttttttaattctcaaagagtccttgcctgttatttttttttatgccactgatttattggagaaaaagtcttttttttttttttttcaataaaatgtcccatattatggattttgctgatgtgttcctccatctctgtatttattgctagtggcaaaattagattctggttcagtaggtgttttttttttaggtgaaatcctttataaatgatgatgcatactacttttacattacggagcacataatgttggatttcctcacctttagtgatgctaagattattttgtgcattcattcagatggcatctacccaggcccttgattataaagctcccaccaacctataagcatcctatcacttgttaactggaattcttctcttaagaactttccggctgggcacggtggctcatgcctgtaatcccagcactttgggagaccaacttgggtagatcacctgaagtcaggagtttgagaccagcctgaccaatatgatgaaacctcgtctctactaacaatacaaaaattagctgggcgtggtgacgtgcacctgtaattccagctacttgggaggctgagacaggagaattgcttgaacccgggaggtggaggttgcagtgagccgagatcatgccattgcaatccagcctgggcaacaggagtgaaactgtctcaaaaaaaaaaaaaaaaaaaaaaagaactttccctgtttaattgttcggtcttacagaattttttaaaagcaaagtctgcaccccattctttccattcatttttgaatactcacagtgtgtaggctgtttgagagagttaccttatttttaaagcgaatatgatcttacagcaataaatctagtttatataaatatgaaaaattaacaaaagtttcagaaatatatgcattttttttaaagcagacacatgatttttcacattttctaaaatggttagttttgcagtgggaaaataaaatccttcaaagtcgatagtcaaaagaaattttctttattttcataagcattaatgactttttttttttaatagatattgtctttcctgcacttgacattcttcggttgtcaattaaacaccccagtgtgaatgagaacttctgcaatgaaaaggaaggggctcagttcagcagtcatcttatcaatcttctgaaccctaaaggaaagccagcaaaccagctgcttgctctcaggactttttgcaattgttttgttggccaggcaggacaaaaactcatgatgtcccagagggaatcactgatgtcccatgcaatagaactgaaatcagggagcaataagaacattcacattgctctggctacattggccctgaactattctgtttgttttcataaagaccataacattgaagggaaagcccaatgtttgtcactaattagcacaatcttggaagtagtacaagacctagaagccacttttagacttcttgtggctcttggaacacttatcagtgatgattcaaatgctgtacaattagccaagtctttaggtgttgattctcaaataaaaaagtattcctcagtatcagaaccagctaaagtaagtgaatgctgtagatttatcctaaatttgctgtagcagtggggaagagggacggatatttttaattgattagtgtttttttcctcacatttgacatgactgataacagataattaaaaaaagagaatacggtggattaagtaaaattttacatcttgtaaagtggtggggaggggaaacagaaataaaatttttgcactgctgaactgtgagattttcctgtgtaatttgggtagattttcaagagtgtgaacacaaatttaaaataagctataatcagcaacaacacaatgacaatgacatcttccccttaccttagccactaagaagacaagggctgttactcatataacttgcttttattacttaatgtacaccaaactgttgttgtcaattatcttttatttaacttctccaccttcattgctagatccttcgaacagcactgatacatttcaaggtcttgttttaggataactactttaaaattttttaaattatattaaatttataaaataatttataaattcatatattaaaacaatataagataatttcttgatttgtcatttataaatcctaaagtatatttgtttaatggcctatttttagatgaagaaaaagccagttggtaagctgtgttagtcatgtatcagttcagacagacgaggtctcaatttaactccaggcttagatccagtttcttttgcccttcactatttgaggtaacttcatttttcattctagttttgatatttggctgtttatttttgtcattttccattatttcaaagggaatttggaacatgttgaattttatcaggtggttacataagcaagagtacatcaaactgtattatttgaaagtctagaacctgtcatgtgaaattactatttttgagccctctatgtggtccaggcagaatagtagacacactgatatttaatccttaaaacccctttaaatgagggccagtattatctctgctttcagaagtagacataataggatgaatcatataacagaaaaaaaaaagtgaagccaagagggagttaactacttaaagtacatgctatgctatactttctagagagatcacagatgtgtgtgaacatcctagcaattaacacaaagaaggaaccatcacattaattacacaatttattgtgtctgaggtaacccagtttcttgagagaagcgtaactattttcaaaagtgggaaagatcttttcataaagacgttgccagaaatagcaacattctcaatactcgtggtgtaaaaaccatgaatcccctggcttaatgccaaattatagccttagaagaataattgttccccaaatgggcaagaaaggttctaattgtcaagagtaacccaagtaagaacttttggaatatcaaaaggaaatgagcaaaatgtaaatagaggggatatgtactttgctgagtattaaattggaactacctggtgtgtacctggactaaatattctgttcactggctcagttgagtacctatacttttcgttttttgattgggtttaggtggttatgtcaaagttaaatggcaaaattaggaatttaacccaggtctggctggttcctttacaatacactgctttcttaagtacaaataatttaattgcaatatttaggaaaagtaggtacctttgaataatgataagaaacagtcttggttaagaatatgagttccctcttcaaaatgtaaggggtggcaaaatgtaaacactgcttcctattactgtgcaagtttttttatgtcaactttactatttcatgtttgttgtggagattacaaaatatagcttagcaaaaggaaacaatctcacttgaaggatatgttaaataatttaatgatattttaaagattttcttttttagttaaactttcctatgattctcttaatgttttttctgaatacaaaagtaataaatatttattgagtaaaacacacacaccccaaataaaaattgcctgtaaggccactatctagagaaaactattcttaacatctt

SEQ ID NO: 15680 - DNA, 46725 bp, Human
  misc_feature (1)...(46725): n = A,T,C or G
atttttagtagagacagtgttttgccaccttggccaggcttgtctcaaactcctgacctcaggtgatccacccacctcagcctcccaaagtgctgggattaaaggagtgagccaccacgctcagccaacacctggctaatttttgtatttttagtacagattgggtttcgccatgttgcccaggctggtcttgaactcctgacctcaaactatcatccgcctcggcctcccaaagtgctgggattacaggcatgagctactgcacctatcccattcccccttttttttaagaaggtaacaaggtttttgtcagggtctgtgagctggacatgtgtgcagtggttaaataatttggcctaggctgtgcacccactgtcctttttttttttttttttttttctagagagctattggaataggggccaggctgctgcaggctcagggcagctcaacttccaaatcctgtagcttcagacttgtggtccttcacgacatgctgagtcacaatctactgctccctcaagcccaatgtcaccacaagcagagtctctaaaggacattctcagaagatggtactgtcaatgtgagaggcacctctcctcccctcgagttctggtgcagctgataactagagatctcaaatgcttccctgggctttactttctacttcaacaagtactgattgcgggcctctggagcccacacactgccctatacactgggtaacacggagcactcaggaatacacgatcttggcggggcgtgatggctgaggcctgtaatgtcggcattttgaatgactgaggtaggaggatggcttgagcccgggaggtagaggctgcagtgagccgtgatcgcgccactgcactccagcctgggcggcagagggagaccctatttcaaaaaataaataaataataataaaattaaaaaaaaaaaaaaggaactcacgatgtggccgtaaaatgggttacatcctagttaggaaaatagatgtttgcaaaggtacataaatatgcaagcatcaaaacaataacaacaacaacaaaaatttaaaaaatgcaagcatctacgtgtggcacagtcccgcgggccgggcggcttactgtggttgaggtcaccagaaagactgtggaacagacgcatcgcgagtgggtctcggaggggtggcgcatatggaaagaggagaaggagggcttttttgattgaaagcgaataccggcaagagggcctttggcacgttcagggaaccttgccttacacgcagacacagggttggggatctgttcggaaacgcctgaaagatcaggctcaggagaagaccactttttggccgcttcagtactgcggtcaaccagctggaaagaacccccgccctctacttttcaaattaatctccggccggcgcacgcgcctcgtggggcgggcgctgtgctaccatagacatgcagagctagatcgtatacctcctcggaggcggacatgttgggtcctggccaaaaagttggaaacacctggggccactaccgaggtaggctgctcctcccaagaaagtgagaccgaaagagctcccgtggaagcggtcaaagcaggggcggggcgaacctgtgacatgcccctcggaagaacaggcttttagagagtcgccaggctccctgccctcatccgagatggcggcctgagggcgctctagccgacgctcttcggatgcccggagggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagtaagggggcggtgggagggccgggccgggggcggcggcgcctagctctccttcgcgcccggagggacccgctcccctccacccgccccacctcctgcacctggggcgggaggcgcgggccttcccagccggacaaagcttggaggtgacggataccgccccccgctccccggttttgcagctgggaggcttggggcggactctcggtgacctcagccccccgccccgtgactgggtccgcggcctgcctgcctttcgtctccgcagtcccacaccccggggcgggccgagctttctggagccccggagtgcgtgtcttggggaaaggggctcagggcttggcttcctttcccacggctggagttgacctgggaatctgaccgccgccactctcaagtctcactgcagtgagacccgcgggcgtggttgtgagttgggggatccgacgcggcaggtgcggtcgcagagcaaaggtgtggggactggcagtgcgaagaaggcaattccagggaggcagatgggccggagctggtggtagaaatgacaggcctgaccctgctttgtaaatcagcttgggataagatcagtcatttgtgtctttaacccaaccaagcccctggtcttaagtcgcctttggggtctgacagctctgagatgccctcccagccttgccacttactagctctgtgtcagtgggcaagagacttgatttccctgaacctcatctgtgaaatgggcatggttgagaatattgtatgatcgggataatgtagaagtagtatctggttctagcagagtaggggctcatagtggccctctgaatagttgtttactaagtggcctcttttctttttctttttcttttctttttttttttttttttttttttgagacggagtctcgctctgtcacccaggctggagtgcagtggcgagatctcggctcactgcaagctccgcctcccgggttcacgccattgtcctgccccagcctcccaagtagctgggactacaggcacccgccaccacacccggctcattttttgtatttttagtagagactgggtttcaccgtgttagccaggatggtttcgatcttctgacctcgtgatccgcccgcctcggcctcccaaagtgctgggattacaggcttcagccaccgcgcccggtgaaatggcctcttttctagttggctcttttggagaatcccagagctctgatataaaggaggagccttatatgccctttctacatacacttgttagaaatctaagacataaaatgaatagctcgtcttttaatatttaaagccattttcacattttaaacagttttcatagagttacttcgttacttttttagggttgacaaatgattgcagggatatatcttaaacttctggggggaaatgtagaagaaagggaaaactttagtcatttttttttcagctctgcttgtttttttttttaatagttggagttttggagagtggaagaatgttaaaaaaacaaatcaatccttttgcagtctactacctagtttctatttctaacccctgattgtttgtctttctttctgaggccaacgaaaacactgactttaaacgaagcttctgtgtgtatctagtggttcagatttaccctacctgaccttgagggagagcagaggggagcagggcacattttaaaagtcagtgagggttttttttgtttgtttgttttagattctttcctggcaaattcccgaaagattttgaattactataaatgatacatattcataaatacttcccttacctgttttacttgtcgctcagtaagattttgttttatcttatctgttttatttattttgagacagtcttgtgtcacccaggctggagtgcagtggtgccatctcggcttactgcaacctccacgtcccaagttcaagcgattctcctgcctcagcctcgaaagtagctgggatcacagatgcccgacaccacacctggctagttttttgttttttgttttttgttttgagacggagtctcgctgtcgcccaggctggagtgcagtggcgcgatctcggctcactgcaggctacgcccccagggttcacgccattctcctgcctcagccttccgagtagctgggactacaggcccccgccacctcgcacagctaattttttgtatttttagtagagacgggtttcactgtgttagccaggttggtctcaatctcctgacctcgtgatccactcgcctcggcctcccaaagtgctgggattacaggcgtgagccaccgcgcccggccacacctggctagtttttgtatttttagtagagatgggtttcaccacgttggccaggctggtctcaaactcctgacctcagacgatctgggattataggcgtgagctactgcgcccggcccacctggagtatttttaaaaattgttatatacataacataaagtttacctttttaaccgttttttgtttgtttgtttgtttttgagacgaagttttgctcttgttgcccaggctggagtgcaatagagccatcttggctcacccacaacctccgcctcccgagttcaagtgattctcctgcctcagcctcccaagtagctgggattacaggctgcaccaccacaccccgctaattttgtgtttttagtagagacggggtttctccatgttggtcaggctggtctcaaactcccaacttcaggtgatccacctaccttggcctcccgaagtgccgcctttacaggcatgagccactgtgcctggcctacctttttaaccatttttaagtgtacacttcagtggctttaactacattcacagtgttgcacaaccatcaccactattcatttccagaacttttcatcatcccaaacagaaactctgtacccattaaatactaagtccccattccctggtagcctccattctactttgtctctatgaattgcctattcttgggacttcatacaaatagaatcatagcgtttgtctgtgtctggcttattttcctcagcataccttgtccaaggctccctcatgtcatagcacgtaccagaatttattctttttttttttttgagacggaatctcactctgtcgcacaggctggagtgcagtggcacgatctctgctcactgtaagctccgccccctgggttcacgccattcccctgcctcagcctcccgagtagctgggactacaggcgccctccaccacgcccggctaattttttgtatttttagtagagatggggtttcaccgtgttagccagggtggtctcgatctcctgacctcgtgatccgcccgcctcggcctcccaaagtgctgggattacaggcatgagccactgcgcctggctgcagaatttattctttttttaaggccaaataatattccattgtatgtgtatacctggctggagttttgttgttttttttttttgagataaagtcacccaggctggagtgcagtggcacaatcttggctcactgcagcccccgcctcccaggttcaagtgattctcgtgcctcagctcccaagtaactgggattacaggtgcccaccaccacacccagctaatttttgtgtttttagtagagatggggtttttccatgttgcccaggcgggtctcgaactcctggcctcaagtgttctgcccaccttggcctcccaaaatgctgagattacaagcatgaaccactgcgcctggcctggctggagatgttaattttattttttttattattattttttgagatggagtttcgctcctgttgccgaggctggagtgcgatggtgtgatctcggctcacggcaacctctgcctcctggattctggcaattctcctgtctcagcctcctgagtagctgggattatagacgctcgccaccacacccagctaatttttgtatttttagtagagatggggttttattatattagttaggctggtctcgaactcctgacctcaggtgatccgcccacctcagcttcccaaagtgctgggattgcagacgtgagccaccgcacccggcctggaatatttttaaatagattatcttacatcatatcatttcacttgtaaaaagagtaatgcttactaatcaggacttaaaacctcacactactattaattccttaatattatgtagtatctagtctttgtccatatttctctgattattttttaaaatggctttttttttttttgagacggagttttgctcttgttacccaggcgggagtgcaatggcgcgatctcggctcaccacaacctccgcctcccgggttcaagcaattctcctgcctcagcctccctagtagctgagattacaggcatgctccaccatgcccagctgattttgtattttagacggggtttctccatgttggtcaggctggtctcaaactcccgacctcaggtgatccgcccgccttggcctcccaaagtgctgggattacaggcatcagccaccacgcctggccaaaaatggctttttacacttggtttattctaattaggatccaaacaagatccacaccacatttggtcagagtgctgaagcctctttccttctctatgcttttgataattgaggcatttatctctggtgtgtgttattgaaatcattgcttgtaaccaagtatttggaagtgattttccaagaaaattactattcaaagaacaacgcgcaccagacattaaccatgggttgtgagctctgtctggtaaagcagtatgttacaacgtggtgagctgcttatggagtgacagcagaattttagtttaatgaattagattttctgaattattttttggaaagaatggcagcttaattatttgagtctttttattagacatatgcatatgaactggaatttttttaaaaagagtaatcttaatttcccttttttgttctttttgatctataggcgccttggtgctgaattggggaagtctgttgtatatcaagagaccaatggaggtaagttaaaattatttcttttttttaaaattattttttatttatttagtttttttgagacagagcctcactctgtcgcccaggctggagtgcagtggcatgatcttggctcactgcaacctctgcctcccaggttcaagcaattctcctgcctcagcctgctgagtagctgggattacagacgcccgccaccacacccggctaatttttgtatttttagtagagatggggtttcaccctgttggccaggctggtctcaaactcctgacctcaggggaccctattgcctcggcctcccaaagtgctaggattacaggcatgaccactgtgcccagcctttatttatttatttatttatttatttatttttattaagatggggtctcactatgttggccaggctggtcttgaacttctgagctcaagcagtcttcccaccgcagcttcccaaagtgctgggattacaggcgtgagccaccgcactcggcttccaccacgttatttctaaaatgcaaatattttttcttactactgcttccttactcctaccctgtaggctggggtccagtctttttagcaatcacatggggccctttgggaatccagattctacccctttacctgcctcatctttgatccacccattaccacatcttgtgtgctctgactttggaatacatcttatatctgaccctttctcacaacctctgctgctcccacttaagtccagcctgccgtttgctgcttgctagacaccttccaaaacagacgccatggcctccccgtggccactcctgccctgccacggttttcttcacacagtagccagcagtctttttaaaacaagtagatgaaacccttcccaaccttaaatcttccagtggctttcctgtcactgctagaataaattccagactcttcagcgagtaagaaatgaaatccagagtcctgcaagtcctggccccttggctccctgacctcctgtctctctctttcccctcactctgtctgctttcttttttttttttttttttttttttttttgacggagtcttgctctgtcacccaggctggagtgcagtggcatgatcttggctcactgcaacctccacctcccaggttcaagcaatcctcttgcctcagcctcccaagtagctgggattacaggcatacgccaccaaacccggctaattttgtatttttagcagagacgggggttttgccatgttggtcaggctggtcttgaactcctgacctcaggtgatccacccgtcttggcctcccaaagtgttgggattacaggcatgagccaccgcgcccggcccactctgtctgctttctaagtggactaactgcctgcccctctgcttggcacactcggatcccacatcttcccatgttcccaaacccccttctgcgctgctcgttctggattgcagtgaggcccttttttccagccccattgttctttctccttcgtcatggctagcgtctctggcatattgggcccggagggtttgctggccttgttgttgtatcatctctcctgggtcagtctttgtcccttcttccaagtcctgcattttggggttcccagtacagttcctgacatggaggaggcttcagcatttgttgaaaaaataataaggatgtcgcccgggctggagtgcagtggtgcaatctcagcttactgcagcctctgcctcccaggttcgagcaattctcctgcctcagcctcccaaagtgctgggattacaggcggagccaccgcgcccggccaaactccctttttcagtgcacaaccaaaaatcagaaagccactgtaaaacccagtgaacatttagcatgttgtttaacaacttttcacaagctgaccctgactttccggaagtgaaatgaatatggcagagtttatctgaagatccacagtctagaaacggaactactgctcttttgaggggcgccatctcagtggcatcactggaaggtccagattgcctgccacactggtaatcaattatgggggggtcaggtgccaacagatgtctggctttaagggatttaagtccatgctgaaaggtggaaagggagaagaggacatagaaacaaatttgtcttttcagagcacaaggcttttgtgtgctgaggtggccatgtgtgtcaaagtcagggagcccctcttcctgggagccgagaggaagtctctcaaaactagaagggaaaggtgctttccccacatcaatccagcttcggagacattctattcatgacatatgctcctttccccagaacaacaatgaagcgttctgtgtgctaacaacatagcttagaaaacaaaaattctgcgtttttataaaacttgataaaaaatagtatttcaaactgtacagtcaccagaagtacacagttatccaaaatgcacacgcttccctcagcatctccagcaggtgcctggtgtgttcaggcatctccacttcccatagagtcattcccctcctcgccagtgtcagctttttcctttttcccttgggtaccttctctcccttctttgcagtggcctttttaggcctgggctctggctttggagggaggagcaggtttagcagacagcctcacagatcttctctgtggttcgtctttcaccttggcctcatctcccttagcatccccttcagcctttctcttgggcatggtggcaacgaaagcagccggacgtaggcactgggagcgggatgcagtggcggtgcacggactgcgctcagtcgggggtcattctcgcttcctcttcttcatactgctccaagacttattcttttgccccagataaaatgttggtttagattaatctttactccctccaaatgtttctagctgttgcatcatgagtgctttgcttttctgctttttttttttttttttctccagacaaggtctctgttgtccaggctgaagtgcagtggcacagtttcagctcacactgcagccatgaccttccctggctcaggtgatcctcccactgggactacaggcacttgtcaccatgtccagctaattatttttttgagatagaatctcgctgtgtcacccagactggagtgcagtggcgcgatcacggctcactgcaagctctgcctcccaggttcaagtgattcttctgcctcagcctcctgagtagctgggattatagttgtgcgccaccatgcctggctaatttttgtatttttagtagagacagggtttcaccatattggccgggctggtctcgaagaactcttttttttttttttttttttttttaatgagacggaatcttgctctgtcacccaggctggagtgcagtggcgcgatctcggctcactgcaagctctgcctcccaggttcacgccattctcctgcctcagcctcccgagtagctgggactacaggcacccgccaccacgcccggctaattttttgtgtttttagtagagacggggtttcactgtgttagccaggatggtctcgatctcctgacctcgtgatctgcccacctcggcctcccaaagtgctgggattacaggcgtgagccaccgcgcccagctaattcttgtattttttgtagagacaggattttgtcatgttgcctaggctgttcttgaactctggtgctcaagtgatctgctttcctcagccctcctaaagtgctaggattacaggcatgtgccaccgcgcccggcatgaagtacttttgtttttcttttttctcctttttaacataggagcttttcttaaaacttcagaacatttttatttttcagaaacaagagttgaaataaaagaatctgttcgtggccaagatattttcattatacagacaatacccaggtaagaggactgactactttatctcttttctgtaaaaaccttaacaatataattgattatcttttcatatgaacaacaacttagtgtttttaaaagttatatattcaggccgggcgtgtggctcacgcctgttatgccaacactttgggaggccgaggtgggcggatcacgaggtcaggagttcgagaccagcctgaccaatatgttgaaaccctgtctctgttaaaaatacagaaattgctggctgggcacgatggctcacgcctgtaatcccagcactttgggaggccgaggcgggcggatcacgaggtcaggagatcgagaccatcctggctaacatggtgaaaccccgtctccactaaaaaatacaaaaaaattagccgggcgtggtggcgggcacctatagtcccagctacttaggaggctgagataggagaaaggcgtgaacccaggaggcagagcttgcagtgagccgagatcgcgccactgcactccagcctgggctacagagcaagactccatctcaaaaaaaaacaaaataaatgaataaaaaacaaaagttagctgggcatggtggcatgcgcctgtagtccagctgtttgagaggctaaggcaggagaagtgcttgaacccaggaggcagaggtgagctgagatcgcgccactgcactctagcctgggcgacagagtgagactgtctcaccaaagaaaaaaaaaagttatacattcgtttgcatgttaaactaaatgcttccccaaatacaattactgtcttctggaattcctaccatttgtcacactgtactgttacctgtttacttctctccaggctttttttggggacagtctcactctgtcaccccggctggagtgcagtggcacagtcttggctcactgcagcctctacctcctgggttcaagtgattctcctgcctcagcctccctagtaggtgggattacaggtgcccaccaccatgcccagttaatttttgtatttttagtagagacagggtttcactatgttggccaggctggtcttgaactcctgacctcaagtgatccatgcacctcagcctcccaaagttttgggatttcaggcgtgagccaccactccccaagctttaaactcctcaaggacaaagggttttcccatggtttgcactgaccccaggccagtgtccgtcagctcagctctgctgaaaagcttctagttgttacgtgtggtgcataaactgctcctggttcatacccatcaagagaggtttttgcactgcattttatcttgcaccgtggcctgtttctagcctatctctgtttcagagatcgtcgcccttgcttccctcagggcagggggctgacacctggggaatcctggcctgcttgagtgagaacgttcatgcttctatgggactatctcctttctcatcgcctgacagggagtgggccattacaccatctgtgtctctgaaaaatccagaccttcatgtcctgatcagtgtacattccccagaccatattagtaataagaatggcactgagtgctaccagtgtgctggatgctttatatgtttcgtttttgtttgttttggttttttgagacggagtctcactctgttgcccaggctggagtgcagtggtgtgatcttggctcactgcagcctccacctcccgggttcaagtgattctacctcagcctcccgagtatctgggattacaggtgcctgccaccatgcccgggtaatttttttgtatttttagtagtgatggggttttaccatgttggccaggctggtcttgaactcctggcctcaagtgatccgcctgcctcagcctcctaaagtgctggctgggattataggcgtgagccactgcgcccggccctattcagtcttctttagtttggagcagttcctcatggcctttatttgactttctttttttttttttttaatttgagacagggtcttgctgtgtcactcatgcaggaatgcagtgacacgatcatggctcactgcagccttaagctcctgaactcaaagcgatcctcccacctcagcctccttagtagctgggaccataggtgtgtgccaccatcctgggctaattttttgtatttttagtagagatgaggttttgccatgttgcccaggctggtcttgaactcctggactaagaagtgatccacccgcctcagcctcccaaagtgctgggattacagacatgaaccaccacacccggccttgactttgaaaactttgacacatttgaagactgacattttgccgattactttgtcgaatgtccctcaatttgggtttcaccgtgatggctctttcactatgatgagattcaggtacctcggaaggaagctgtgttcctgttgtcttgtcttcctgctgcttcatgacatcttgtgtggatgcatcggtttattcagtctcttgtgtgtcagtttgtttctagtcttatgctgatacaatagaggctgctgtgagcctcatcgtatatacatcatattgtcggtgtttcaggtgtatctgtaggaagatcctaagaaatttctggttgtgagggtccatgccctgtggtattgagggaaggggctgcgttgccctcattgaggatatactaattcacattttctccaacagttttggttttgtattgtttgcctcctggtgactggagtcttttttgcctggtggttttgtttgactctccatcttttatttttagacggagtctcactctgtcgcccaggctggggtgcagtggcgcaatcttggctcactgcaagctccgcctcccgagttcacgccattctcctgcctcagcctcccgagtagctgggactacaggcgcccaccaccacgcccggctaattttttgtatttttagtagagacggggtttcaccatgttagccaggatggtctcgatctcctaacctcgtgatccgcctgcctcggcctcccaaagtgctgggattataggcgtgagccacggtgcccagccattggggtctaattctaaaagcatgattgattggtgaagtctctttactaccctaattgaatttgtgataacgaaagaatttgtcatgtaaagagttatctttaagaaatcttgttggccaggtacagtgactcacacctgtaatcccaggactttgagacaccaaggcaggaggatcacttgagtccaagatggcttgggaacagcctgggcaacatagtgagactccatctctacaaataaaatttgaaaattagccaggcgtggtggtgtgcacctgtagtctgagctactcgggtggttgagttgggaggattgcttgagcctgggtggtcgaggctacagtgagctgtgattacaccactctactctaacctgggcaacagagccagatcttatctcaaaaaaaaaaaaaaaaaaaaacaaaaaaaagtcaaattgttaacactaattcgttggtctgcattgtaatctggaatttgagttggacttctccaggaaaagactgaactgagttggtgcatgatcagagcagttctcctctggcacatgagcagctgtgctcttggcatctttgttttgttacatgtatttagggatcatctatgagtcaggggaggagctaagacgttataaccttctcacggcagagaccccattttgttagatagtccagcagtctccaacctttttggcaccagggaccagttttgtgaaagacagtccccccctaccccccgcttttttttttttttgagatggagtttcgttcttgttgcccaggctggagtgcaatggcgcgatctcggttcactgcaaaccccaccacaacccccgcctcccaggttcaagcaattctcctgcctcagcctcccgagtagctgggactacaggcatgtgccactacgcccggctaattttgtatttttagtagtgacggggtttctccatgttggtcaggctggtctcgaactcccaacctcaagtgatctgcccgcctcggcctcccaaagtgctggcattacaggcgcgagccaccgtgcgaggccgttcatggttatttcaaactagtcgagcatagaaacagcatattgttagtgtcctttgtgatacgaagttgaattttataaaattcttggctttgatatcacatggtaaccaagagtgctcaatataagtatttaacacgtgcaatctagagtgatgctgggggtagtaaagactgaacttgacaaacaaaggatcatcagtgtgcaagtgtcttccagggaagggacaaaagaagcatgaagaaatgacttagttaatagccaattgggaaacacttaccgtttttctcacttgtatcttgagtattaggaaattggaccatggtcaggtgtggtggctcatgcctttaatcctagtactttgggagaccaaggtgagaggatcacttgaggccaggagttcaagaccagcctgggcaatatactaagaccctgtctctattctttttttttttttttttttgagacaaggccttgctctgtcacacaggctggagtgcagtggcacgatctcggctcactgcagcctccacctcccaggctcaagtgattctcctgtctcagcacccaccgtcttaccctcccaagtagctggggctacaggcacatgccaccatgcatggctaattttgtatttttagtagagacagggttttgccatgttgcccaggctggtcttgaactcctgagctcagctgatctgcttgccccggcctcccgaggtgcttggattacatgcatgaggcactgtgcccagcttttatttaaaagaaaaaagaaattttggccaaaggaagaagtaggaagcacttcatagagttgtagcagagtcttgtacaataacaatgacaattttacataagtcaacatggaaaggcaccttccctgttgaaaaaggcacataggtataaatgggtacttctgaaaaccagaaccctctcctgaagatggtgaagtttctttatgtgtatttggtgttgagataaaagccgcaagtctcttcccagtggttcagtttaagagcatcaaagcaaaaatatcatcacctggcattttctctgtctcttaagctgatagggatggaagaagaaaggaaaaatttggaaaaaagacaggttggatgtgttgttttgtgtgggtgtgcagcccataaagaaggttattaggtttgtcacaataaactggttctttttgttgtttttttgagacggaggcttgctgtgttgcccaggctggagtgcagtggcgtgatctcggctcactgcaacctctgcctcccaggttcaagcaattctcctgcctcagcctcctgagtagctgggattataggcgtgtgccaccacagccagctgatttttgtatttttagtagagacggggtttcacagtgttgaccagaatggtctcaaactcctgacctcaggtgatccacccgccttggcctcccaaagtgctgagattatagacgtgagccaccgtgcccagtcaataaactagtttttgtagtgcttgagtactggatactttagtaccaactaaagaacacagataatttaatttaatttaattttttttttgagacgagtttctttcttgttgcccaggctggagtgcagtggtgcgaccttggctcactgcaacctccactttccaggttcaagtgattctcctgcctgagcctcccgagtagctgggattactggcatgtaccaccatgcctggctaattttgtatttttagtagagatggggttttaccatgttggccaggctggttttgaacccctgacctcaggtgatccatccacctcggcctcccaaagtcctgggattacaggcatgagccaccatgcctggcctaattttttattttattttatattttatattttattttatttattttttgagacggagtcttgctgtgttgcccaggttggagtgcagtggcacaatctcggcttactgcaacttctgcctcctgggttcaagcaattctcctgtctcagcttcctgagtagctgggattacaggtgcacaccaccacacccagctaatttttgtatttttagtagagatggggtttctccatgttgcctaggctggtctcgaactcctgaccttaggtgattcacctgcctcagcctcccagaatgttaggattacaggcatgagccactgtgcccgacctggttttttaatattatctgcggttacatagatgaaggaatatcttttacaggtttttctgttgttgggaggaagggggcattgcctaaagtaataaggctaattttaggcaaacagaccaaagcttagacattaaaataagcttagttgccttcagagctgttgttctaaaatcacatagatacctttttttggtgctgtttttgcttggaatagctttggaactactgcttccaaacttgcagcatatttcttttgactgttctaataatagcaaccttttggtcgttgaggataggtttaatttttggaaatggcaaaaagccattcagaacaaaatgattattttgggtaattgaactgtgcgatactcagagattttccagatataccaagcaatggaactaagtaaaatatgaagcttatgaagtatattttaaaggttaatttttatgtttatgtacaagttctagtgtgttgatgtaaagtaagcagactcattaaaataacatttacagctgggcacggtggctcacacctgtaatcccagcactttgggaggccgagtcaggtggatcagttggtcaggagtttgagaccagactagccaacatggtgaaaccccgtctctactaaaaatacaaaaaattaaccaggcatggtggcaggtgcctgtaatcccagatattcggaaggctgaggtgggagaatcgattgaacccggaaggcagaggttgcagtgagccaagatggtgctactgcactctcgccttccagcctgggtgacagagtgactcagtctcaaaacaacaacaaaaaattcccagctgctgcagatgattaattgttacagttgggagcagggtaaattctcccccattacttccagctgtggtgtggtttctctttttgcgagcctggctagtttaatgaatgcgtataccatgcctgtttcctcatctcaggttagttgtttgttgttgttgttgttgttgttgttttccaatatggaacacttcacgaatttgcgtgtcatccttgcacaggggccatgctaatcttctctgtatcattccaattttagtatatgtgctgctgaagagagcacacctcaggttagtttttgcctgtccaaaatgctagagcagtaagggctggacttaatataggatgtggttttcttaggggaaagaaaagtagttggttggctgggcatgatggctcaagctgtactcccagcactttgggaggccaaggcgggaggattgcctgagcccaggagtacaagaccagctgggcaacatggtgagacctttctctatttaaaaaaaagaaagaaaagtagttggtaaaacaattaagaatgtcctacttagaggtaaagactacaagagctagccagggtgtacttgcaacattcttagggaacagataaagcagagactgccagccgatttcccttcgccctgctagttcacaaagtaactgcctggtgtccaatttgtccggtatctctcagtgaatgggtaaagccaatgtgacaaagccccttttgtcacctttctgaccaataaggggtgaggtatggagctttctttagcgttgggctggaggatgttgaatcccttggaaaaatggaaaataaaaacctcatgggaaattgctctttttttttttttttttttttttgagatggagtttcactcttgttgcccaggctggagtgcaatggcatgatctcggctcaccacaacctccacctcccaggttcaagctattctcctgcctcagcctcctgagtaactgggattacaggcatgcaccaccatgcctggctaattttgtatttttagttgagacgggggtttctccatgttggtcaggctggtctcgaactcccgacccaggtaatccacctgcctcggcctcccaaagtgctgggattacaggtgtgagccaccgtgcctggcctttttttttttttgagaaggattctcgctctgtagcccaggctggagtgcagtggtatgatgtcggctcactacaacctctgcctcccaggttcaagcaattcttctgcctcagcctcccaagtagctgggattacaggcacctgcaaccatgcccggctaagttttgaatttttagtagagacgggctttcaccatgttggttaggctggtctctaactcctgacctcaggtgatccacctgtcttggcctctcggattactggcgtgagccaccgcgtccggcccagaaattgcttattaatgaaaggaatgttaccctgaaatcaagacttctcaaaaattgtttatcttgttcattaatgttttattatctgggcctcccttgtgctgtgttctccaaaactcatggtgtcatacacttgtgtattttacttgattttgtttttatttttttgtgtgttttttgagagatggggtctcactctgttgcccaggttggagtgcagtggtgcagtcacagctcattatatgggtttgagggatcctcccacctcagcctcccgaatagctaggactacaggtgagcaccaccgtgcctggctgatttttaaattttattttatttttagagaccaggtcttgctatgttgcccaggctggtatcaaactcctggcttcaagcaatactcctgccttggcctctcaaagtgctgggattacaagcataaactactgcacttggtccacttgtgtattgtctatgacaaagccagctaaaaacccactacttgagcctgggtgtggtggctcacacctgtaatcccaacacactttgggaggccgaggcgggtggatcacctgaggtcaggagttaagaccagcctggccaacatggtgaaaccccatctctactaaaaatacaaaaattagctgggcatggtggtgggtgcctgtaatccccgctacttgagaggctgaggcaggagaattgcttgaacccaggaggcagaggttgcagtgagctgagatcgcaccattacactccagcctgggtgacaaaaacgaatttccatctccaaaacaaaacaaaaaacaaaaaaaacctcactacttgaacagataacgcttacagaagctactaaattaactgactccaaacatattgtggatattgggttctggtttatgaagccacagccagcctgggtgtggtggctcatgcctgtaatcccagcactttgggaggctgagatgggaagattgcatgaacccaggagttcaagaccagccatggcaacatagtgagaccctgcctcttacaaaacagaaaagaaaagaaaaaaaatcttttaaacaaaagagtctctgggaaggggaccacacattcttccatgagtcagatgtgctccttcttgggaagaatgagtacctcgagagtggtcccagatggcctttggctttctctagaggtggtttgccttgtttacctaccacagtgcttgcctcaagttgccccctaaatatgtgttgcatggatgatgaactaaaattgactattatgaattcccaactttcttgaaagtgtttgataattgctttgattctaccaaagattatctgaccttttgatgccagacttggcattattaatttggaagtctgaaggagaaaaatgctccaatttattgagagaaaaaataaaaggtaactggaaaacaatggaatggattagcagtctaaaaggaatgtcttagttgtcttgaagttgagccctgcatcagtctcctcagggagacattttttgtttttgttttttttaatcatagaatgcttgcaatagttaagaaaaatccaaattacgagggtgaaattggaagttccaggagttgaacctggaagtggaaaacattgtcagaataaaaggatgtctttgaaatcgctcactcccaaatgcactctgccttagagagaagtgtaaacataaattggaagagactggaaggaaatggctcgattacccttcaagctagaaagcatctcttgctgagtatttcattcagccacctattcagcaaacgctaactctgctgtgtgtatggcaggctttctgctttgctgtaatgagggcagcatcacctacgtgtcagtgtagagctgataattgttcaagaactggtacctgaagaacctgctgccatgggtaggaactgatgacgtggggaagggaagggagatacagtcctgacccccacccccaccccaagacggggatgtttgaggatgcgtggatagtccaggaagagcaggaggaagctaatgtgagaagtgaatactgagagaggtcctggaaggatttcaaggctctcacccctttttaaaggaagagcctgtctgggaatggtggcgcatgcctgtaatcccagtgctttgataggctgaggcgggagcatcacttgagcccgggagttcgaggctgcagtgagctaagattgtaccactgcactctagcctgggtgacagggtgagaccatttcttaataagtgagtgagtgagtaagtgaaagaaagaatgaatgaatgaatgaatgaatgaatgcagagtctacattaggtttgattatccttggcaaaagctagcaatccaaatttataatcattggaaattgcctttccttctaatatcttccagattcatatttcattttttgtctctctgggtaatctttgtcaggaatttatatgtcagggaaagaaaggtccagggaggtttttttttgtttgttttgttttgttttgttttttgagacagagcctcactctgttgcccaggctggagtgcagtggcatgatctcggctcactgcaacctctgcctcccaggttcaagagattctcctgcctcagcctccccagtagctgggactacaggcacgtgccaccacacctggctaatttttgtatttttagtagagacaaggtttcaccatattggctgggctgcgtccagcctccagggaggttttcgaaaattaagttccagctgggtatagtgggtcatgcctgtaatcccagcactttgggaggccgaggtgggcggatcacctaaggtcgggagttcgagaccagcctgaccaacatggagaaaccccgtttctactaaaaatacaaaattagccacgtgtggtggtgcacgcctataatcccagttactcgggaggatgagccaggagaattgcctgaacctgggaggcggaggttgcagtgaactgagatcacaccactgcagtccagcctgggcgacagagtgagacttcatctcaaaaggtcaggagatgaagaccatcctggctaacatggtgaaaccccgtctctactaaaaatacaaaaaattagccgggcgaggtggcgggcgcctgtagtcccagctactcgggaggctgaggcaggagaatggcgtgaacctcggggggcggagcctgcagtgagctgagatcgcgccactgcactccaacctgggcgacagcgagactccgtctcaaaaaaaaaaaaaaaaaattatattccaagacctccccacactcaatggaaagagaccaaatctttctgttaatggcagctaaatggaagggcagttgggtttcccttggcattcaagctggcctaagcccaaatccctgggaggctgccagcaggtgttgggtaactctggtcaccagcagttgcttcagatgtcactgcagtaacggggtatgacacaggagacccaggcaaatgtgagggtgggttaactgtgctgtgaataggagtaacctcagatgaaagctagggcttactcagctacaaaaagtcagaaagcttcccctgccttcatgaggtgccattgtaagctagtgtgatggtaaaattcccacaacacccatctgggcagcccatgttaagttgataaagtcaagatcttttctagggttgatacatggaattaatccccaaatacaaactttgactgtttcagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtgagtgtgcgcgggggccctggggttccagcatgatcctttagggctctttcctagttggacttagctcatacctcagatatccaatctgggatctgagtgtttgtttccttttgaacagttttggctaaggatatgtgagctcggttagaaattcttttttttcccttattcgctttgtcctactttagaataccattgctttagtgtcttctcttctctgtcatctgtcacatattttctatttcatcttgtcatcgctaaattcttagctggcagtcttggcattcttatgtgatcttttgatcttcaggtctagatttctatatctgctttgttagctaaattccatttttgttcatagtattcaagctggattttcttttactccctctcccccacccttgcctttctacatagtggctcattttcattgctttattctccttgtgtggcgggggcacgctttctggcctgtaaatcaatgtaatattttacaattgggtttctattcatctgatgtctgttctaaaactttaacgtatatttgggtcctcggaaagaaatgtatggtcctccctcaatgtccttataggattggttccaggaacccatctcccgcttccccggctcctcagcagatacaaaaacccaaagatactcaagtcttccatataaaatgccatagtatttgcatataaccaacacagtcatctgtagattatttataaatacctaataccatataaacactatataaattgttgttatgctgtcttgtttagggaataatgatgagaaaaaagtttcatacctgctcagtacagacacaaccattgtaggcctaactaccttttcagtctgtgtttcgttgaatccacacgtggaacccatagatccagatggtcaactgtatgtgaatttcatcctctccaaaaaactatagtgtttctggaaagaacaagtaatactggttctacaccctggaagttttgctgtgacctttgaccatttgcaatgtgtttatatatatgtaccttttcctcttcagtactcttgattataagagtatctcttcattgtttttctataagaatacttgaaacattctttgttacatacagaaattattctaagcttcaatatctttgtgttatatgagtttcttttcttctaatatgtatattactttgcgtttgtgttcttgctactttttgccttcgctacagttctttatcctttcttttaagattctgtaatcaaggccttactgttttttccatctcttcggtattaattccatattcatatttttgcttctgccacattattcttttctcaattttctggaccaagccaaaagtcaataattcccactttcttagctttagttctttgtccatgtggaaggttgtagccttctctacattaaggctttattaaggttaacaatcaagcctgtgactgcagtgcttaatcacagtaccccgtcttcagtctgctggtaggaagcaggagttgagcatctagtttaggtccactgtagccatttacctgtaggggtgaactttgtaattttttgttttaaaatttcaggtttaactcacattatcactatggatcttcatcaaaaggaaatacaaggctttttcagctttcctgtggacaaccttagagcctcacctttcctgcttcagtatatccaggaagaagtgaggaaccaccagcaaacaccccattgtcctcaaaagagatcttatttagtttttctctggtatcagatttcgatattggaaggcacatcaaatgagctctcccttaagtcacaatgcctgaggcagcagacagggtcagctttagtcgtggacgatcatagctttaaaagacactaaaaacagattttttttctacgtatctttagcaatttgcttatgttttctaaaatgaatgttttaagaattatttttaaaaaattcttgacgtaggagtgctttttccagtgatgttaattgataaatattgaaaaatctaaaacttgtgactaaaattctagcatatttgatgactagtttggatcattataagagggaaaacttgaataccagcatccaggtgttattttctgataacttttcagtattttctatttttccttcaaatctagattccaaattacagaaatgcagtcattgtagctaagtctcctgatgctgcaaagaggtaagtaagctagacatgggtcctgatccctcctgagtgctcccgaagtcagaatgagctgctttggaatccagaggctgtcactcgtggcctttgaaagcccactggctctcatgttaacccctccatcgttgtcatgtcccatgccacacacagctttatctccagcctccagacagcacacatgatcgctgagttgctcagctttcctctgggaaaacaaagttccttcaagttctcagagaaaggaaagcaatgaggctatgagcatttttcaagcaatggtttttttttttgttttttttttgaaatggagtttcattctgtcacctaggctggagtgcaatggcgcgatctcggctcactgcaacctccgcctcctgggttcaagcagctctcctgcctcagcctccccagtagctgggattacaggcgcctgtcaccactcctggctagttttttgtatttttagtagagatggggtttcaccatgttcatcagactagtcttgaactcctgacctcaagtgatctgtctgccttggtctcccaaagtgctgggtttacaggcgtaagccactgtgcccggcccaggcaatggtttttaacgttgttctttcttctgaagatgactatcagaatattggacaaaggatagaatcaaaattatctagaatcagggccaggcggggtggctcacgcctgtaattccagcactttgggaggccaaagcgggagatcgcttgagcccaggggttcaagaccagcctgggcaacatagaccccgtctctacaaaatacaaaaaatagccagttgtggcaacacatgcctgtggtccccgctactcgggaggttgaggtgggaggatcacctgagcctcaggaggttgaggctgcagtgagccatgttgacgccactgcactccagcctgggtgacagtgagaccttgtctcaaaaaaaaaaaaaaatgtctagaatcagatacaatcccaaaccctaactcacgtgccctttgagtcatttacatgctggcctgggcctcacattctcatttatataaataatgcctttgtatgtccctgaaacgttaaatattttcattttatggttaaaaaatgatgccgtagtgatgcgtgggatttcttcctgtcagtttcaccatttccctttgtccttctagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccatgtaagatgagctctgtgtttttattttatttgtaaattgaagaaagtttttttttgttggttttgttgtttttgttgttgttgttttgttttgttttgttttgtttttgagatggagtctcactctgtcacccaggctagagtgcagtggcgtgatcttggctgactgcaacctctgcctcctgggttcaagcaattctcctgcctcagcctcgtgagtggcaaagattacaggtgtgtgccaccacgcccagctaatttttgtatttttagtagagacagggtttcaccatgttggccaggctggtctcaaactccagacctcgtgatctgctccagacctggtgatctgctcgcctcagcctcccagagtgctgggattacaggcatgagccactgcacctggccctgaagaaagttttaagtagtatgaatggctaggagttatcgactatgtagatatatgctgtcttgttgttttttaataatggaatggtatttgctatcctccgcctttttttttttttttttgagaaaggatctccccctgttgctctgtacagtggcacagtcatggctcactgcagccttgaccggggcgcaagtgattctcccacctccgcctcctgggtagctgggactgtaggggtacactaccatgcctggatagttttctgttcctttttttttctttttgtatggagacggggctccctgcattgcccaggctggttttgaacttctttgctcaaacaatcctcctgtcatggtctcccaaaatgccgagattacataagattacagacatgagccccatgccaggcccgatttcctcttttgtaaaaggaagttgtgttatacacatttgtagactgtgtatggacggttctgcgtagcactcagcattcagacggtgtttgataattttagcttcagtaaaaaagttgtatgtgtgatggtgtgaaatcttaagcttttacattatcataagctgggtgacagctgttgatcaaataccaggctttggggatcaggtaacttttatttttacttatttatttattttgagatggagtctcactctgtcgccaggctggagtgcagtggtgcaatcttggctcactgcaacctcttcctcccgggttcaagcaattctcctgcctcagcctctccagtggctggggctataggtgcgcgccaacacgccgagctaatttttgtatttttagtagagatgagctttcaccatgttggccaggatggtctcgatctcttgacattgtgatccgcctgcctcagcctcccaaagtgctgggattacaggtgtgagccaccgtgcccggcctatttttatttatttttattttgtttgagactgaactcgttctgtcgcccaggctggagtgcagtggcatgatcttggctcactgcagcctccgcctcttgggttcaagcagttctcctgtctcagcctcccaagtagctgtgacttcaggcacacaccaccacacccagctaatttttgtatttttagtagagacagggttttaccatgttggtcaggctggtctcgagctgctaaccttaggtcatccgcctgcctcgacctcccagtgtgctgggattacaggtgtgagccaccgtgccaagccgtaatctgcatttttagctttttattttcaactgactttagacttaaagttgaaagaatagtacagatttccagcatatgctcttcactcggagtccccaaatttaacatttatatacatggggtttttttttttccaccatttgagggtgagttgcagacgtaatgtcccttcattcctaaataccttcgtgtatatttgtaaagacaaaagactcttatataaccagagtatcattatcagactcaggaagctaacattgctgtaacactgtaatctacagaccttactcaggtttcaccagtggtcccagcagtgtcctttagagcaaaagaataaacttgttttcttgttcaagacctaacccagggtcacacattgcatttagttgtcatttctttttagtctcatttaatctggaatggctgctttattctttgtttcttatgaccttgatacttttgaacagtgcgatcaagtgattttgtagactctcccttaattggggcttgtttgtgtcctcaggattagattcaggttatgcatttttggcagaaaatcacaggaaacacatgatgtgtcccattactggtgatgtgcattctgataagttggttaaggtttctctggcaggtttctccactgtaaagttactcttttttttttcctctttgtaattaatactacctcatgttaagactatgttttaactgtaaatattctgcttctcatcaaaatgaacatctactgatgattcttgcctgaatcaattattgactgtgattgttgtcagtgttcatttttctaactctatcattccttctacatttattagttgaccttctaatgcaagaaagctttctcttcttccctattcatttcttcatttatatcagtatggattcataggcctatttcattcagtgggttataattcattgtcgtcacaggaataccttaaatattgcaggttcagttctgcaccattgcagtaggtgaatattataataaagtgagtctcatgaattttttgatgtcccagcacatgtaaaagttatgtttatactgtagtctgttaaatgctcaatatcattgtgtctaaaaaccaatgtacgtaccttaatttaaaaatactttactgctaaaaaatactagcagttggccaggcgcaatggctcaggcctgtaatcccagcactttgggaggctgaggcgggcagatcacgaggtcaggagatcgagaccgtcctgactaacactgtgaaatcgcgtctctactaaaaaaatgcaaaaaattagccgggcgtagtggcgggcgcctgtagtcccagctaccgggtggctgaggcaggagaatggcatggaggcaggagaatggaggtggagcttacagtgagctgaaatcgcgccactgcactccagcctgggtgacagagcgagactctgtctcaaaaaaaaaaaaaaaaaaattagcagtcatctgagcctccatcttgttggtggagggtcttgcctcgatgttgatggctgctgactgatcagggtggtggttgttgaaagttgggatgggctgtggaaatttcttttctttcttttttttaagagatggggtctgtttcccaggttggtcttttttttttttttttttttttttttgaaactgagtctcctcgctctgtcgcccaggctggagtgcaatggcgcgatctcaactcactgcaagctccgcctcccgggttcacgccattctcctgcctcagcctcccgaatagctgggactacaggcacccgctaccacgcccggctaattttttgtatttttagtagagacggcatttcaccgagttagccaggatggtctccatctcctgacctcatgatccgcccgcctcggcttcccaaagtgctgggattacaggcgtaaaccactgtgcccggacccaggttggtcttgaattcctggcctcaggcaatttttcttttctttttttttttttgttttgagacgagtctctctctgtcgtccaggctggagtgcagtggttcacccagttcactgcaagctccaccccccgggttcacaccattctcctgccgcagcctcccaagtagctgggactacaggtgcctgccaccacacctggctaatttttttttttttgtatttttagtagagatggggtttcaccatgttagccaggatggtctcgatctcctgacctcatgatccgcccgccttggcctcccaaagtgctgggattacaggagtgagccactgcaccctgccagcctcaggcaatttttatacctcagcctcctgagtagctgggattacaggcaagagtgattgtgctcagctgtggcaatttcttaaaacaacgaagtttgcctcgttgattgactcttcctttcacaaaagatctttctgtagcatgtaatgctgttttatagcttttttttttttgagatggagttttcgctcttgttgcccaggctggagtgcagtggtgcagtcttggctcactgcaacttccacctcctggatttaagtgattctcctgcctcggcctccctaagtagctgggattataggtatgcatcaccacacctggctaattttttttgtatttagtagagacagggtttcaccatgttggtcaggctggtctggaactcctgacctcagatgatccacccgccttagcctcccaaagtgctgggattacaggcgtgagccactgcgcccggctgacagcattttttaaaatgtcagccaggtgatgtactgatgttctaacaaggttcaaggatggcacatctcacatgtaagcgtgaacacccaatgatcacacttatgaactacaaaatgatctgtttgatagcattttacctagaagaaagaactactttctttttttttttttttgagacagtctcactctgttgcccaggctggagtgcagtggcaccatctcggctccctgcaacttctgcctcctgggtccaagcaattctcctgcctcagcttcccgagtagctgggattacagatgtgtgccaccacacccgcctaatttttgtattattagtagagacagggttttaccatgtcagccacgctggtctcgaactcctgacctcaggtgatctgcccgcctcggcctccaaaagtgctgggattacaggcgtgagccactgcgcccagccgaaagaactactttcaaaattgtagtcactgttctcaaaccctgccactgtgttatcaaataatttttgtaatacttctaaatccttgttttcatttcagcagagttcacagcatcttcagcagtagattcatctcaaaaaaaaaaacaaaaaaccttctttgcttatctatcaaagcaactccttatccattacagttttatcataagattgaagcagcccagtcacagcttcaggttccagttctaattctagttcttttgctctttccaccacatctgcagttacttctaccatggaggccctgaactcctcagagtcatccatgagggttagaatcaacttcttccaaactcctgttaatgttgatattttggcctcctcccatgaatcacgcgtgttcttcatggcatctagaatggtgcatcctttccagagattttcagtttactttgggtccttcagaggaatcactatctatggcatctatagtcttataaaatgtatttcttttttttttttgatacagagtcttgctctgtcacccaggctggagtgcagtggcgcgatctcggctcagtgcaacctctgctttccaggttcaggtgattctcgtgcctcattctctcgagtttctgggattgcaggtgtgcaccaccacgcccagctaatttttgtatttttaatagagacagggtttcaccatgttggccaggctgatctcaaactcctgacctcaggtgatctgcgtgcttcagcctcccaaagtgctgggattataggtgtgagccaccacgcccagccaaatgtatttctttttattttattttagaggcggggtctctgtctgctgtccaggctggagtacagtgacaggatctccctctctcacccagacctgcagtgcagtggtgcgatcactgctcactgcagcctctaccacctgggctcaggtgatcctcccacctcagcctcctgagtagcttggaagctgggaccacaggtacgtgccaccacacctgactaatttttgtattttttgtggagacggagttttgccatgttgcccaggctggtcatgaactcctgggctcaagcagtcaacccatcttggcctcccgaagtgctaggattagaggtatgagccactgtgcccaagcacccagctaatttttagaaatttttagtagagacagggtcttgtcttgttgtccaggctggtatcaaattcattggctcaagtaatcctcccgcctcagcctgtattcttgacagtttgggagggtgaggtgggaggatcaccttattgttattactcttaataataagacttggaagttgaaattactccttgttcaatgggctgcagaatggatgttgtattagcgggcatgaaaacatcactaatctccttgtgtatctccatcagagctgtcgaaagactgttgtttgataaatatatttttttgagatggagtcttgctctgtcgcccaggctggagtgcaatggcacgatctcggcttagtgcaatcttcacctcctgggttcaagcgattctcctgcctcagcttcccgagtagctgggattacaggcgtacaccaccacgcctggctaatttagtatttttagtagagatgaggtttcaccatgttggtcgggctggtcacgaactcctgacctcaaatgatctaactgcctcagcctcccaaagtgctgggattacaggtgtgaactactgcgcccggcctgttgtttgatattgtttgaacttttatcaattatcttagttagatcttcggagtaacttattgcagcttctacatgagcacttactgcttcaccttgcactcttaggtcacggaaacggcttctttccttaaacttcatgaaaaagccttgctctggattaggctttggcttaagggaattttattttgtggctggtttgatctatccagatcactcaaacttctctgtatcagtaataaggctgttttattttctcatcatttgtgtgttccctggagtcacatttttaatgtccttcatgaacttttcctttgcattcacagcctggctgtttgactaaagaggtgtagcttttggcttttgacacactaagcttaattatttctagcttttgatttaaagtaagagacatggggctcttcctttcacttaaacacttagaggccattgtagggttattggcctaatttcaatatattgtgtctcagggaatagggaggtccaacaagaggaagagacgggaacagcaggtcagtggagcagtcagaatacacatttactaagtttgctgtctttttttttgtgcgtgtgtgtgtgtgtgacagagtttcactctggctctcggctcactgcaacctccgcctcccgggtccaagtaattctcctgcctcagcccctgagtagcatgcttcaccacacccagctaatttttgtatttttagtaacgacggggtttcaccatgttggtcaggctggtcttgaactcctgacctcatgatccacctgcctcggcctcccaaagtgctgggattacatgtgtgagccaccactgcatccagccagtttgctatcttatatgagcatggttcatgctgccccaaaacaattggaatagtaacatccaagatcactgattacagataccagaaaagacgtaacaataatgagaaaagtggaaatattgcaagaattaccaaaatgtgacacagaaacatgaaacgagcacatgctgttagaaaaatggcaccctggctgggcacggtggctcatgcctgtagtcccaacactttgggaggccaaagtgccaggatcagttgagcccaggagttcgagactagcctgggcaacatggtgaaaccttgtctctacaaaaaaaaatacaaaaaattagccaggtgtggcatgcacctgtggtcccagctgttcaggaggctgagatgggaggttcccttgagtccaggaggcagaggttgcagtgagccgagattgcaccactgcactccagcctgggttatagagcaagaccctgtctttaaaaaaaaaaaaagagagaaaaatggctcccatagacttgcttgacacagggttgccacaaacttcaatctgtaaaaattttattatctggtaatctagcactttgggaggccgaggtgggtgcatcagctgaggtcaggagttcgagaccagcctggccaacatggtgaaaccctgtctctactagaaatacaaaaaaaaaaaaaaattagctggacgtggtggtgtgtgcctgtagtcccagctacttggtaggctgagtcaggaaaatcacttgaacctgggaggcagaggttggagtgaactgagatcgtgccactgcactccaacctgggcaacaaagggagactccatctcaaaaaaaaaaaaaaaaaaaagcattatctgcaaagcaacataaagcaaagtgcaataaaatgaagtatgcctgcctttcttcctttttcttccttccttcctccctccctccctcccttcttcccttcctcccttcctcccttcctttcttttctttctttctttctttctttcttttctttctttcttgtctcacccaggctggagtgcactggcactatctcagctcactgcaacctttgctttccagtttcaagtgattctcgtggctcgttctctcaagtttctgggattacaggcatgcaccaccacacccggctaatttttgcttttttagtagagacagggtttcgccatgttggccagactggtctccatctcctgacctcaagtgatccgcctgccttggcctcccaaagtgctgggattacagatgtgagccaccatgcccagcctacatttattttaatgctcagtttgtctcatatttggccagagagagctccttgcagctgcctcctgtgttcttttggcatgtccccaacacttttggagactcccttacttttgtgctataaccacgccccgtgttcatcttgtgctttcttagcactgtacttggccatttctccaaggagcccttatacctttagtggagaatggtatttatttatttttaaaaatcagtcaggccaggcacggtggctcacgcctgtaatcccagcactttgggaggccaaggagggcgaatcacgaggtcagcctggccaacacggtgaaaccccgtctctactaaaattacaaaaattagccgagcatggtggcgggcacctgtaatcccaactactcaggaggctgaggcaggagaatggcttgaacccgggaggcggaggttgcagtgagccaagatggtgccactgcattccagcgtgggtgacagagcaagactccgtctagaaaaaaaaataaaataaatcggtcagatttagcagtgctggattgtatgccaactttttagtgacactaatattaataagtattgataacccattagcatcagaccagctgagaatggtatttagaaaccaagatttgggctcagggtggacatgctcagttaccacacgtcactacctgtgagttaccttgatttaatgtccttttgtaagcagctgagtatgttgtgggataaagaccgagaaataggccaggcgtggtggctcatgcctataattccagcactttgggaggccgaggcaggcagatcacgaggtcaggagttcgagaccagcctgacaaacatggtgaaaccccgtctctactaaaaatacaaaaattagccaggcctggtggcacacatctgtaatcccagctacttgggaggctgaggcaggagaatcgcttgaacctgggaggcggaggttgcagtgagctgagatcacgccactgcactccagcctgagcaacagagtgagactccatctcaaaaaaataaaaataaaaaaagaccgagaaataaaattactgggtcagaggttattttgatagatgttgtattatcagagtattttatgtggtgagattatttattctgaggatgttgctttgttgcttaacggtcataaccatggtttccccggcagtcatctttgtgtgtcataggaaaagagtgcattacttctagacatagtggtatgtttacattgcaactttcacagttatcatcacattgctttctgtgactctctttaataggcttagccaagaaaattctgaaaaaattatttcttgtatatgtaataaattgcacctcccaaattaaatatgcctcacatctgtgtgtcagttatccaatgtgtgccagtggttcgttggttggtaaagaagattaagatcttagaatggttatgacagaataaatattcaaccttggactctttgcattttttaggaagatgaactattttattttcctcaaatctattcttgttttttcagatagagtcttgctgtcacccagactagagtgcagtggtgcgatcccagctcactgccacctccgcctcccaggttcaagcgattctcctgcctcagcctcccgagtagctgggattacaggtgcttgacaccacccccagctaatttttttgtatttttagtagagatggggtttcaccatcttggccaggctggtctctaactcctgacctcgtgatccacccaccttggcctctaaaagtgctggaattacaggcatgagccaccgcacctggccaaacccattctttagagcactacttcttgcccatgggtgagttttgcctcacagtgaatatttggcaatgtctggagatgtttgtggttgtcacaaccatgggagctggggtgctgctggcatcttgtaggtaaaggccaggatgctgcttagcatcctgcagtgtgataatcacccagtccaaaatgtcagtagtgctaaggctgagaagctcattttagagtaatttgttaaaagagaagttgtatgaatgaaggagtgaaaccttaaatcttttccatcttataggtagacttgatacagatgatgggcaagggcatctaacaaacttgaaaagattatatgttgggggttctgctgaagaagactacatttgccacaggggtgaaaagtaagagtttggatcacaaaagtgagaggaggtcactttttctggctcgcttttcctggcttcttaatttcacgagtgaagatgtggttttcaccactgaagtgaaaacagacattggcacctcttgagcatgttaaatgtaaattttgatttgtttgcatgcagataggggttatgagcttgaaatcagttcatttctgttctacagaagacctcattttatttactcatctaatttatttatttatttttctgagatggagtctcgttctgtcacccaggctagagtgcagtgggcgatctcagcccactgcatcctccacctcccgggttcaagcaattctcctgcctcagcctcccaagtagctgggattatgggcatgagccaccatgcctgactgttgatttttttttttctttcttttctttgagacagtcttgctctgtcggccaggctggagtgcagtggcatgatgtcggttcactgcaacctccacctcccgggcccaagcaattctcctgcctcagcctcccaagtagctgagattacaggcatgtaccaccacgcctggctaatttttatatttttagtagagaaggggttttgccatgttggccaggctggtcttcaactcctgacctcaggtgatctgccaaagtgctgggatcacaggcgtgagccatcatgcccagccactcatctctttttaatgtcagtttgttgatatggtttgacatttcattgaactagaaatagacaaaggtcaaaatgggtaaggaatgaattttctcatagttcttttttgctgtttactttagcagaggaaggtttggttaattggctcccaggaaagagtaaatgtgtgcacatgtgtgcaggtgcttgtacttgtgatggaagcgtgcgtaaggtaaggagggttgtcagtgcagctttattttacttggaaaaggctacctttaaaagcaaaagacaacttcctacatccttcataagagcattggaaatcgtttgatgaattggaaacattttcactgcagctgatgtagttttcacagtgatttctggccgcaagtaatgttgcacaattcattttattcatggattagattttgtttgataaaatggaaagagagagcagaatctaaacttagggtagttttagcactctattcttgaccttgtatgaaaactggaatttttagtgttttattttttgggtaagctattcaaaaactgttggcctgtgaggtactagtcatttttttctaccctgtaataataaagtctgtctctgttttgtggcagccaccagattatgtgttcacttttattcagaacctaaaggcagtatcagcagggaatgagtatattgggcagaaaggctttcattttagccttttttagcctccctcctagcagagcctaggtttttcatgcgaaactaacagtagttctttgtgggaggtagggttgcaaaaaagtaaacaaatatactgtgatgttttccgcatcaaactagagctgaatttccattgatatttgatgagaggtattggcttgcaatctttctttttttttttctttttttttttttttttagacggagtctcactctgttgcccaggctggtgtgcagtggtgcgatctcaattcactgcaacctttgcctcctgggttcaagcaagtcttgtttcagtctcctgagtagctaggattacaggcgtgtgccaccatgcctggctaatttttatatttttagtagagacagagtttcaccatgttggccaggctggtcttgaactcctgacctcaggtgatccgcctgccttggcctctcaaaggtggcctggccaacgtggtgaaaccccacctctgctaaaaatacaaaaaattagccagatgtggtggcacgtgcctgtaatcccagctacttaggaggctgaagcaggagaatcgcttgagcccaggaggcagaggttgcagtgagccgagactcgtgccactgcactccagcctgggagacagagtgagactctgtctcaagaaaaaaaaaaaaaaaaaaaaaaaaaaaaagcggataggtcaacataactgcgtgtttacatggtttaatttaaaaacagaatctcaggaagctgctcctaatgttggtggtttgaaacccccctccccccattttaagtgattttatatgcaaagccttcttgtcttgcccaaattcaagaagttgtctttgtttctaggatgtgaaatcaggaaatatatgtttgttgaaatgtataaagtagtggtgaatttcagctcaactgatttgccagtatacagagaaaaacacctgttctttgagatacacagtgcctgttgggaatctgcaaaaattgtttgttggtagtcactaaactcttgttaccctgaattttattctctttcgcttcccccactactagcctaataaatatttcagaataataacaaagtttaaagaaagaatacttagcctgttcttctgaagtagtctttgtttttcttctctgtttactaacctccttttgaggataaaatcttatttcctttctttatcctgtagtttcctttgtacactcatagcctttcttcagatgcagattttgcagtcagataaaagtctctactttaagcaccaattaaatcaggaaaagatgatgggcctggagttattgtcttcaagttcctgattttgaggaaactctgattatgtcagtagtgcagttatctgatagtaaggttacactgtccaaataaggtgactttggaagaaaataacataaagccatctcatgatctggcagcctttcgctgtttcgctttctgcagagcggcattccttctgcatgtctctgtcagtctctgtgagagtggggtttctatccacacagcactgcggtgcagcttctccgtgttggcagaatcttccatgctctgctggttcgttgtctttccagctgtgctgtgcagtgcaatgtgctggctgctgagctcatgagacacggcccgtctcaactgagaagtgctgtgcgtataaaacacacaccaagtagagaagacttgataggaaaaaagtgtaaggctgggtgcggtggctcatgcctataatcctagcactttgggaggctgaggtaggaggattgtttgcttccagtttgaaatgagccggggcaacatagcaagatcccctctgagaaaaaaaagtgtaaaacatctcattaatttttatatcaggttgggcgtggtggctcaagcttgtaatcccagcactttgggaggctgaggcgggtggatcacctgaggtcaggagttcgagaccagcctgaccaacgtggagaaaccccatctctactaaaaatacaaaactcagctgggtgtggtggcgcatgcctataatcccagctactcgggaggctgaggcagaattgcttgaacctgggaggcggaggttgcagtgagccaagatcgcgtcattgcactccagcctgggcaacaagagcaaaactccgtctcaaaaaatacatacatacatacatacatacatacatttttatatcagttacatgttgaaattataatattttgggaattgcataaaataaaatgtattaatttcatctgtttttaatgtggctactagaaaattcaaagtaacatgtatggcatgccttctatttcttttggccaatgctgctgtttctgagagattgcaggttcattgagggggaatttgcatggtttgtttgttttttgtctgtatagtggttttgccaccatttccagggaattaggttgtgattacatttctctagtgatacatgaatgactgagatcttgtaatttgttttgttttgctagtgatgatggccaaagagaagccaccgataactgtagttggagatgttggaggccgcatcgcaatcatcgtggtatggttatatgtcatccatgtgcagaggtggcactcctggctcttggtcagtaggttgtccactctgggactgtatttctaggaacgatgatccgaatggatccatgtatcctttctcacccaaactcccttgtgccaagtggcagaaacctgtatccaggtgaacatacattaaagtataacctacagataggaaatgagcacagtactcccgtgagaaaattcagcaccttcaccttcatcatgtggattctaggttctttaaaccagctcacctaatcatgcttgagcgttagggccgaaagatgaactgaagatgagctgttccgttttcacaagtaagaatgggtgtccccgtgcagactcgttctgcatgttgacatactttttttcccagctctaaatatctgctggctagtgggtcatgagtcctttgcagtagcacactttatttcagttttcttctcatgtcacagtctatttgaaaaaaaaataaatggaacgctggctatgtgggattcaccagaaacgtgagacaggaaaatgagtgttggcaatcctcagctccagccgtaatgtcacaggtgcttgactgcgcccgcctctgacagacacacaaggtactgtcaggtgcttctgttgccatttctggatgctcgttctttgacccaggcacacagctctgattttccatcagaaatcctctgaaactgagtgcagaagagagtagagtggtgtgtgcattgacagtatgggctagagggtgtttctttcctaccaactcactctgttctcctcccaggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtcaggctgcttctaaatcttgagccaagatttactgctgtgttttctgggaataataaaatgattcagtcaatactaaattgcttaatctgtctatagcttttctagcttttgctggctagcagttcgttgggacagatacatgtttaggaatacagatagtccacgacttaccatggttcaacttagaagtttttgactttatgatgatgcaaaaccattgcaattacgatgtaatgtatagtattcgataaattacttgagacactttattttaaaataatcgcttttattataaaatgaaagcctttgccctagatgattttgccacctgcagtctaatgtaactgttctgggcatgtttaaggtagggctaggccaagttaatgatgtttagtaggttaggcgtattaaatgcttttttttttttttgagatggaatcttgctctgttgcctaggctgggagtgcagtgtggcaatctcggctcactgcaacctctgcctcccgggttcaaacgattctcctgtctcagtctcccaagtaactgggattacacgcgccggccaccaggcctaatttttgtgtttttcttagaaacggggtttcaccatgttggccaggctggtctcaaactcctgacctcaggtgatccacctgcctcggcctcccaaagtgctaggattacaagcatgagccactgtgcccggcctaaatgcattttctacttaaaatattttcaacttataatgatgcgtttatccagacataaccctgtcataagttgagagttatgttgagggtctgtatatgtctatttgcataacggtttgcttgggtactttaatttgacaccctaggagcatttctcttgaggctggaattcttcccttatgatctgagagttttgcatagcactggggctcactgtgtttctgcatggagaccatgccattcctaagatttttgtcttgtgttctgaggccatgtaacttttcctttgcataaaattagttaattttggtttataaaaactatactcggtggaacaaggttttgtagtttggaacttaggctgtgggaactcaatgttagataagcttttctgtgtaaccagcttggagaacagacttcagtaacagcgtttgttttccatcactgtgtgactaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtcttgctagtcttttcattagacagcagaagaccatggatacagaacagcagtcaggtctgtggctggacacaaacactttcccaggttccaccctcttcctaagtgttgaagctaaatccttgttgaatactgtattttaaatctttaaaaaaaaaaaaaaaaagtctaggtgtggtggctcacacctataatctgagtactttgggaggctgaggcaaggaggattgcttgagcccaggagtttcagaccagcctgggaaacatggcgaaacccccatgtctacaaaaaatacaaaaattagccaggcattggtagcatgtgcctgtagttccagctaccttgggaggctgaggtgggaggattgcctgagccaaggaggttgaagctgcagtgaactatgattgtaccactgccatccatcctgggtgacagagcaacaccctgtctcaaaaaaaaaaaacaggccagggatcgtgtcttatgcctgtaatccctgcactttgggaggccgaggcaggtagatcacctgaggtcaggagtttgagaccagcctggccaacatggcaaaaccccgtctctactaaaaatacaaaaattagcctagctaagttaaaagcataaaaagactacaaagaggccaggcatcatggctcacgcctgtaatcccagcactttgggaggccgaggtgggcagatcacttgaggtcaggagtttgagaccagcctggccaatatggtgaaaccctgtccctactaaaaatacaaaaattagccgggtgttgggggagggggtgcacgcctgtaatcccagctactcgggaggctgaggcaggagaattaattggttgaacccaagaggcagagattgcagtgagctgagattgtgccactgcactccagcccaagtgacagagcaagattccatctcaaaaaaaaaaaaagactgcaaagaactagttattttgataaccccttaaaggcctactgtgtcccaagttattggaatataatgatgatcgaaaatccttcaattaaataaacagtacctctcaggctgaagtgaaaaatctgaacttgaacagtagttaaaatagtacagttattccttacaatccatgggtgattggttccaggactcaacctcctgcccatggatgtgcaagtccctgatagaaaatggtgtagtatctgcatataagctatgcacatcctggatgacttgtaatacctactgcaatatcctgtgtagatggtggtcatgctgtattatttagagaatcatgacaggaatctgtacgtgttcagtcgtggttggttaaaactgcagatgcagagctcacggaggaggctggccagcatggcacacattcataggttctctttaagtagccttgctgtgcttctgttaggaagttttatttatacgtttttgggaagaatcttgtatggggaagtcatgtctcaattgttaacaccagatttgtctcgtgctgtttaatcctgctttgtaatgagctcaagcacaggcgcttgaccaggtgagtggtttcttttcttttctttttttttttttttgagacagagtcttgcactgtcgcccaggctggggtgcagtggtgcgatcttggctcactgcaacctctgcctcccgggttgacgcgattctcctgcctcagcctcccgagtagctgggattacagatgcgcggtaccatgcccggctaattttttgtatttttagcagaggggtttcactatgttggctaggctggccttgaaccccttacctcaggtgatccacccgctcggcctcccaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15681 - DNA, 80269 bp, Human
gaatgtatggctcaacaaatttcccaatctcttttaatctatagattgaccattcccctctttttttcctttggaatttgataaagaatatatttgtcttgtaccgtttcccacagtctgtactttgccaattgtttttcatggtgtcatttagcatgttcctctattctgtatttcctgtaaactggtggttgcatctagaagttcagcaggtcaggtgaatttttttttttttttttttttttgacacggagtcttgctggagtccagcccaggctggagtgcagggcaggtggcgtgatcttgcctcactgcaacctctgcccaggttcaagtgattctcctgcctcagcctcccaagtagctgggattacaggcatctggcaccacacccggctactttttgtatttttagtggagacgaggtctcaccgtgttgaccaggatggtctcaaactcctgacctcaggtgatccacccacctaggtctcccagactgttgggattacaggcgtgagccaccgcaacggcgttaaagcgtcttttgaaggtggatgtgattttttttttttttttgggacggagtctcgctctgtcgcccaggctggggtgcagtggcgcgatctcggctcactgcaagctctgcctccagggttcacgccattctcctgcctcagactcccaagtagctgggactacaggcgcccgccaccacgcccggctaatctgttgtatttttagtagagacagggatttcaccgtgttagccaggatggtctcgatctcctgacctcgtgatccgcccacctcggcctcccaaagtgctgagattacaggcgtgagccaccgcgcccggccggtggatgtgatttctacaaacaagcaaaagccagtcagactgaatgtagtgaataatgtaggtgacccagctggaagatgatggtttgacgtggaacacaaggggtgatgaggccatgaatgatttgcttgtgtgtctggtaaactggctttgatggaaattcctaaacaggtccaaaaacgttctgtccaatggcagcatgaaatgtacagccactcagggtgactaatgtgaacggaacaacagtgactttgacagtgaaattgcatgttggttataaaaccagctttgctgtgtgggtgggcatgcgaggtgcccctttctagtcatgagctcctcttaaggaccccaaaatgtctcagtggtaccggattgaaaattggggctggacggtgctctcctgctgaaattcgggagctacttagcagccccaccttggcaccctcgtttccgaggggcaggccctgggcgcgcgtctcagtttcaagcccgcggcccgacactagagccgtctggatgtgttgacaaggatgccgctgggctccacccgggctcacccgggccctcccgagccctgggccgcgcagcaccggcgtccgcctcctccccattactcggcgagaatgcggtcggggcactggcgcgagcagcctggtgctcctgaacagtcaacaagaaatgaggaagcacgggggcagccgccagggcgaccagaggcaggcctcagagcagcagccatacgggagggccccggtggttttgacctcccgcaaacttcccttttcccgctcagccgaacccctcccctgcacgccggcagccccttggggcttcactccgcctccgcccgctactcgcgaagcccagcccggccccgcccccaacaagtgacgcaaaactgggaggggccacgaggacctcgggcacatccagcagtgcgacggggccggcgccttctccgagctcctcccacgctcgcgggtcggagctcgcgcctgcgcagttcgggccccgggtgtcctcccccctcccctttcttagcaaccatcgcccgctcccgcccccgctccctcggccgcggccgcgcacgcgcgcccctcccggcgcccggccccgcccaccccgtcacccgtaacaaccacaagtgccgtcgccgcgccccttccccctcccgcctccccggccccctccccggaaccggcggtcgagctacggtcgcggagcagtggaaccgagactgccccgcggagccgccggtatgagcgcccctcgccaccccgtgtcccaggcccggcctttctgacaagaggtaggcgcgtcgtcgcggcgggtccgagtgcgccctcgccccggtcccggtctccgtggagtccggcgcctctcgggcgggccccccggaactcccggccgcccgcttgctgagcctgtccctccccagccccggctgccatcggcccggcacccgaaacgggccgtgcccccgcccccctgctcgccctccgcccccctgctcgcccctcgccgcccctggcccccctcccccgcccccacccccacctcgccaggcttccagttcccgggagccgctttttgctgagagcggagtttcgggtccggagccagtgcccgcccctctctcccgtcggtcggggctttggccccgtggggctcagccgcgcgggacccctgctgagcagccccgggcgccggccgcccctcgagcctgctcgggatgcgttcagtgggtctggcctttggctcctgtttaaacagcgattgtcatgcaatggaggccgtccggctcctggatgccacttggtcgttgtcactccggatgcccgcgtagggcgtttatctggaccagagcatcggcagctgagacctggctgtggttcacaagctcgtgaattagcaggttcttaagtgagtgtagccagttctgccaggcggtggaatcctgaatggatgttaccgtttcttaaacgagcattacgcttttttgcttcttcccccaactcttgtttgtacccggttatcgtcctcatatctgggagagtaccctaaaattaatattcccaattaaatttttaaaagatgattggattcccactgtgcaccaacactgtaaggtttgcaaaagaaaaagaacgtggtcccagcacatcaggatgtgtcagtcgcataatcaagatgaatattagaaaagcttcaagttgagtttggagaacttgggagtttggctctcattctcatggttttagaggtggaagtctttcaagatcatctccccgaaaacctcattttacagagatgaaactgagtcctagggaagtcaaatggcttactcgtggtcacccagagtcattccttagccgttttcacactgtcagatggcgatgttttccaccatgacctctcctctgagaggtatgccagacataccagagaaagttccaaacctgtttaaaccttagtactatagatgggaattctataccaggcgccgtgactcatgactataatcctagcactttgggaggctgaagtgggcagatcccttgagcccaggagtttgagaccagcctgggcaacatggggaaaccttctacaaaaaatatatatggtggtgcgtgcctgtggtcccagctacttgggaggctgaggcaggaggatcacttgagcttagaaggtggaggctgcagtgagtggagattgtgccactgtgttccaccttgggcaacagagagacaccctgtctcaaaaaaaaaaaaaaaaaaaaaggaatcttggaagtttctgaaataaaatacatcttggtaatttgtctctctcttttttttttaacagctagacttcgggctccttgaggatattcagttttgtatgtttgaatatcctctcaccatgttcagcataaagtaccattcttaatgattatcctcaacaagacaggtaggctcattcgatttttctttctcactttaaataggggagacagaggactggcaagtccaggtgtgtttttagagcaatccgtgtaggctggcgctagagaatgattatgcacccataaggagggctccttgactgtgaattaggtgtgaacatttaaccgattacttacggatattagctatctgaggctagagatttcagtggagcctgtttagccagaatacttggcatctctgccactcgaagacaggtcgccaaagctgtagtgtacacagttagaaaataggaattgacacgtttcctttgaagctagcttttgaggagtattccatagtttgagatacagtagtatttttttccagttttatttttgttttcccagagctaatatcttaacacgagatcatttttatttggcttctagtagaagttgtttaagagaaaatgatccaagcattaattatattggttattagaataatagaatcataacagttcattgctggaaaggactcaggtcaggtcatgtaatgaatgcagagtcccagtaagccaatgagaggattggacccctctcacaccagtactgtttgcctcattgcattggggctttgtctgctttttcttattgtttaattacctccccctgccctcatgtatttaaatatcatcttttcatttttgtgtgcatagaattatgacctattgtggtctctttctgtcgttagagtgtggtatgatgtgtcagtgcagacttactaataatttgtttctgcattgtggttacttatcacatatatttatgttttgcaggtgtgagagggttgctgttgtattgcaatcatggtgcagaaataccagtccccagtgagggtgtacaaatacccctttgaattaattatggctgtaagtacttgacatttcaatttactctttggcttcttatttataaagtacagtgttagaatttgatgatctatagatttattgttcgtctccatggcatcacttgaacttactctgtttttatgcttatgaaccgtatctagagtgtgtaaaatgtttttaaaatacaagcctctgaaaataaaaatctgcttattaaaaaaaatgcacctcagggtaatgtatgaattgaagttaattctccctttgaacacacagaagtgggattctaagcacttcttcctcggggttgtgctctttttttccttcgttagagtagcaaagggacatggagtgtggtctttgctgctcgtgtggaagagtgctctgcctatgggtgaattcactttaggtggtgttagaactgagcactgtgcgatggagttttactcacgattcaaatgactctgttgaatgagtttttccgttatttacctgaagaatttggctgaaaataagcattttactagatgcaaagcaaaccttttccagtcatttttagattaccgtagggtatttcttcttttcctttctcttttgtgttattattaagatataacatacataccagaaaatataatacagacaggagaatgtgtctttcatgagcacacacctgatgaaaacgtgtgtcacactcagcacacctgggatactggcaccaaggtcaggaaccagaacatggcaacccaggaagaagtctcccctggttcaagtgagccactgttttgactcctaatacacagaggactgttacctgtttctgttccttctataaatagaaacgcaggtgttttagcagctggctgcttctgctcagcgtatgtttgtgggatttatatagatcaatagttttgaaaaacaagaagtcctcttacgggaagaatttacatgacagggtttgttttaaaatttattttatttatttttttgagacagcgtctcactctgtcactcaggctggattgtagtggcgcgatctcagctcactgcaacctccatctcctgggttcaagcgattcttctgcctcagcctcccaaatagctgggattacagacctgcactaccatgcccgctaatttttgtatttttagtagagatggggtttctctatgttggccaggctggtctcgaactcctgacctcaggtgatccacccgccttggtctcccagagtgctgggattacaggcgtgagccacctctcctggtctatttttatttttattttttgagacggagttttgctctcgtccaggctggagtgcagtgacgcgatcttggcttactgcagcctctgcctcctgagttcaagcgattctgcatcagcctcccgaatagctgcgattacaggtgcctgcccccgcacctggctaatttgtgtgtgtgtgtgtgtatgtatgtgtgtgtgtgtgtgtgtgtgtgtgtgtatatatatacacatatatatttgttttgttttgttttttagtagagatggggtttctccatgttggccaggctggtcttgaacttctgccctcaggtgatcctcctgccttggccttccaaagtgctgggattacaggtgtgagccactgtacttgagatataatttacatacagtgaaatggtcacgtgtcaggtgtacagtttgattagttttaacaaaagaatccctcacacctttgtgaaaacacaggacatttgaatccatccccctggtgaaggttctgtggtgcgccttccctttcaggtgtgaggttttggtttgtgtgtgtgggtaagaagctctgtgtgttaagatgtctgtgtgttaagaagttacgtgtgttaagatgtagttacacatcttaaatatgtgtagctagggctgttaacagtattttatgttgttgacttaccatgtttgccatttgcatgttatctgtgctgttttggcttttggttgtatgaggcaaagacccactccagccagcttgggaaggagtttggtgagtgggaacatgtatagtgtgataggaatcacacaggaatccgggaattcgagctgggatgggctgagctccagagcctggtagtggagggaggttcctggctgctctgggggcctcagccacagtttttctctaggattttgccctgtgggactgtgcctggctccatgtgctggagccttctaccccgccaccagctggctgctttgctcactcctagttttccatgtggcttcagctcgaggacgtgcttagctgtctgaaagccctctggccccagttcaactctgtggcatttcttgttgcattctttcagtttctaagtgaccaattcctgtcacatttcatagttcacatccttgagagaaacttgatctagttcattccccaccccgacccctgccctggtcctgggtttgaggatattggctagcctgtggattgtttgccttaggtgggaggcctgacccttgttcagtgagctgggctggtggagctggggaggaggcagtgggggtggtaggcagtgggcatcgccaggtaaagtagagtggctgcccacggcccggggtggacacagggcagagagttgggcagggtgggggatgttctccaaaacacttgagtgtggcttaaaaagttcatgcaaccctgatagtttgaggcaaaggctggtttctttgccaaacgttagatttaataaaagaggaggtgtttggattgtttaacgttcagacttccttatttcccttacttcactattttcaaaattgtgacgtttaccttgccagttcatgcaggactttacagaagaactcgaaattcaaattctgagctgccaccaagtttttacaattaaaccattttaaaactattgttctgaggtagtggttaatttcccttctttttctttctttcttctccttttttttcttttttttatgatttaaaacttactagttagaaacttttttttttgcctcaccagcttcaggaaattttcttttgaattgttagaaaaacaaacaaacaaacacacagacgcacgcacacgcacgtatattcttccaccctgtagtataaagaaaacatttttaaatccgaaaatgaaatatgttacctttttccttccaaaagtagactgtgagtgatgtttgtgtggtgtcctttgcccccatttcttactgtagttttatggtataaaatcctcagtatttgcttaattttttttgtcattgaggaaaactaacagtaaaatgagttaacctgaaaatgcccttttcagttcagcattcagagtgaggaaagaggtatatatgcagttaaggtgagaacggaaccgtagcttccgccggcggacttgtgagcacgtcagaaagcgaatgtgcctcactagaacgcacggtggcggcaggagtggccggcagtgcccggcacgcagtcacgggaggtgggtcgagtcctggtttatgtgagtcctgtgaggtgagagagtgggagaaaacgcctcactcaacttaatgcctttgtttgtttgttttaaccaagagtttacttgtaatttagtattgccggaaaattgttcaggtaaaaagtgcctagtataaataggtacacagtcaggtcagatatgttaattgcatctcacttgatttaatgaaaatttaccatttgttttgaggtcagtaccattaaaaaaaaaacatgttaaagttctcattaactcgcttgagtggtatttacataagcaaaattgaagtggaggtttttcagtaggcatttgcatggtgttgttttgttagatatcagcccagaaacagaatgtcagagctttcagcgagttggagcaatcacctagctcaaccctcccttggagggcggggaatctgagactccgaggtggtgaaacttacacaggtagtgccgagatctgattctcgagtttagtgttcttttctcatactatgcttcttccttctacccagggatgtgtacctgaaacattttatgaaagagaaatcaaaacttcttggccacacacaaacgaaagcctcacacctgacaaggaaggcgcaccagggaaccttctggggggatggttgcagatgtcctgtgttttgacaaaggtgtgggggactcattttttaaattgagttataatttacatacaatgaagtggtcacatgtcaggtgtacagtttgatcagttttaaccaaagggctgctcttcctggcttgcggggaggagaaattaatcagtgaaggacactgattgattgtgccttaaagggtttaagatctcacgggagcatagtgatatgatcccacagattaggaacttagaatgggatgtataattctagggtgcttgagttgaagtgtttctttttgaaatttctaagataaagcacaaactttaaaagttaaacattgtcaagtgcatctccccctccccctgcatgttaatggttccttaataaaggcttcaaagggaaaatgaaggaggcgggaggccacctagtgtaggagggcagggtgggagaggtcaaggtcaggagcccttaaggagagttgtgggagagagggaagaacatgagaggccaccttctgaacccgatttttgtggtgacagccgcaggcgagatagtggcttggactctggtctttcttctgctgaggacagctgtcctcattgtgaccagtgggaacacacgatagaagaggctccattagctcctgtgcatcccaggagttgccaccctgtccagtgccgtttctgtctgggcttatttccattacacagcagatgtggtcacctcattctttgctctctcctttcctcgccctcatcccagtttcactgtgccctaggagtgctggctttctccaggaaccccttcagtgtctctgtcccttcagcagacacaccctttagactgtgccttcaggaaccaaggcacctggttctgtccctgtctgtcccagcactgccatcgttgcagcgtaagcccctccctttgcagggaaagaccaggggtcccttgttcctttgcgcactcacatctttcatcccttaggtcactttgtgctcccctgccacacactttccattgtgtgtgtcctgtgttgaaggctttcctgttatccgtcctcgcacgtctcagctcctgtgcttttttcggcaaggccatttgtggctgtgttctgcctggtccgtttaaccttatttcataattatgcacacttcccagcttgaacttgaacatttgtttctgtcttgttcccgttggcccggacacacagtgctgtttcctgccccctcttttcttttttcttttcagacttctttgcctcagatgtttgccattccccatctgtctctccagatcttacccatcttgtccttccacacgtccccgatgcctctgaagatgccattcatgtttctctcccttccccgggacacattcttaatgttggagttggtgttaggtactttcacttgcaatgggagtttctttattcacaaagcctcttgagtgttgctctcatactattttgtgtgtccttccagggcagtgaccttgacagttatttgtcttgttctcccaagcgcgggtgctaaggacatagtctgtgggcatgcagatgtgtgtgacttgttcacacgaactgtgaggatgaggacttggtgaatggtggaaattcagatccaaactgtatctccagggcatgatggcgcctgtctgtagtgcagttacttgagaacttgggagggtgagttgggaggatttcttgaggttccaggagttcgagaccaacttgggcaacatagcaagatcctgtctctataaaaaaataaaattaaaataaatggtcatggtggtgtgtgcctatagtcctagcttctcaggaggctgaagagagaggatcctttgagcccaggagttcaaggctgcagtgagctatgatcacaccactgtactccagcctgggttacagagcaagaccctgtttcaaaaataaataaggaaataaaatgcatctctaattctgttttcagacaagagatttatgttttctacatggaacagaagtaacatgctatggtctttcagttaaccagtgggtcacctgggagcaaagcccttttgtgataaagttggctgatttgtgttttttttttttttttttaattttcgtaaacgttgcaaaaccttgttggtaaacactctcctggcagtttaagtggtgtgcttttccaggttgaataaccaaaaaacctgcttaccagtgtataggttttgtttttgtttttgtttttaaatactgctccttgcggagcagggctgacccacaggcagtgctctcagagtaaccacagttgtcgattaaatggcccgagtacaaaagaatttgtttcgctctcctgctcctcttgctttattttgttttgtactctggcatttggggttttttccccctttcctctcaggtgtctcatgtcttcccattaagaccggaggaaggaagagaaagagatttgctttgaggccaggtacaaacctgtgcctgccacagaccagctttgtaacctgctaggccagtgactagtgtaagactgctgtgaggaggtgctggagtgaaacagacagcaggggtgagggtaggcaagggcgacctggtgatgccacagtctccccctctcccttccagataccctgccccttctcacctccaaataccaggggaactgaatcagtttataagtgagtaaatgactatgaatgtgcatctctgttagatcaaataggcatttatattgaagctctttcatccattccaatttcatatacaaaacagggagacgtgagggatcccaggatggactcgcgactcatatatcttacttcagggtgaggagacactgctcttccttaatcagggcctccgtggagtgcgaaatgcccgagggagaacactttctgacgggcagctgtgcccatgttgggcagctgtgcccatgtcgttcctctggttggttgggcagggggcacaggtcctgctttgccctttctccatctttgtggcagctagctgcgttcagaaaccatccatccgcccacccgtaccttgcctgaatattctctgagctgcctgtccccttttctctaactttttcttcctctgactgaggtcctgtgcacgtcagattttcagcattgttttagttacaggaaatattttcagtccatcgttcatcttctcagagcatgtcttctttctctcatcctggatttcatccttgggcctttttgtatttctgattctggtttttttagtttctgatggttaggtgtgatattgaaatacatcttttcattcatcaaggtattcttagatcttccagcagcctaatgtgcagtagaatttgtttttacccaaacgaataagcaatctactttttggggtaggtgacttaaaacccaactttgttcaagtctggaagtggagggaaatgttccattttctcctatgacatataaaaggacctggtcaatcagtgggagactgtgctgccctcgtttgtaaagttgtgaatgccatcgcgtgagtcctattgcatttcatcaaagctggggtggtgtaattagtcagatttagttggttttgaaaatggacaattagagtgagctttcatcacgtgctcctttgtacagagccagaccttctcccttgtgttccgtctcagcattatgcattccagttggtttttccccatgcttttcctgagctgtatccaagtgtctttaatgcgctagagtgaaggcagttgtggtgcagtaggaaaatatttcaagcagaaataagatgtatcagattcagcttctcgcctctctgatttacctggttttataaaaacaaacaaaccccaaaaccttgttttatggaaaatttcaagcatacacaggtagagagaatcatataataaatgccatttacccatcacccagtttcaatgttaccagcatcttgccgggcctgacacagtggcttatgcccgtaatcccagcactttgggaggccaagtggggaggatggcttgaggccaggagtttgagaccagcctgggcaacgtggtaagaccctgtctctaaaaaacaaaacaaactcttgccaatatttttatcagttgtacccacttttttctttcctggtgtattaaagcagatttcaggtatcttgttaatttgttgacaaatacttcagtgtacatctctaaccttttgcttatattatttttatttttttgagatagggttttgctttgtcacctaggctggagtgtagtggcacgattatagctcactgcagcctcgaactcctgggctcaaggagccctgcctcagcctgctgagtagctgggactacaggctcacaccaccatgccagctaatttttctttttttaaatttgaaattatattcctgttgcttaagattactaaggcagacttttttttaaaccaaaatattcagtctccatagagactgtcagaaatggtcagtgctggctgggcacggtggctcatgcctgtaatcccagccctttgggaggctgaggcgggtggatcatttgaggtcaggagtttgagaccagcctagccaacatggtgaaaccttgtttctactaaaaatacaaaaatcagccgggcgtggtggcaggcagctgtaatcccagctacttaggaggctgaggcaggagaatcgcttgaacccaggaggcagaggttgtagagagccgaggtcatgccactgcactccagcctgggtgacagagcgagactccgtctcaaaaaaaaaaaaaaaaaaatggaaatggccggtgccagctctattgcaagttatcttgtggtattgggaagttttcaatgagcaataatcacgtctcgggtaaacctcactgactatgatggggccactgtgcagagagcctttctcctttttaaacacagccgccatgttgttatcccacctaacaaaagtactagtgatgcctgatgatcatctaatacacagttcacgttcatgttttctcacttgtctaaaaaatgtctttcataagttgcttggatcctgcttcaaataaagccatttgtatttggttattatgtttcttgggtctcctttattctctaacattctccctttccttttgtttcctttcatgccattgatttgttagagaaactgggtcatttgtcctgttcagttaccttaaccttttgctgatttaattgttccttacagcaaataggctgtaaggagaaggtgtggacctaaattcaatcaatgcagccaccctttagcagttctctttatttatttattattattatttttttgaggcagagtttcactcgtcacccaggctggagtgcagtggcgcaatcttggctcactgcaacctccgcctcccgggttccagcgattctcctgcctcagcctctgagtagccgggactacaggcatgcgccaccacgcccggctaatttttgtatttttagtacagatggggtttcaccacgttggccaggctggtctcaaactcctgacctcaagtgatccaccctccttggcctcccaaagtgctgggattacaggcgtgaaccactgagcctggctagcagttctgtttaaacatttgctggcagagatggaaactaatagttaaaaccagctgctccccttttcttcctaggattgttctatataattttgagttgcaaataagatgcaaaatatttttttcccaaattaaactaggccattctatttatggttactccttatttatttatttttgtagttactttttaacactgaatgggtcctcattttgtactgaaagcaggtgagagggattaatttattggcagcgtttctatgtagtgcatgcagcaggcacttggcaggagtctggcctggggctgaggaggtgggtggtgtttgtggtctgaggtgtccagttgtgctgggcagtcagtccttgccctcttctgttgtctcttttattagagctctggatagggctgttgggctgcctggggaagcttccccagagaagttcactgtagagaggattttggttggcagatgttataattgatccatctctcttgatttttgacctgtacgctagtgaagcagacacttttatatagttctagtggaattattttgcatgttgtaacaagaagcatatattgcgttgtaattttcttgcatggtacaagttgatgtaagaggacagcagccctctgtatccttgtgttctgcacccacagatacaaccaaccgtggatcagaaatgttcaggaaaaacaacaaaaataatacaacaataaactgtaatacaaataaaacgcatgcaacaactatttacatagcatttacattgtatttggtattataagtaatgtagagagaatttaaagtgtacgggagggctgggtgtggtggctcacatctgtaatcccagtgctttgggaggccaaggcgggagaatcacttgaggccagtagtttgagactagcctgggcaacttagcgagactctgtctctatgataaactgaaaaaaaattagctgggtgtggtggcgcatgcccgtagtctcagctactcagaagacttgagacaggattgtttgagcctaggagtttgaggctgcagtgccactctggcctgtgtgaacagagcgaggccctgtatctaaaagatgtgtgtctgtgtatatgagaggatgtgtgtaggttaaatataaaatgtaaatgccactccatttttatatcagggactggggcatccacaggttttgggattggagggacatcctggaaccagtcccctccagataccgagggaggactctactggccccttctggttttttttgttttttttttgtttttttttaagaaaagtctgtctctataattatgtatcaatatatgaaataattgctatgtgtatctttatatgtactggatccattttccattcagacatctgccctgtttttcagtgatctgtactgccatgtgtatcagtagaatatccgaggtactgataagcgtccagtttgtaaatgtcttgtgtatttcagtagatggctgcgtccttacttcttttccttttaggggtccggccttccccttctgatctggactttctttattccactttcttgccttattaaggtgcggatggattgtttgttccttttcctctgattttgctgtttggggacccccagttgtatattttgcattttctggcaataataggtgttttaatgagcagttaatgctattttaggcatagctatctggctctcttactgggcagcacttcctgggcagccccatttaaacctgtggcttcacctgtcactttataaactaaagatctcaaagctttgtcttcacccgagatgccccccaggagcttccaaactccaagccaggtgtctggcagacatctccatttcactgtcccaggcagatttaatgcctctgaaacagagttcatctcctcttgcctgcgcaaaaaacacacaccccaacagaaacaaacacacacccacacccacacacccaccccagtaaaaaccaaaccaataaaacaccactcagaagctctccctttcccctgagctgctgctttagatgtgtggccccgcaggtaccttaccctcagagcagaaatccaggcatccctggcagccttccttcctcacccctcagtcttgctggtgcccagatgggagctggcagagatgtctcctggatgggcgctcactttgctcttctgtagccttggtggcttagccccagaccactcctccttacaacagcctctggaccctgagtctacccctcactcttctgctcgtccttggggctgctgccagagagatcggtacattgtaaacttgactgtgctgcctgcaagtttcaaatgatgaagtgcctgcacctcatctttatttatttatttatttaatttttttgagacagaatctcgctctgttgcccaggctagaatgcagtggtgccatctcggctcactgcagcctccgcctctctcctgcctcagcctcagctgggattacaggcgtgagccacttcgcccagtccacgtacctcatctttaagatgaggttcccagcttaagcttggctcccagaatcctttgtcattggccttctgcctgtcctgcagcctcctctccatggcgaggcctccacacccactgcacagtctaattatgtcgaatttcttgctgtttcctaggtataccattttttgtcatgatcttggtgccttgaccacatacttgcctggaatacctttcctgctttctcacctggctgactctagctggctgcatgcagttgctcctggtggaggttcctctctgtgcactggcagccgctgtagggtcctgacactccactggtctctctgcctctctctgtcaccttccctgcaactgccagtgttcccagggtgagaatcaaatcctcatgccctcaaaaatagatttctcggccaggcacggtggctcacacttgtaatcccagcactttgggaagctgaggcaggcggatcacttgaggtcaggagtttgagaccagcctggccaacatagtgaaaccccatctctattaaaaatacaaaaattagctgggcgtggtggcgtacatctgtaatcctagctactggggaggctgaggcacgagaattgcttgaacccaggaggctgaggttgcagtgagctgggatcacaccactgcactccagactgggcagcagagcgagactccgtcttaaaaaaaaaaaaaaaagatgtctatgaagagtagagggtcttgcagtgtatgctttcgtttcttgcatcacttcttctctgtcagtgaaattttgttttttgttttttttttactctaatcccatgacataatgaaaattttgacaaaaggttacattggaacatagtcgtttggtcggctgtatttactatttatggttcaaaagaatctgatgcaaatcatgttttgtgagtaaaatagttcagtgaactgaagcttataatccctctagttgcctgaaaagcgtgtcctggtttatgtgtcacttagtgttttgagtggcttttctcctgtagtgatgaatacaaagtatatacaaaatcctatttctttggttctcctacagaacataaatttattttaagtaaaattcttgactctggtggaatggtaatctgactttaagatttctccaaatttaaaacccaagagttattacataattcttgttttcttaataaataagttattccatagcatgaggtaggcctaatcacaaaatgtgtgtgtttcttttctttttcctagtttaatgcttgtgtatgtattaaaaatcaaggcccagaactaaaagctacagggtacatattttaagaagtaaattgatttaagtggtcattggtatgttgcaggatttatggcattaatatttagaaagctcttctccaaacacgtattatcttcatttgaattttctcacacaaagttggtttataatgtaaattcgaagagttccaaatcctaattcttcactgagtcagaatttctggaggtgagtcccgcagtctgtggcttcacaaggcttccaggtgattcttaacgcctgctcaagctggagaacccctggtgtggatttgcatcatttgaatttgtagtacatgggataggaagaaaggagggtggtttctattataactttttttttttttttgagatggggcctcgctgcgttgcccaggctggagtgcagtggcatgatctcggctcactgcagcctccacctcccaggttcaagcgattcttctgcctcagcctcctgagtagctgggattacaggcatgcgccaccatccccggctaatttttgtatttttagtagagacggggtttcaccatgttggtcaggctggtcccaaactcctgacctcgtgatgcgtctgccttggcctcccaaagtattgggattacaggcatgagccaccatgcctggccataacttttatttaaaagtttttcaaacgaatggtttttttcaacaggctgtataaataggctcttattacatcatgttttcatgtgacggatttaacatacactagaaggagactgtttgctttatgtacttctccaaattgctgttcttgagtttatttagtgatgtccacgttatattaacaagcatgtgggctgggcatgagccaccgtgcctggccataacttctatttttgtatttttagtagagatggggtttcaccatattggccagactggtctcgaactcctgacctcatgatccacccaccttggccttccaaagtgctgggattacaggcgtgagccatcgtgcccggcctgtaaccacttttaagtgcagagttcagtggcactaactaaattcacatcgttgtgcagccaccaccaccatccatctccagaactttctcatctccccaaatcgaagctctgtccccatgaaacactcattccccattcttcctttccccagcccctggcagccaccattctttctgtccctataaatttgactactctcggtacctcttatgggtagaatgacacttgaccttttgcgtaacttggtagttacttgaccttttgtgtaactgggttttttcacttagcctaatgtcttcaaggttcacccatgttgtagctttagtttttgggtagtacttgaccttttgtgtaactgggttttttcacttagcctaatgtcttcaaggttcatccatgttgtagcatgtgcagaattcccttcctcttcaggggtgaattgtactcaattgtatatgccacattctgaattgaattgtactcaattgtatctgccacattctgctcatccattgacttaccgatggacgttgggttgtttctaccttttggctgttgtctgtactatacatttttaaagtttcaattacattttatagctttctttcctttttttttttttttttttttttttttttttttgagacagtctcactctgttgcctaggctggagtgcagtggcacgatctcgactcactgcaacctccacctctggggctcaagcaattctcgtgcctcccaagtagctgggattacaaatgtgcaccaccacgcccggctaatttttgtaattttaatagagacagggtttcaccatgttggccaggctggtctaggacgcctggcttcgtgtgatccacccagctgtagtattttttttgttttgttgtttctgaaataaactctcactctgtcacccaggctggagtgcagtggcacaattttggctcactgcagcctccacctcctgggttcaagcaattctcctgcctcagcctcccaagtagctgggattacaggtgtgagccaccacacctggctaatttttgcatttttagtagagatgggggttcgccctcttggccaggctggtctcgaacttctgacctcaggcgatgggcctgtctgggcctcccaaagtgctggggttacaggcatgagccaccacacccggcctcttttcttcttcttcttttttttttttttttgagacagagtctcgctctgttgcccaggctggagtgcagtggtgcgatctcagctcactgcaacctctgtctcccaggttcaagcgattcttctctctcagcctcccaagtagctgggactacaggtgcccaccaccaagcctagctaatttttgtatttttagtagggatggggtttcaccatattggccacactggtctcaaactcctgacctcatgatctgcctgcctcggcctcccaaagtgctgggattacaggtgtgaaccaccgctcccggcccttgtcttttatatttgatagattccagatccaaaagacaagttccttgaggaattcaaccaccactattttattccatctgttgaaaatacagctttaatttacagctcatgattgccattgttgttaattttttaacaaagaaagaatagcatgtaaaagctggtgtggaatgatgagctgagtggtgacccacttaaataaaagggtgaactcctgtgctaagggaatggaggtggtagagaagatagagaattctgtagatgaccctaccccccgttaagtgttcaagtcatagtgttactcctgattttcttttctttgttcttcagagtgtgatttaaattttaagtgcttcaaggtctatgaagtacaacctgcacagtagatatttaataaacagtgagtgatcagtattttcctgatggattaaagcactcctattggcagcctactgactctgtggagttattattctggttcatgaaaccagataatatttccatagctcattgcattcctttatgtgggcaaacacatggcatctttaaaagctgacagctgcagttccctagaacaccaaatgcttttctgaagtccacaaatttctcttttacactctggaaagtaaaaccgtactctgccaagtccaggcggatctgaaggggaatatgcacactgctattttgttgttagagagagatttgtactcagtttgctctttattagaccaaaaatttttcagattaggaatggtttttgaatatcatgcatgttttggtttcctttggatgctttcagcatcatgtgattgctttaaacacatgaaaagcaaagagaaataaaacctttcatagccctgtagacattcttgtttgcctagggcttaagtgattgtggcatgcaaagtatttgacattcaagatttattgacggagaccaggtatcttaagtataaagatttgtatttaaagatgtgtatacctccatttttttctaactagtgtctttataattctctaacagggattggttgtctttgtacttttattttgataatcgaaaaactacatggatgcgttgagatcatctgtatagcatgcttacagctgagcactatcagcacatggttagcttttattttttgtggacaacaaataatactgttttaatggctgaaagtaaatacaaaaagaatagggatgaaattactatgtaagtgatgtgtttgagcgaactatagactggggtgcttactttgcagatggggagctgtacaaataaagatttaaatagagtaaaacgatgggagtagtgagtcatcagacagcttctgtccagtttgaaagaagctgtgcccctcctgttcagttccatattcattttgaaggggaaattggtcttcaacaaattgtcattttccccatgaaatgtatgttgtttacattttataattgtatgagcttttttgttttagaaactagtttgtttgcacctatttaagtaacgttataataaaaataactggccagtcaaggtggctcacgcctataatcccagtcctttgggaggccaaggcaggcagataactgggggtcaggagtttgaggccagtctggccaacatggtgaaaccctgtctgtactaaaaatacaaaaatcagctgggcatggtggcacccacctgtaatcccagctcctggggcggctgaggcgagagaatcacttgagccgcggggatgggggtgggatggaggttgcagtgagctgagattgtgccactgcactccagcctgggcaataaaatgatactctatctcaaaaaaaaagttaattaaaaaataaaaataactggtcaatagactgagttctgcaagggggaaaaagtaactggtcaacattaaaggttcaaggacacgtttctcttttaaaaggagggtttgtacatgactcaggcttcatgaaggatttctttgccatagagattttgctttactttcatgaatccaaatcagctgggtccttaaattggttcttttttttttttttttttttttttaaacaaccagaggttaaggaagggaggggaataaacatccttgtattttcctgtttgtgtttaacatgagtgcctggttggctcaagtactatattttaatttttgtttgtttcccttccctcccctcccctcccctcccttccttccttcctctctttctctctttctttctcttcttttcttctttcttcttcttctttttttttttttaaacaaacccttgtgttgagggctgactttcaatagatcgcagtgagggaggtgctctgctacatacaaatccccgacccagaattctgcaggtcgtctatgaatggtttagagccaggttccccacgaacatgggtggcccaacgggcaagggggcgactgcctttcccaggacgaggggctgtctgcaccggaccccagtcctggcgctcggcgggggagggaccggctgtctgaggccattggaggccaaccgaggccccacgggcactgctgtatccgtctgcctgggtgggattctgacttaaaggcgttcagtcataatcccacagatggtagcttcgccccattggctccttattgtggctcaagtatttttaaatatgggcaacccttcagtgcaaggaatcaaattagtactgatttgacagccattttaattgaagttgatattgactggtaaggctgagatgagaatggaaaataggaatgacagtgtcttcaatttcttctgggtgtaatttagatctgtgcaaagtaacatgatgtatattttgactgcattattaccacatggtggaaaggttaaaaaaatgtgttgtggaccaggtgcggtggctcacacctgtaatcccagcactttgggaggccgaggcaggtggatcacctgaggtcgggagttcgagagcagcatgaccaacatggagaaacccgtctctactaaaaatacaaaatgaactggcgtggtggtacgtgcctgtaatcgcagctactcgggaggttgaggcaggagaatcgcttgaaccggggaggcggaggtgtcggtgagccgagatggtaccattgcactccagccagggcaacaagagcgaaactctgtctcaaaaaaaaaaaatgtgttgtggattctcatagtcatgttttctttttcatgaaggacattttggagtgctttgtaggtgatgttaagatcctcacctaaaactatatcatgtttttacctttaaaagcttaaaacacttaaagctatttagtttgagaatattggccacgtaccagggagacaggggagttcggtatgccatcggccaataggacacaattctccagcagcttctgcctcctggactcttgttacttcctggaggggattgacgtagctcctgccgctgtgcttggtctggagcttgcagtggcaactgagccccttgagttctgctctcagcgagtatagagtctgtgaaaatcgatgatacgaattggacttaccctgtcacacccaactaaactggagtcgagggaccaggggagaagaaaagctgggacacagagcgtctgccccgggattatcttgaaggccagctgccaaagtgacctgctgtaactttaagaccagtgttaactccttgctgctgaaatgaattactgtgactctaagactggttcagtcagagcttgccagctcccaaaaacttcactagtaccaatgagttttcaaaacagtatgtcacctttctttcttttctttctttttctcctcctcttccctcctctttggttttatactttagctatgaaggccatttaccagagtcaaacttgttgttaacaagcagaatttttaagttcattcagagagtccctcagacttttctgagcctgttcacttgcagagagcagacgctgtcaccatgttcttcgtgtcatgcattcacatggatattcagtcttcatatgctgtcaagtttctttaagatcaaaggagcggctcgcagcggggccacatagatgatgacttttctctttctcataaaacccccagccttccgttttttcttcgcacataccgaagagcacctggtctttctctatgccccaagttgcaattctcttttcccaaatgaaactgttttagggattcagctttatatttttatttgaccttgacaagcccagggtgaagatgatactgcttggcctggagaggagcctgggctcctgggtggcagccagggatcctgccactgaaccgcaatttgcaaaatacttaaagaacatataacaggtctaagaacaacatttagagagtgcttgtgtggcaatatcttgtttattgcccacacttactttgtgggtaggctctttcatcccactttacaactgaggaaacaggttgaaattggttactaagtgattgccctgacctggctgcctcgcctgctgacagcggtgtgggctgacccggtaccgtgcccccgagcaggcagagcgcctgtgcccacctggaggccatcagcccacggcgctcaggcacttggctttcataattcccaacagggccagtttgcagtctttgctttaaaagacctctctgggagtcactctgaaccaattctggtttgagggaggactgcccaatttggtcaattaaactcaattttttgaaaaacctcccaatttccccccacctcttttcccttttgctctgtctggtgtgatccgtctccctgctgggcagtaaccctttttcccagcgctccccctttgttggtggctttccttctgtttgcttggacaggaggcctttgcttccaggttgtccagctgggattcaaatcaaggtccattgacacaagagcccaggctctaatttgctctgccatatgcctccccggtttgtgtcttagtcctagaatgacagtgctggaggagtggagggaaaggacacttggatagctgagttgcagacatgataattgggtgggtgcgggtgagggtggtggtgatgcggagtgggaggaagttgctaggaaagctgagcttaaaatagctgaaggccatagatactggtacagtgtggagtctggcagataattgtgtggcagagaaggcttttgtcctgagaatagtagatgacctcccagaactgtgggaacaacagtctcatgtttacatttattcaggccacaatggagctgagcaattcgcttcctgacatgaattctttctcttccaagtagatcgtgtttccttattctgtggaaaacgttaatgccattagaagccagattgagggctacctgtaaccggaaacctctgcagagaacatcctgttactcagtacccctttttcttcatttattttatgaaagttccctttccacttgactgatatttatcttcagggccatattttctccttctgtcaaccgaatatagtatacgtagctaatcaatgaattagataactaaatccatatatttcctcttcttctgtgaaccccgaatatctgagacaggtcttagttaatttagaaagtttattttgccaggattgaggacgtgcctgtgacacagcctcaggaggtgctgacaacatgtgctcaaggtggtcagggcacagcttggttttacttattgtagggagacaggagacatcagtcagtatatgtaagatgtacattggtgctgtccagaaaggcgggacaactcgaagcagggagggggtctccaggtcgcaggtgggtgagagaggcagccagaagcatttttctcagtgagtagaggggtgactttgagtggaatgggaggcagatttgcctcccagtttgacttttccttttagctgagtgattttggggccccaagattgattttcctttcacaatttatatgataaggggagtgttttattcccagtgcctgaactgaagtatgatcattttttttgccattatcttcctttggccttttcttttctctgtagaaggcaggagacctaatatgctcctatttatacctagttcctttttttagtcggctaattatttacttaaaataactggttcctagcaaagtctcatgagatttacatcttgtaattttagggtcatgagtgagataattattttagtttggtgaacacatggattttatttggtgcatttccaaagtttagtagaaaagataaatgtcaaatgaaaatgtttagtgttttaaactgtttgcattcagaaggtccccctcctcatcttgtgcatagctcagctggttcctggactgtgggcctgacagcggctttacttcattgccaatagtgtcttcctccttgagaggttcatgtgttgcacagaacagtagccacacttattgagtattgtacttattctttgtttttgagatgagatcttgctatgttgcccaggctgctgtcgaactcctgggctcaagtgatcctcccaccttggcctctcaaattgctgggattacaggcctgagccatcatgcttggccccctacttattctgtgtcagggcctgccaaacattttatgttttcttatttaatctttcaacaatgctgcaagttgaagatgatgaagaaattgaagcttaatgaaattaaatagcctccccaaggaccacttttaatggtggaactgggatttgaagccagatctgcctcttctaaagcctgtgctctgaaatagaatggtaactggagtggggcagacctgggttcatatcctgggttcaaattctctcagcctctgttttctcattttaaaatgggagaaacacttatgtcatggaaagatgagacctattaagggccgggtgcagtggcttatggctgtaatcccagcactttgggaggctgaggcaggtggatcacttgaggtcaggagttcaagaccagccttgccaacatggtaaacacctgtctctactaaaaataaaaaattagccaggctgggtggcgcacacctgtagtcccagctacttcagaggctgaggcaggagaatggcttgaacctgggaggtggaggttgcagtgagtgaagatcgtgccattgcactccagcctgggtgacagagcaagactcagtctcaaaaacaaaaaacaagaaaaaaacaaaaataaataaagattgtacctattaaatgcagtaatctttgggaagctgattagggtgcatgcgtactaggctctccatatatacatgttggtttgatcatccctctgatgtgtttctccccagatgaaagctcttcatgggtaggacccttgtcttgtgttcatgtgtcctcagccctgtgcctgttggagaagggagtgaatgttgaataagtaatgttagaaatttttctaggttcttaaaagaagcttgtttgtctttctgttttcttttctttttcctttttttttttttttttttgagacagtttcccaggccagagggcagtggtgtgattactgcagtctccacctcccaattcattgttgaagcaattctcctgcctcagccacctgagtagctgggattacaagcacgcagtactacacccagctaatttttgtatttttagcagagaaagggttttgccatgttggccaggctggtctcaaactcttggcctcaagtgatccacccaccttggcctctcgaaatgctagaattacagacatgagccactgcgcctggccagttttcttataccatgagcacaataggtttttacctttggccaatgggttacttgattgcttttgtttctttttttcatgtttaatggagtttattttttagagcaattacaggtttatagaaaattgagcagctagtacagagaattaccatataccttctccttccaccttacaaatttccctattattaacatcttgtgtgatactgatgcaggattttttgcttagctcagctaggtctgggttcttgtctcatgaccaggaggaagtagacacacggacactcaaagagtgagcaaggcgggaagttttattgagtgatgaagcagtttttagtggggagggtacacagggttactccctctacccaaaggcaagagagttctttgtgttgggaacaagtaagcggtgctgaagagaaaaaccagtattgagacaaattatttctcagcaaggcaatttacttctgcagaaaggtgctgcctgttacaaccgcaagagtacaccgagcaaaggagggaaggggtttttatccctaatgcagttcctgtccctgtgtccttcccctgttggctagggttggaccatacaatctaaactgatgccagttggctaagacttaaactttttctaataggtaaatgcgtgatttgtaagagaaggagggggtaggagtggtctgtccattacggtacggggcatgtcgggccacaagcgtgggagggttgttcggaggctagaaacaagggagtataaggaggttgggcttctgaacaaagagcaagaacgttacacagttaaaccctttgaagaggaattcatcatctctggcaatttccccctttgtcttttgataattcttcctcttcacatttttttaacatgatttggctctgctgttcttctcgatcacctaggaacaagagcctatttgagtatagaggaggagaggtaggggaggttttgtgagagctgtttctataagtccttgcattaacccatggatacagggtatgatgcagcatcctacatatgagtacacctgtaacaattgcaagagaggttaatattgaagtcataatccctttccattcaccaaaccacttttccatgagacttgtgatggggtcatttattctggaatttttggctaacttatctgatatggaggtaaggccttgtaaagccttcataattgttccattgggagctgtgttgttagggctgaaagtacagcattggactctggtcttgacacagactttgcctttttttgctaacattatgttaagggctcttctattttcccagggcatttggctggtgggcctaattgttcagctatccctttaatggcatcgtctgcataattgacaaaccgctgttgattatagtaaatgtaatttatccagtctacatttttgtttatagttgaccaccagaacagtgcagatttgaatctgaatcctgcagctatttggtttcggggtttaaatttatctggtacctcttgtgggaccccagtagcagctacataaatgtgagggtcaaaagacccgtgaggagcatctttttttttttttttttttttttttttttgtgatcctctgtcctgttatgttgacggaatgccagagtgaaagggccagttggactagggctcacgtgccgctccagtttctcagcagagtgcctaatagtttaccgcagtaccaccatacatttgcttgagaatagacaaaaggcagcttgactggtaagctcttgggaaggcttggtttgactacaccctgttaggtctccgagggacgttaatctttccccttgccatgagagaagacacgaggtaaaattaaatcagaagctggaggccagatggccctcgggggctgacctgcggggtctttaacttgggggaatagcaatgagagagtcttgcatgctctctcccaggctgtgagattttgaaagagacttaccatgcagcttatgcccggtcagtcagaagaccatccaagtgggaaggggactatctgggcctctggcctgcctgccgcacaagcctaacagtcaattttgtttaatgtgcgagcagaatatttaatccattccagccaggcattcgcatcttggtatcctgttctaagcactaaagtttgttttaaatctttaacctttacagtgcctactatagtttcgtcatggggtatggaaagaacagctgtttgattggaagagggtttagaaggagaagaaggtgaagggggttgaggagtaatgaagtgcatttcaaaggatcctttggggtcctttccaggaatattagctcctgggccatagaagtgacctagggtaggcttggtgtcggtagaggtggggacattaatagagatttgcacagggttacactgttggagttgacaggtggagggggttgtacctttggtaaagtgaatgtaaggctttagataggtacaacctattgaggaggtccagccttgacacttggtggtatagattacatctccctaagtatcacagaactaccagttataggatcggcctcagtccatgcaaaagtcagttctgtaggcagttttatttatcctggaagggcaaaggtacttttctgaagaggccagctgtctttggctttggagatccccacagggcataacaagacaagcattaaaagtaatggtttgaggggagctagatctggttatattaataataagatgtgtggtagctggggaaaggaagctaagaaggaagagacagattaaactttcttttttaacgtgactctggttggggtgggtcctggaacggcagtccatgactctggagaggatggtgctcttttgacttgggtgtgatgagtgcaaccgtttttggtggtcctgactgccgtttcagtttttagaagtactaaataaggttcttcccaagtaggtttgagcttttcttctttccaacttctgacgaggacgtaatctctgggctggtgatgatggcctgcaaattcaaggggtgcagtttgtgctaaaaggccttgagtcctaagagaggaaagggtggaagacagacctgatacatagtttttgagaaattcatcctttgtttcaaaagtgggaatgtcagtattagagtttaagtaaggcagtccataaagcatttcataaggagagaggccagtgtccttttgcggggctgtttggactctgaacagggcaataggaaggcattttgtccgaggtagctgggtttttaaaattagttgggttaaatgattttttaaagtttggttcattctttctacttttcctgatgagggtggatgccttggtgtatgatattcccattttattcctagtgcttgagtgagccctttaataacgagggcagtgaattgggttctattgtctgaatcagtgttttctataattccaaacctaggtataatttgttttaataaggttttaactacatgtttagctgttgtgtttgggaaagggatggcctctacccagtgggtgagatgatctactattattaataaatagttaacatggcctactgggggcatttcagtgtaatgaatttgaattttttggaatggcgttaaccctgagttttttcccccaagggcttgcatcttatttgttgatttattagttttttttgcatattatacaactatccacaatttacctagcaagggtatagatttctatacacccataaactccgagagcggcatcacacatagcctggggaccccagtgagttccttgatggagttgagacaacatccctcttatgagaggtttaggcaacatttccctctcatctggtaatattcgtttttcttctgagctttctttggctcctatttcatttaacttttcttgtttgttatgggaaaagacggggactgtggctgggggagggagacaaggagttaaatggaaaatgggttcccgttggggaagaggcagcttgcttggctatttggtcagcaagattattccctcagcttctaaaggaaagatttctttgatacctgggacgtgaacaacagctatttgttctggcaactatagattttctaatacttgaattattatgtccctgtggactaagttactgttaatgaggccttgctctgttcaaatttttccaaggtgtggaccactccaaaagcatacttggagtctgtataaatagttccttcctggttttgcagaaattttaaggcttgatttaatgcaaacagctcacatgtttgcgcagagcaggtgcagacccgttattaggtaatcttcccgattttatttctgtgaggatatctccgtttactactgagtacccgttatgccttttttcttttattacttgcctcgatttccttcttttgaccatacatctggatggatgtatcctttatctagggtagtgagcaaatttagggaggggaggaatttttcttggttaacatagaggtctgggtttaattttagcattaaatctcttcctaaataggtttgttcctgcctccgggattaacagaagtttaatatttactgagcggtccttatatttaatttctgtttcttctaagatttttgctttaaacccctcttcttttactcccgaaataaaaagtttttcctgtgaacaagttacaccagggggaagataacaaactgaggagcgagcagctcctgaatcaatgaaaaaggtgataagctcaggtttgggtcccacctctaaatttatcaagggctcttggtgggacttgaggtaaaaaaaagagtggagcccttgaccgccgtattcttcctccaaggtcatgagtagaatgacttctttctctttttcccatctgggacattcctttttaaagtggcctatttttccacacttgaagcatttgttttgcccttttccctctctacttttgggttctttggctgtgctgttttatagcctttatatggcctggaaagtgggggcttaagttctttataggttttggcccctgagtgttctgttgtggggcggacagcatgatccttgctttttgtttttgcttttcttttcctcgtcttttcgtacatataccttttgagcgtctctcaaaagctgctctatagatttatctttccagttctctattttctataacgtgttttgtgatgtctggccaactattggtaacaaaatggagctttaacatcccctgcccaagagggtcttctaaacctagacctgcatatatcctcgcttgctccttgagcctttctaagaactctgtaggtccttcatccttcccttgttgtatatagaaagctttgggaatgttttggatgcggaatacagatttttgagttcctttaattatcagttctccaaggtcttgcatattcctccagtaggctgcgttgttactatcccattgaggatctgtggccgcaagtttttgctcagctgctgggacgttctgacctgggggatgctcacgttcccaaattgtcatagcagccctgcgaatcatgctcctgtcttctcctaaaaagcgaatacctaggatagacattagctcagcccaagtatatatctggggtctgagaaattgattaatctggtcagccactatataagggtcacttaagagtggtttgagctccctttgtaggtttcggacctctgagctagttaatggagcatttagcctcctctgaggggcacttcccttaaggggaagagagttggagctaactctttagaagtggtggggaaagggaagttttgaatatcctttttacattgttctgtctcgcaccgaagtcttcctgggggagggccctgaggctgggaatgattccaggagttaggattataaagagggggcacaacgtgagtcgggggaagggtccagggcggctgcctgagggggagggaggtgagaggtatctggctgaggcagatggtctaaaggatcccatgtgggttgcttaggggtgggggccttagtttctatagggtaagtagtttctggcttattcttactggctttgagggggtagaggtggacaggcccctgccgtcagcacagggcatagcgtatctcctcctgagggacaggactcttgttattcacatactctattaaaagttgacaaatccaatcctcatttgacccaaactgtagccagaaaactgatggtttgaggatagtttccttagtccaaataaaacaacagtattttatcatttgttgctttttcttatttttagtcctttcattatctttccagtattttagcaggagacctaaggggctgtcccgggaaattctattgtcttgcttggggtatttcgcatcctggagaaggtgtttttttgagtttgtgaggctcaacctctcttactagagatttcttgcaccctttctttttttctttttttttttttaaggtggagtcttgctctgttgcccaggcaggagtgcaatggcacgatctccgctcactgcagcctctgcctcctgggttcaagcgattcttctgcctcagcctcccaagtagctgggactacaggcacacaccaccacacctggctaattttttgtattttatttatttatttatttccttggtagagatggggttgcaccatgttggccaggctggtcttgaactcctgaccttgtgatctgcctacctcagcctcccaaagtgctgggattacaggcatgagccactgcgcctggcctcttgcactctttctttagaggcccaaccccccttacttgagatttcttgcattcttttgcttctgcttaatccttctctggctgcttcctttgtgggaattttcaggtcccccttagcgttggtgggtcggtatgatcccccgacaggcaagacaggcaagctgtcctaagctgtatgaggtgaccacggaaccacagatccggactccacactcaattgtgcgtctcattcacacactttcaacctccaggatgtcctgaccaccaaggaaatactgcactgccattgtgttttttcttaacctttgtctctgcacagagttacctggtcactgtggtatttgtaggcctttttctcccgcgttgctaagcgtccgggtttattcgtcacaccaggtgggtctcgatccctaacccttgaggccaccacaacgaggcagtgggacctgtctcctcacgagtgaggactggagacccttccccagaggagaatgggaatcctggatgggcccccagattgttgggaacaagtaagctgtgctcaagagaaaaactagcactgagacaaaggatttctcagcaaggcaatttacttttgcagaagggtgccgcctgcatctgttacgactgcaagagcacactgaacaaaggagggaaggggtttttatccctaacgcagttcctgtcggtgtccttcccctgttggctaggattggactgtacaatctaaactgatcccagttggctaagacttaaaacttttttgaataggataaacgcatgatttgtaagagaaagaggggataggagcagtctgtctgttacagtacaaggtatgtctggacttgtgtgagcatgtcagggcacaacaagagcaggagggttgtttgcaggccagaaacaagagagtataaggaggttgggcttctgaacaaagaacaaggacgttacacagttaaaccctttgaagaggaattcatcatctctggcgctagtattgttgcaggattcaggaggacgagagagagatctcgggttaaaacaggagaatcttttattgagtgcactcaggcccagcagattcacacccaaaggttgggctcagaacaaagacagcacttgacttttatacacacttcacagaagggggtgggctagctaaagcaagcttatagtggcgtgaaagcagggatacagaggtgggacaaagacagttaattaaatcgttacaggttcataactcaggattgcacataactgttgctatgcaacccagatgtccgttatctgtgtttgcctaggcatggacttatcctataaccttcactatggtgcccgggcagctgtagttccggcctactcaggcttttcatgaccttcattgtatttcttagataaaacaatacttgaagtcactagttacagagaacaggaatctataaactcattctataaaacaaagaaaaatttgttttttcttctccctgtgttgagggagtgctgggaaagtctccagagcacattagataatattatcaagacttttcctgggtctcggctgtgcctgttgctgcctctgggacaaatcagcctaatacaggaaaacttatttctctttcttttaaattttatttttctttaatttccggcctccgtgtagctgagcccagggctttttatgggctcagaatagggagtgtgtgctgattggtttgtgagtatgcaaaaaaggttaaagtgaagacaccactcaaaggtgggcatgatagtgtagaaaaccaattaggagactggacatggtggctcatgcctgtaatcccagcactttgggaggccagggtaggtggatcacctgaggtcaggagtttgagaccagcctgaccaacatggtgaaaccctgtctctactaaaaaggcaaaaattagctgagcgtggtgctgcacacctgtaatcccagctactcaggaggctgaggcaggagaatcactcaaacccagcaggcagaggttgcagcgagccgagatcatgctattacactccagcttgggcaataagagcgaaactcagtcttgaaaaaaaaaaagtaaaccaattaggaaaggataggtatatgtaaaataggtgaaagacggatcaatcagaggaaactgtgccaaatgagaaggtgggttctcagtcccgtgtgaggatttacccaggactctctccagattgaaggttggatttcactggggacctgctcctgtctgcctaggcatttgtctgcctcctgcctctatcagtatgtttgttaaaattgatgaactaatattgacaacattattttttccccactggatgtctcttacacaataattatggttttttgtttgttcgtttgtttttgagacagagtctcgctctgttgtccaggctggagtgcaatggcagagtcttggctcactgcatcctccacctcccaggttcaagtgattctcctgcctcagccttctgagtagctgggattacaggtgcctaccaccatgcccggctagttgttgtatttttagtagagacggggtgtctccatgttgttcagagtgttcttgaactcccaacctcaggtgatccgcccaccttgacctcccaaagtgctgggattacaggcgtgagcccctgcacctggccaattatgttatttttaactagaatctgtagtttaggttcactctgtgttgtacatgtctttggattttgacgatgcaactttacacatccttagaaatccttctgattaagaatgaagcaaagacattttttcttcaacttaagtttattattttttcaaatggttactaagttattaggacataaatgctttttaaattgtttggacatagtaacttaataaatcatcaatttttttggtcttgaggcactatgaaagttactgagacatcaaggaacacatgtgacagtgctgaaggacaaatgtacccagatgagctggtcaggaatgtctgagatgattatgttcaggacagtgagcaaatttaaaacatagagcccccgggctgatgtctgagatgtccgtattgagatcgttcagaaatgtaacagacagtagaataatgatgggccttatttttctaatttaaatttaaatgcaaaagatacaattgatcaggcatactagattatactttgaatttcatttgaaagctcagtaactctatgtcagcctattaaatagtgttaacaaaagtttccaggtagtcttggctggaaattcttgaagaagaatacattaaaagtactttaagagaaaatattccagaagaccttgttaaaccagttttagctatggttagttgcatgtatgttagtttcagcaaggagagagggaatagtgtttgtctttaactagaacaatctgaaactgaccccctcttaaaacattatatctaatgctagatctgaatagtagtcttgctttagccaaatgtagacatgctagtgttttagcagatgattatttttcttttgagcataattttttgtttttattcttgttttgtgcttatagcagtggttcaaaacttagaagctgtaatcctctgctggatactgtgaaataactgacatatacctagttcttttgtatggaccaggaacaattttgacaggacacatggctgtcctatgaagagtataaaatcatagccactgtcattgggggacagagttgggggtgtcacagagctgtcaaattaggtttggtgggtaatgccctagttctttgctaagatttgcttgcctgcccctttgtactcgtggctttttccctttcttcccctccccccccccttttttttttgagtgcagtgttcatgcactagcacttgtttctaggacccaaaggtttagggaaatttatggcagaaaatcttaaagcggatggagctgtatttagtagcagcttctcttgctcttgaggaggagaccgtcgtcagtaattttggttcatagcactcccatcccacctgccactcagagctgcaagaacacggccttccagaatagagtcaaacacagtgtgggtgtcactaacttgagttattttaagaggtcaggaaacaaacctactactgtgtgttttttgacattattttaaaatataatgtggataaatcagatgagtgacctctctgtggaattaaaactttttacgtgtgaagtttttaattttgtgggtaattttttcaaggtcctttagaattgtgtcactgttgcctgctaataaagtcatgtgaaggtctctgttaaagcagtggtccccagcctttttggcaccagtgactggttttgtggaagacagttgttccacggattgtggggtgaagggggatggtttcgggacgaaactcttccacctcagatcatcaggcattggattctcttacggagcatgcagcttacagagcgtgcagcctcaatcccttgtgtgtgcagttcacaatagggctctcactcctgtgagagtctgatgctgccactgatgtgacaggaggtggagctcaggcagtaatgctggcacgccggcagcgtggccacgttctcagcagcgcacggaccggtaggagctggggactctctgtgtgttaaacgaaggtagtccaggtgaagttcagcataggctggagggtggaacacacagatggtcgctggatgtagtgacctttccttgtcacaggcttaacaccccaggtggcacggataccttgaagagccatgctgtttcctaagagaaaacgtggaatttggaagagattttgaagtttctttctcctgtcctctagcaagaatatatatcatgtctggaactcttggagcaaaggagtgggtgtacgaatggaagaagctccgatgggttgatgcagaatatctcacagccctcccggtgttggcccattccctgtctgttgtgtggtatgatgtgtgttgaaatggctccttgatcaaaagtaaacatagctgctttataccattgcgtggtaaactgtgaaggcaggcattgagagaggggtggtaaaaagaacctattcctggtcaaaaatgctaaaatacttggaagtgcaaatgttttggtgcgtggcatgtgagcaacatgtttactgtctgttctttcagctataattaatgccttccacgatactcatcataatcataccttaatgagaaggccctagaaaagaaacccaaccttttttgttgggttacttcgcatctatcatgatactttttcctttgattttatagcactttaggatgaacttacttttccgtgctaaatgttagctttggagaaagtgtatcatcagaaccatggagtttgaggtcttctaagatgaagttcataatttaagctttatatgtgtttgatctcagaaatgtcttggattatgtcaaatttttactttttttctttttttttgagatggagtctcactctgtcgcccaggctggagtgcagtggcgcgatctcggctcactgcaagctccacctcccaggttcatgccattctcctgcctcagcttcccgagtagctgggactacaggcgcccgccaccacgcccggctaatttttttttgtatttttagtagagacggggtttcactgtgttagccgggatggtcttgatctcttgaccttgtgacccgcccgcctcagcctcccaaagtgctgggattacaggcatgagccgccgcgcctggcctacgtatttgtttttaggtttttattttgttttgttttgttttgttttattttgatgttatgttttgttttgttatgttatgttatgttatgttatgttatgttatgttatgttatgttatgttactttatgatgttatttttttgagagggattctcacacagtcacccaggctggagtgcagtggcgtgatcttggttcactgcaacccctgcctcctggtttcaagcgattctcctgcctcaacctctcgagtagctgggactacaggcacctgccaccatgcccagctgatttttctgtttttagtagagacgttggccaggctggtctcttaactcctgacctcaggtgatctgcccgccttggcctcccaaagtgctgggattataggagtgagccactgcacccggcttgtttttaattttagtattgtcattgtattttcttgtttttgtttgagataaggtctggctctttcaccccgttgggagtgcagtggcgtgatcatggctcactgtagcctccatctcctaggctcccgcgatcctcccacctcagccttattttctggtttgatctaagcgcagattaccagtctgctgttgtgacttgatgcgtttatctcactgaagactggtacccgaggcagctgactttggttgaggtgtggcacttctttccctagttaatgtgcatgccatgtaccattgtgagtttgccagaagcggcctttgatcctagctgtggttgctctgggctgtcagtatttggacaagtggacgggtatgccgtaactgctgggatcctgacttttctttgaaagggctcaagtttttatgaattttagtttttataaataccttattaggtatgaacacatattcacaaatagcatgcaatttgaaacctcggtttaccagtgaactaaacagaagttgtttctcttggtagccttctgatgaggaaacgaggtggggtacaggagcctacagaggactgaattgtgattacaagtagtcttcctgtgtccttgtcactcttacggtctagaagtagcttcgatgtttatttgcttggagtttcagcagcagaccgcggtgcttgaagctgttcatggaatgaccgcttgtgtctgagccagcgtctgaggaaactgatgttctataagtaggtctgagaggcttctctggagttggcccatgtcttgctccctcttgctgatgctctccctgccaggaatgttcttctctctctgggtttctctttagagccctctgcagacatcaccaccccagcaaagccctctgtaaccatccaacctgaagtggtttccccctgaatagcttaagcagatttctttttgttaatacagtccagttggtattaatcaccttctttctcagtcttcttttctattgctgtatatagttatacatttgtttttgtttttgagacagagtttcgctcttgttgcgcaggctggagtgcaatggcacaatctcagctcactgcatcctccgcctcccggattcaagtgattctccagccttgcctcctgagtagttgggattacagtcatgcaccaccatgcccagctaattttgtatttttagtagagatggggtctcaccatgttggccaggctggtctcaaactcctaacctcgggtgaggtagtctacccacctcagcctcccaaagtgctggggttacaggcgtgagccaccccacccagctagttatgagtttttctgtcttgcctctctaaataagccatgttcctgtgccttccacttgtatattccttagaatttttagtatagggcctgcatgtggtaggccctctgtaaagagctgttactttgatagtgtgtgaattatagaattagaactctgagggactttggtcagtttgccacgttttctttctttttttttttaatgcagcctacaaagttggacacattttcttgatatgttgaatacttgtttctttgagcactggcagcttgtagagagactgaggccgtagttagttgtcttacttactggttctttccagggtaaaaccagatctgtgtataaatgagtttgagggtcgtgtctgatgctgtagaatatcccagtggttgcatggaaaacagctggcttggtgtgttggctaaactgggtatgaacatagctcatgttaaaggtaggctctttaggttgagtttgttttgaatgggtttttctggtggagtgcagcattcagctcattaattttcaagttgaaatgtcgtcacaaaaatatggctttctttagcacagtactagcttttaatatgtcaaaattgcattcaaaggttggttaaaagctgaaagtgctgttgccagccttccaaattgcaggctcagaaatcccttttgaaagaggaagagtgggtgtaggaaggtgggaggaagcagttacccgggaggagcttcctctcagggtcaggttgatgaggccctagttttgtttttattactgaaacaattgctgtgtaaaaatgagtgagcaaatgattacagtagttatttgtcttacagaaataatttttcctttaaaaaggatacatcaaagaacctttctccctctctgaggaacttacttctgggagagttcatttcgtccagcctttcttgactgtgtgtttggtaaatgttgggcgtgattaggaaatggctggatgacactgtggatacctggaaattgctgctgctcttccggcgcagtgatttgaacctgggagagttgaaaaaggggttcttcccacattcttttagtgcagagataaaacgtgaaggcctgctgatgtgggctctgtggctcaaacggggttttaaaaatagagaagctttccagaaaagtccaggttgctggctttgcttgaaaagcataagctccccaggccgctgctcctcctagccccaaggagctggagccagtgctgaggccccaggagaaggccccgtcccgctgtgctgcgcaccaggcctgccaccacctcgaccagagcttcgggcagacctaaaatttgtacacgttttcacatctaaaacgtggcagtgttgtatttaatgagttattgcaaaagacaataaaaactgtaggttgatttcttggtttgtaccaatctgtgtagcctctgactctgtcataaaagcaggttttattttacatgtggactttctcccctaaagctacctttttcaaactattaatggctttccaaactttttattatgagtaatgctcattttttaaaaagttggtagaaaagtactgtgaacacctgtatgcatgtccgctaggtaaattagcacatttgctttctctgtctctttcacaaacacatgtgcacatacattttgtagaaacatttgaaagtaagttgctttatgtcatgacactttacccctacatactaaaacatgtattgcctaagaatagatattcttctgtctagctgtgattattatcacaggcaaagaatcgtgcacctgtggtcccagctacttgggaggctgaagtgggagtatcgcttgagccaggaggcggaggatgcagtgagccaagactgtgccactgcactccagcctgggtgaccagagtgagaccctgtctcagaaaaatacaaataaaaaataaaaaagtgttattcaatatgaaacgcatggttgcatttccttggttgttccccagatgtttcgatagctatttttattccaatccaagagctaatgcagcattgcatttggttgttctctctttagatgcctttattctagacagttccttgctgcttctgtttatctttcaagactctgacattttttttttcgtttaagcgtctagggtggttgtgtagactgttccataatttgggtttgtctgatgatttcctcccgagtagctgggattataggcatgcgccaccacgcccggctaatttttgtatttttagtagaaacatagtttcaccatgttggccaggcgggtctcgaactcctgacctcaggtgattcgcttgccttgacctcccaaagtgctgggattacaggggtgagccaccatgcccggccttatttccccatgattagctaagggtcagccatctttgtcctgagggccgcagaagcctgtggtgtttgtgtctgcttccgctgcatcacgccaggctctgtggctgtcctgttgctggggctcagttcagtcatttggtgaaggtggtgcccatgagatctttccattgtaaaggtacccacctttgttcctttgttaaatttatctgtaacctgcaggatgataatttgaggccctgtctcttctgaatgccttacgttagcattcattgatgatccttgtctgaatcagttattgtgcattggtggctagaaaatggtgatttcctaattggcaatccttctgtgttgattagattttttttttcctgaaaaattttctcccctgttgagtatcactatgtggtttataatgctttgccacccttttttctttctggtgttcaaattatcccagacttggtgagtggagccccttcaggctggttcctctgtcccttgggcatatgcccatctgagcactcccttgcctcctggtgagaaacgtttctgcctcgccttgaccttcccttgctccagacttgtaatcaaccgcacggattcctttgtaatagggactggtatttggaaatcaagatctggttgccaggtttgctcatcatgaactgagatgtcattgcttttcaccccttccaatggaaagagctaggagctagtacatagattgatgtttttaatcaaattagaatgcttctgtttttcagggcctgcttacatactttgtagaaactcgcgtggcttgtagctcatgctgaaaaactcaggttctggtacctaagccatcccagagatgaaagttacatctactttttgcagtcttttcatttccagaaccctccacagttagaattgtgtatgctgacagtatgcagaatctactgaccttaacatatctctgaaagacgggtcagggtaagagagtgcagaaacaaaaggcaggacttatctttttattgagtaagattgtattgtatgcttcaaaacatgttttttggacaaggactttgttttaggcattgaagtcctcgttctcctgaggataaaaagtctctgccctgcagcctagcagtgcatttggtggcagagtgacaggcttggaagagaatgtggagggagtaagggaggcgcttgctaactgcccctgacgctgacagagctctggagaggtcagtgcagcttctgagttagctgctccttagcctggataccttaaatgccatctggttgggcatgccaaggtaaagtgaacgtctgtgcaaatatgagtctacgtggatggagaattttacagggaagggaacgtttttagtgtggttgaaattcaaggtgaggctgcgtgggtgacaccttatgctgaccactcttgtttcaggaattggaaggatggtgtgtgtattttgaaaatggcctagttctagctaaggctacctcttagtaagtgcttactctgccctatatgtcacttaaaaagattcattttgtttgaaacctttgtaagtctcaatttcttggtacgtcacagtactggaatgtacaaagccagttttttttgtttttgtttttttaattagagtgcagtggaagtcagtttagatggttttcagtgtccgtatagaacaaatggtagccaacctgttttcctaggaattgttcgtgttcggtacttaataaattcttagggctttgaatgggacttatctgtggtgggatctgagcaggtgattaaactgcttaagtgttgtttacataaagtgtatgaagagacagatactgagtgatttttcaagattctggcagtaatgggattcagaacatgtttgagtagaagaggggagcagataaatataaagaatatatttttaacttccaaagtaagaacatttaagaagcaaatataattggctaccacatgtgggttttgcatcctttccagaccatcctgcgcatgagtctcttattaattttctgaaaatgtgactctggccacctgttcgcgctccctccatcccagctcctggagaggaaggccagggccttctgtctgcacccggcaaggcatggtctatgccacatcgtcatgcaccacagtgacccctggcctcacctctcaccacttccctcccctgggggctgtgggtcctgccgccacctgaggttgccttgcagtcgcactcctgagttctttcctggaaacgctctccgcctcgctggctgtgaacagaccctggcacgctttgaggcccagcctgcatgcctcctctctctcaaaggctttccccacgctgcctctccacgcagagcgtgttctcccccttctgcctcctggcacctgcttatccttctgaccctcatggatgtcattgactcccttccctccctcctgtactgactaccatggtcccttgtgcgtaggcagctggagtgtagcatgtgcttttcacatcgatttaaccttgtaacgttgtggagagaaagtgagatacaggcaagaaaactgagggtgactttgaaggaattgtagtaaaaacccaggcggaggaattcctgtgattctctagtccttctgggatcttgatggcagtatttgtgatctgtgtattacttctgttcagaagggcagtcctgttgaaggtaaacatcagggaattgctgccagaaagggagtgtttttagtataataatggtctgaagctacttgtaccttgtcagaagtaaaatcaaagccatttgtgccattttcattaatatttttaacaccaaaggtttcttccttaactctgtttttggttgtgattaatttaagatgggaattcacagttctaacctcgcctcatttttagtacaggttgagcatctcaaatttggaagttcaaagtctgaaatgctccagatcaaaaactttttgagcactgatatgatgctcaaaggaaatgctcattggagcattttggatttcagatctgtggatttgagatgctcaaccagtaagtataatagagctattcccaagatccgaaaaaattctgaaatcagaagcacttctggtcccaggcattttggagaagggatgctcaacccatacaaccttacagaggggtgacatctatcagtcaagcaagagtcatcctgcagtaccttcctttataatggggccgaccacaggggcaggcactgggtttcctttttcaggttccttcttacagcctagattcttactaccctatgccccccccccacaccccttttttctgagacggagtctctctctgccgcccagtttggagtgtggtggcaccattttggcacactgcggcctctgcctcccaggttctagtgattttcccacctcagcctcccaagtagctgggattacaggtgtatgccaccgtgcccagctaatttttgtatttttggtagaaatggggtttcgacatgttggtcaggatggtctcaaactcctggcatcaaatgatctgcctgccttggcctccctaagtgctgggattacagacgtgagccactgcacccggccttattcttattaccctatatcctatgacttccagttcacatgcaccatgggctactggaattttttttttttttttttggagacagggtcttactcttactctgttacccaggctggagtgcagtggtgcaatcacaggtcactgcagcctgcacctcctgggctcaggtggtcctcccatgtcagcctcctgagtagctagaactacaggcatgtaccaccacacctggctaatttttatattttttgtagagatggggttatgctatgttgcctaggctggtctcaaactcctgggctcaagtgatctgcacgcctgggcctctggatcgcttaggttttaatatgaattctgcaacatctttagtttggtaatctttgtggattgctacagagtaaattaaattatttacaaagaataatattgaataatttaattattcacaaggaataatcttgaaagatctcatgtgttctttactcatcttcccccagtgataacgtcttgcagaactgtgtgcaccagcacagtcaggatgctgccgtgcgcatagtcgagacgcagagtgcttcccaggcatctctctcatggcccttttacagccacacctgcttcgctcctgtccccaccccttccttagccccggcaaccactcttctgttttcggtttctctagttttgtcttttcaagagtgttatggacagggaatcataccgtatgtaactgctgaggctttttttttttttagcttagcataattctcccacgattcatccagttcctcacctggatcaatagttcattctttttttttgctgagtagtgttccgtggtgtggctgcagcgcagtccatttagcctcactcaggaaggacatctcggagttgtttccagtttctattatgagtaatgctgctatgaatgtttgtatatggggttttgtgcgaacataagctctcattgctctgggataaatgcccaggagtgcatttgttgggttgtataccgttgcatgtttaggttttaagaagatacctgttttctggagtggttgcaccattttacattcctgccaatgatgtggaagggattcagttcttccacatcctaaccagcactgtgttttattttagccattctgatagttgtatagtgatactcctttgtgattttaatttgcatttccctaatggcccttttctctaatgaacatctctcgtgtgcttatttgccatctgtgtgtcctctcaggtgagatatcacttcctgtctcttgcacattttctaattggactttttaaaactcttgagttgttttttttttttaatcatggtaaaagcacatgaaatttaccatcttaaccatttttaaatttcaattgtgtgtcaaaagacaaaattacaaaaaaatttagtgtatggatcttaattggcttttttgattccagaatcaggcaacacctcattctataaaacagaattctgtgaaatagaatgagtgttctcatgagctgagcaggggaagctggctttgtagacagaaaaggggtgagggaaacagacacagagaacagagagcagatgggtggtttcagagtgacttcccttgtaaaggttaacgcagaggggacttccttaccacgctggcccaaactggcccatttgggggatttgctgttctctttctcctgacttcttgcaaagtcagataaacaacttacttttggcttggtggtatggaggttaccaagagggactccattttggtttggtctgctgggcctggtgcaggagctcagtccaaaccagtgttctcctggctcactgtatttatgttgagttttaagaattttttatgtattctaggcactagtcctttgtcagatacatggtttgtaaatccctcctcccattttgtagtttgttttttcattctcttaacaggggttttgttttgttttgttttgagatggaatctcactctgtcgcccaggctggagtgcagtggcgcgatctcggctcactgcaagctccgctttctgggttcacgccattctcctgcctcagcctcctgagtagctggaactacaggcgcccgccaccacgcccggctaattttttgtatctttagtagagacggggtttcaccgtgttagcctggatggtctcaatctcctgacctcatgatctgcccacctcagactcccaaagtgctgagattacaagcgtgagccaccgcgcccggccttaacagggtctttcgctgagcaaatgtttttaactttgaggaagttcattttatatattttttctcctgtggattgtgattttgttgtcacatctaagaattctttgcctagcccaggatcccaaagattttctatttttttttcctaaaagttttagttttgtgttttacatttaagtcgctgatctttgagttaatttttatacaaggtgtgaggtttagatcaagattcattgttattattgtttcagcctatggatgtgtaattgctccagtaacatgttgaaaagactggcgtgctttctttccctcattgcttttacatctctgttgaaaatcagtcggtgttccctgacaggtgcagatactaaaaaataaatcagttgggtgtatttgtttgagtctatttctgggttctgtattttgtcccatagatctgtatgtcagttacccctctcctaatactagatggtcttgattactgtagttatagagtaagccttaataccggggtgactgattcttcccagtttattcatctttttcaaaatcgttttagttgttctagttcctttgtctttccatataaattttaaaacaatcttgtctataattaccacaaagtcttgctggggttttgttaggaatgatgttacttatggggagaattgagatctttactaggttgaatcttccgatccatggacatggagtgtctttttcttctttaatgaaagcttcagatgtgaagacagttgtggcgctgcctgttgccgtgcaccgagaggtgctgttccagggagaacacagtcagcggcaggacatcaggttgtgtctttgctcacttctgctttcttggtttttaaatttataggcctatgaaaggaggttccctacatgtcctttgattccgatgttcgtgggcagtgacactgtgaatgaattcaagagcgaagatggggctattcatgtcattgaaaggcgctgcaagctggatgtagatgcacccagactgctgaagaaggtaaaggtcggaaaggacgtcttggagggaaagggcgtcctggtgggagagggcgtcctggtgggagagggcgtcctggagggagagggcatcctggagggagagggcgtcctggagggagagggcgtcctggagggcagcccccagagacaacatgaacttatactatagcttctgtgctattggttgttattaataaacccatttctctttcttttttttttgaagattgcaggagttgattatgtttattttgtccagaaaaactcactgaattctcgggaacgtactttgcacattgaggcttataatgaaacgttttccaatcgggtcatcattaatgagcattgctgctacaccgtgagtaatctgtcactcggcggaagatgttctgccgacatatggcttctgaggattgtttgatcaccattttaaacagtgcatctttttgtcttagagggcagttcttcattagatgttgtcactcatttctcatgtgtaggaggaagggtagcaggtgtggtctcctgcagagtgtattatgttgtcgtggcagttaaggcagccaagtgatgccttgatttggttttgttttttttttcttttttgagacacagtctccctctgtcgcccaggccggagtgcagtggtgcaatctcggctcactgcaacctctgcttcccgagttcaagtgattctcctgcctcagcctccctagtagttcggattacaggcaagcgccaccacgccaggctgatttttgtatttttagtaaagatggggtttcaccgtgttggcctggctggtctggaactcctgacctcacgtgatccaccccttggcctaattttttttttttttgagatggagtctcactcttgtcaccaaggctgaaatgcagtggcacagtctcagctcactgcaacctctgcctcccaggttcaagttattctcattccccagcctcccaagtagctgggattacaggcactcgccaccacgcccggctaatttttgtatttttagtagagacagggtttcaccatgttggccaggctggtctccaactcctgacctcatgatccgtctgcctcgtcctcccaaaatgctgggattacaggcgtgagccaccacgcctggccttaaatattacattcatatgccacttcttttctggtcttactgtaatatgttagaaatatctaatgaaggactaagatgtgtgcctttaagaatagtgccgagagtgtttgtctgtctcagtatcttcactgcttaccaccctgtttcaagaacttcttttatcagatttttagaatactctcctgacagattgctgtatttctgcccttctcccctgcagtgtatccttaacactgaattcaaagtgatctatttaaagtatgtcagattaagtcacttctatgggctcaaaaccctggagtgtttccacagttcgcccagaggaagagcccatagtctttatggtgacttgcaagggcctgagttctctcctggttacgcctttcctgtccttgctgtcatgcagtgggcctcccccaggggctttggctccaaggtgctcgctgtgccgtgctattcttccctacgtctctagtctcacctcctcccatctcggctcaggtcaccccttcttggccagccccagccacccatttaattctgcagcctgactccccaacccccaggcttttttttttttcttcagggatgggatcttgccctgtcgctcaggctggagtgcagtggaacaatcagttcactgcagcctccacctcccaggctcaagtgatcctcctgccccagcctcccaagtagctgggactataggcacatgccaccgtgcctggctagtttttaaatttttttgtagggatgaggtcttgctctgttgcccaggctggtctcaaactcctggactcaagtgatcctcccaccttggcctcccaaagtgtcgggattgcaggtgtgaaccatcatgcctgacccccatccctggttcttttagcctgtgctccaagttttcttttttccatagcacttacttatctttaatttccttgcatactgtgtttctggctgattgtctcctctgttagactctgttgaaagcttccaaggccaatacctctttgttcatgatggagaagactgttcagtgagtatgttgaatgaatgaatgaagcaagaatgaaaatgaagctctccttttatagtcatctttgaaatgtttttgaacaattatttggatctcttcatgatttagaatgtgcttttgatcctgattttgaacatgattttggcattttttccatctgctgtctttatggtagtagcattgttagtaacgtaagtgtttttttctggttactggttaaactgaggagcaggcagatgatattctgttgtcaattcagtcagtgagagtgctttctctttatctgcaggttcaccctgaaaatgaagattggacctgttttgaacagtctgcaagtttagatattaaatctttctttggttttgaaagtacagtggaaaaaattgcaatgaaacaatataccagcaacattaaaaaagtgagtgtatcttgggattttgtggcagagggtgggcaggagtctctgagatgaccatctttttggaaggctggggatggcttagcaagggatttgcagcatttcttgggtggaagatgctatgatccctaccccctgcctcatctttaggtataggggttgaggttgtgctggttgctgatggaggaaggaggtgcctgtagctctagcaatggcactgtctgcctggagttgctgagagagttagaagttggggagaggcagcagcagctggcacacagcccccaggccttgctgcaggattgggaggaggcctgggggcctggggaggtgcttgccgagcaggctgccccccttggattgtcagttcttccacagaagaccttcctttctcgtttttgtgctgttgttcatcagttgttagggaattgtggttttgaaatctatccgtgtgggattatggagtggtttttgaaggctcattttcagggtactgtgttggaaagaattgaaattgagacagaaatcatatattgagtacaagtaccctaaatcagcattttaaaatagtcatataaaaattccatctcattagataccatttcctaaaccttggaaaataacaagtaaaataaacaaaaacacagaagcatttggccttttctttttttctattaattttgtagcaattcagttttattggtgttttaaaagcttgtgagggactgggcgcactggctcatgcctgtaatcccagcactttgggaggctgaggtggacagattgctcgagcccaagagttcgagaccagcctggacaacattgcgaaaccccgtatttacaaagaatacaaaaattagccggatgaggtggcatatacctgtagtcccagctactggggaggctgaggtaggatggcttgagtccaggaggtcaagggtacagtgagctgtgatcatgccactgtgctttagcctgggccacaaagcgagaccctgtctcaaaaaaaaaaaaagattgtgaggctcaccatcttccgttggctagaaaaaaagaaaaatcttgggagagatgagtaatttgaatgttgaatatatactcacctttaaattggttttgttttaaagggaaaggaaatcatcgaatactaccttcgccaattagaagaagaaggcataacctttgtgccccgttggagtccgccttccatcacgccctcttcagagacatcttcatcatcctccaagaaacaagcagcgtccatggccgtcgtcatcccagaagctgccctcaaggaggggctgagtggtgatgccctcagcagccccagcgcacctgagcccgtggtgggcacccctgacggtgggtctggcaggggcttcatcccgagagcaaggctagggaagtcggcgttgccgttttctctctgtttgctctgcctgttcccgcttccttggaacattagataactcagaaaggaaagacccgtctctcgtttctggcccttgtcctctcgcttatgtaatacattcattttaccttttattagattttttgttaataggaaggattatatcaagttatttttattcttttatggataccagaaggtgtttgtttgtttgtttaagaaatggggtctcactgtgttgcccaggatggtcttgaactcctgggctcaagcaatccttctgcctcggcctcccaaagtgctgggattataggtgtgagccaccacacctggcctaaggaaggtgtttttttttgtttgtttgtttgtttgttttgagatagagtattgctctgttgcccaggctggagtgcagtggtgccatcttggctcactgcaacctccgtctcccgggttcaagtgattttcctgcctcagcctcccgagtagctgggaccacaggcatgtgccaccacgcctgactaatttttttatttttttatttttgagataaaaaagtctctgtcgcccaggctgcagtgtagtggcacaatctcggctcagtgcagccttcgtctcctgggttcaagtgattctcctgcctaagcctcttgagtagctgggattataagcctgcaccgccacgcctgactaatttttatattcctagtagagacggggtttcaccatgttggccaggcttgtcttgaactcctgatctcaggtgatctggccacctcagcctcctgagtagctgggattacaggcgtgagccaccagatttcttacattctccaacacagtagctccattcaaaatagatttagatttgcttggcttttttttttccataaattttatatcttgcaagtcctttttgtgttatgttcctcttggaattaaaacagtcattaatatctattatagtcatgaatagtattgtgatttggcaatagaggtaactcagtggtaatcagggaaagataattgagtcagaaagtgtacctgtggtttagtcagtgatttgatctcagagcctatccctcaagtcctctaaggaatctggtttacatctgccatctctgcggtttcatgtgcctctaggactctaggaccacacgttaactccactgagcacaaagactttgggagcctaaagctccagtgttctttgttgtaaataaatgtcacttacattccagacaaactagatgccgactacatcaagagatacctgggcgatttgactccgctgcaggagagctgcctcattagacttcgccagtggctccaggagacccacaagggcaaagtgagtgtcagcaccacacccagtgtgcagggccagagctacgtgaaatcatggaatctctttctgtcatagtcaccaagagtgatattcccaacttccacggctgggaatgtttcttccagtttagaagtcattgaatttatgtctctgtggaatctaagtcgtttatagcaagtgataatgcatgactaactgcatttttctagactttacagagcaaggtctggctacaaacagtgtcacgtcacaaagcaacatgtgttccaagtattcacacattcaaattttcagaaggtgtaaaaagagttcagagatttatcagagattagaaatgtttgagctttaattttcaggtttttggtgaaattttagcctcataaaggtgtaaatttttatggtaagccttatgtagtgagcagagcctggtatgtgtctagcgagttattggcattatttagtaaagggaaactaggcattgcatgtatttggcctgatctctaattctgtcagcctgcttactagaaaccaaataactgagtgctgttgaataccagtcatcaagaaaaccactgcagtgatgatggccaccgtttgttgtcttcttaccatgtattagacactgttttcaggtctttattccatccttccggcagctctctctgctgctgtttttctcactggttttacacgtgaggaaactgaggcacagagcagtgaagtaacctgcctgaggtctcacagccagcgagtggtggggtcaggatttgaacccaggccattttgttccagaacctacattcttaaccacttccacgtaactgtggtcctttctgagtgaagatgatgccacgtcagtaggccacatgcttttgagttatttcgcaggagttggggtcatgaatagctcatgttcccacccccttcttgttctgacggaccagcctcttgagttggtaaacacatggccacggaggaagacacttggtccacgtgacactcggaacacggccttggccttgttctttattcagggaggccaacctgttgattgacagtaatggaacctggagaagattcctgcgtgttagtcagcaatactgccacatcatgaaaacccaacatgctttttttgtattctttttctttaatctgtagtttttgtttttaattatcttaagtcttatgatcactcataatttttaactttgtgtatatcttctctactttaatctttctaatgagttggcaaaagcaccattgccagtcacgtagacacatggtagttctacagttttatgtttttgaatttttttttttttatatatgtatacagagtcttgctccgtcacccaggctggtgcagtcttgggtcactacaatctctgtctcccaggttcaggctattctcctgcctcagcctcctgagagctggggttagctctgccaccattgctggctaatttttgtatttttagtagagaacagggttccaccatgttggccaggctggtctcaaactcctgacctcaagtgatccgcctgccttagcctcccaaagggctgggattacaggcgtgagccactgggcccaacctcgaatgactttttaaagacaatgctaaattataacttagtctgacttaagtagtaaagaattcaaaagtaaagtttaacttgctactatttcttgtcatactgacttttaaaagcatctgaccttatagattgtctataaaatgtgagaagtgttaaatattccttatttgatattacacataaactacactaaaatgccttttaataaataaagggaaccattttagatacaggaaattctaattagattggcatagttaaggccaaaaatataaagtagatattgctgccttatcttcagcctttgcctttaagaggcaaataaatacaaaatacaggtgagtcttgcttggttctgagacagtgaagggatttcctcagtatttaaatagagtcatatggccagttatgtaaacccaaatataaaaccaatctccaataggctttaagatggcatttacgatctttgtgaaagttgaacattactagcgaagtccagtcacatctttagaaggggaaagcagtgtagcgttactgaatcagaattattaaaattcagaaaaccgaacatagtcctttaaccacaagccagccttagttaaatcaggattgcccaaccaaactattctgatgatggttcatgatctgaattctggtgtatgagatctcttttttttttttttttgagacggagtctcgccctgtcgcccaggctggagtgcagtggcgcgatctcggctcactgcaagatccgcctcctgggttcacgccattcttctgcttcagcctccccagtagctgggactcaggcacccgccaccacgcccagataatttttgtatttttagtagagatggggtttcactgtgttagccaggatggtctcgatctcctgacctcatgatccacccgcctcggcctcccagagtgctgggattacaggcgtgagccaccgctcccggccatgagatctgttaaattatgatatgcattaaaaagtcatgacatttctgttttgtaataagacagtgaccaattattactcattagaaggttttttgagataaactttcaagtctgcccttgccgtcttctttctttttttttttttttttgagatggagtttcgctcttgttgcccaggctgaagtgcagtggcgcgatcttggctcactgcaccctctgcctccaggttcaagtgattctcctgcatcagcctcccaagtagctgggactacaggcgtgcaccaccacgcccgactaattttgtatttttggtagagacagggtttctccatgctgctcagtctggtcttgaactcctgacctcaagcaatccacctgccttggcctcccaaagtgctgggattacaggcctgagccaccacaccccgccagtgaagaccatttttgttccagggattctccaaataccccatcagtgtgtcctcactccaggtgatgcttttgttcttattggcatctgtgtataagagaatccagcagcctgacctgtcgtctgcccggagagacggtggagatgtggcccagtcttgtgcttgcttcccttttccatggtgtggcactgggcggcaccctttggaacaaaaatcttgcctttctcaacatcatccatgtttaattctcttttgtctctggcactacgaaggtttccattcagaagccaggtgtcctgctctctctttattctaactttttatttaaatgcagtatgtatacagaaaagtgcaaggatcatagtcattcatagatccgttcatagagttgaagcatttgatgtttagggaattatttatgcctttgctctactttgcggaaacgaaaatgaaatactataaagattattcaaactgataatgctgattttctctagagtagtaagggagatgtttctggtaccacctcatttttaatagtataatagtgcagctcactgttgattagaagtgggagtttcaggccagacatggtggctcatgcctataatcccaacactttgggaggccaaggcaggaggattgcttgagctcaggcgtttgagaccagcctgggcaacatggggaaaccacatctctacaaatacaaaaatgagctgggcgtggtggcgtgtgcctgtggttccagctgctcaggaggctgaggtgggaggattgcctaagcccagtagttgggggctgcagtgagctgagatcatgccacaacactccagcctgggtggcagaataagagtccctgtctccaaaagaaaagtgggaattttagggtcttattcccttagcaactttttttttagggcagtaatgtgatctcggctcgctgcagcctccacctcccaggttcaagtgatccgcctgcttcagcctccgagtagctgggattacaggcatgcaccaccatgcctggctgatttttgtatttttagtagagatggcatttcaccatattggccaggctggtcttgaactcctgagctcaagcgatccgtccaccgcagcctcccaaagttcccttcacaacttttaacattgcttagaaatgtctttttctcttaatagattccaaaagatgagcatattcttcggttcctccgtgcacgggattttaatattgacaaagccagagagatcatgtgtcagtctttgacgtggagaaagcagcatcaggtagactacattcttgaaacctggacccctcctcaggtccttcaggattactacgcgggaggctggcatcatcacgacaaaggtaccggatggagttgaaactgtgtttccatcgttgtcttgatgtgtggttgaagatatcttccaaggcctccttccctggagttgagtggggcccccttgagtgcatcgtttctcctcactctgagaatttggcacctttcccaagttgaacagactgatacgtgtcaccacgggcacactcccgtcccgccccgggcagccaggaagggcctgggactgctctttcctcatggacacacgtcatccttgggcaaatgacttcacttgctcggtgcagtacagtttgttttgacctattaaaaagacagcagtgcctctggcagagtattttcagtagtgcagtgttaataaagggacttttcaatgacttaaaccctatgatagcttaaaacggttcagcccggttttctacatcacagccctgagcacttcagttctgctttgggagtaagtaaggcctggatgaaggggggcgatgcacctgaaatgaagagtggtttaaatgagaaccttaaaacacagttcccccaaatgccttccataccctgccttgcaggaagacctgcactgtcaaaaatacactctttcctgagccaaagtttgagagccgggcaggatggaattggaaacgtcggcgagagggaagcaccgtagaactggttcttttaccctctgaacaagtccttgcagaaccgagcagctcagctttgtctgtgattatgacttcatcttttgtattgttaaaaagtttggtagtaagacattgacaaatgtgtcttttttttttttttttgagacagagtctcgctctgtccccaaggctggagtccagtggcaagatctcagcctactgcaccctccaccttccgggttcaagcaattctcccgcctcagcctcccgagtagttgggactacaggtgtgcaccaccacgcccggctactttttgtatttttagtagagatggggtttcaccatattggccaggctggtctcgaactcctgacctcgtgatctgcccaccttggcctccaaaagtgcaggaattacaggcgtgagccattgcgcccggcctcaacaaatgtgtcttattaaacgttgggagaaactttctgtaaataggcctttccgtaagattttggagcacataaaaatgttttgctttaagtagaccaggtctagagctagactctcctgggagatgaagttcactaggtgacaaatacaagataaatgttaccctctaaccctctgccccatgctgggacgacactgctggtcttctggtaaccaccgaagacaagtcttggttccttttcaggagcacaatcgtctgtattcctcctgctgcgccttctgggactgtgcggcaggaggctaggcagtgctgactctagggatacactatggccaccaagctctttttcccctttgtgtagatggcccatgatgatagggcagtatgataggagttaggctcctctcaggcggcacccattagacctccaggctataaagaagtagagtcaggccaggcccagtggctcatgcccgtaatcccagcattttgggaggccaaggcaggaggatggcttggacccaggacttcaagactagcctgggcaacacagtgagttgttgtctctacttaaaaaaaaaggaggctgggcgcggtggctcacacctgtaatcccagcactttgggaggctgaagcgggtggatcacctgagatcaggagttcaagaccatcctggccagcatggtgaaaccccgtctctactaaaaatacaaaaattagctgggcgtggtggcacacacctgtagtcccagctattcgggaggctgaggcaggagaatcgcttgaacctgggaggcggaggttgcagtgagccgagatcgtgccagtgcactccagcctggcgacagagcaagacttcgtctcaaataaaaaacaaaaaaggaggcccagcacagtggctcacgcctataatcctagaagtttgggaggcggaggcaggcggattgcctgagctcaggattttgagaccagcctgggcaacacggtgaaaccctgtctctagtaaaatacaaaaaattagccgggcatggcagcgtgcgcctgtagttccagctacttgggaggctgaggcaggagaattgcttgaacctgcaggcagaggttgcagtgagctgagatcgtgccactgcactccagcttgggtgacagggagagactctctctctaaaaaaaataaaaaaataaaaaaaaaaaaaaacagagtagagccaacacaggctgcttggtggggttttaaggatttttagaatgttctcatttgtcttggtccttagagtgggaattgagggaagctggcttttaaaaagctttcattcagtttttagtaatctatgacatgaaaaaaaatgattttctaagaaagaaaattttaaaagtactctgtagtcatagaaaaagtgtctggatagtttgatgttcccttgccgttgaaaatcagagctcttgggcagccccagttgttcaaagtgagcccagcttatgggcagttgttcagactgagcccagcacttatgcagctcgagctgagtgagtcccagccggattcccctcatcccggcacagccttctatttccaggaccctgcacagctaccctgtcagttggtttttatttttctcgcttacagctttttggggtaaatattggacacacaccccctatcacacaaatcagttgccacttctaagaatcagaaagacttttaagcgcccctagaacacaggcgaacacatattcctgttaagggtcttagagttgtatcctcagtttcaactgggatggtgctgacaactcattccttcccctcctctgcagatgggcggcccctctacgtgctcaggctggggcagatggacaccaaaggcttggtgagagcgctcggggaggaagccctgctgagatacgtaagtgcgcggctgcgagactccaggtgccactgtggcgtcactttttttctctgccagtaggattggggtgttaaccagcctgttagaacaaacatgaattgcttatgtagttaggactgaaaatatattaatatcgtcttaaaatttcaaaaggagacacagaagttataaaagtgtttctcacagtggaagcgtcagtgaggcagtcagggtctcccccgagatgcctgtgtagcagcagtttgagtcttttcattcactcccatgtggaattgccctctcttgggacgccactcacagcagacctcttgatagcattctttccactggcccttcgttaacgcgagctcttggcgtctttctccagaccctcctgaatgcctgctgacccatcatctcgctgactccagccaggccccgctccactgctgccgccattggcagctgtgcttccccctcccagagaagaagatggtccttcaatttgaaaacaaacagaaacttaaaagacgtatttatagccccattatcctgaaatacgcatttttggctttattttttattatgttttttgagacggagtttcactcttgttacccaggctggagtgcaatggtgtgatcttggctcactgcaacctccacctcccaggttcgagtgattctcctgcctcaacctcctgagtagctgggatttcaggcacccgccaccatgcccagctaattttttcatatttttactagagacggggtttcaccatgttggtcaggctggtctcgaactcctgatctcaggtgatcctcccgccttggcctcccgaagtgctggaattacaggcttgagccaccctgcccagccagctttttttttttttttttttttttttttaaagagacatcgtcttactctgttgctgaggctggggtacagtgtacagtgtctattcgtgggtgtcatcacgactcactgcagcttcaaactgctgtcctcaagcagtcctcccacctcggcctcctgagtagctgggactacaagcaccaccactgagcctggctcactgttggcattcccttgtgtattgtgttagtctgcccccaccgctatgtgtgtttatatatccccacatgcacacgttcacacataaagatagggatggactttatctacaggggaggggtttattaacctaaagcaaaggatcgcttgagccatgccttacatctgttctcaggctgccttttctcttggcgggcacatgtggtatcagagtgttctcacactcacagacattcatctcctgttcccatgcacttgttctgaagacagagccccagagccaggcccctgctcatctggggatacctctgtgcttcactttggatagccgttacctttgccacacatgacagtgtttattctctttcaaaagtagaatttatttgttggtggtgatgtgtttagcgcatgtgaatgtgtaagaaaatctccataggtgacttttttgatttacatgcttatctgtaatacgctgttagtgtccctcttccatagctggacgcggtagttttagccttaaactaatcatggtaaattttcatgcccttttgtatgtaggttctctccataaatgaagaagggctaaggcgatgcgaagagaatacaaaagtctttggtcggcctatcaggtagatgtgggattttgtttttcctttcaacttactgagaaaacgaattaaatatttctagttgatttttggaattaaaatctacttattattttccaaggtgctctaaaaggtagacaagaagtgaacatgtaatatgccagtgacgagggacagacagttagtgttttttgaccccaggcattgctgtgacgtcagccagagtgggttggcctgtctgcttagtctgtgcgggccgcaggagcccagggctgcagatcgtttgcttgtttttgcctcccctccccacccagatgactctgtgttcttaaaccaagctctaagttacagtaaagagttctgaaaatgtttagtgattcagaggttgacattgataagggtgtagatggttcactgggatgtaagttccatgagaacagggtttttgagggccttttgctgactgctgtattctcagctcctgggacagtgcttgcctctctctctgttgaagcatagcccactgcagttcagacgcaatatgtgttaaaataccagctgtgtgccctgttgatggcaggttggggggtggtttagcacgtcgaggacagcacactgtggctttgcttgccggctcactgagcatatctgagagagcttttcgtgcattatcagtcagccttaattgcagtttcaggccttggtcctaccacactgatcctgtgtgttttgtacaagtagatataaacagggttcatagcactatacatagcactataatttaaaaaaattgattatgatgtatttggaaatagctataaatgaccaaaaaggaagaaaataagacacagtttgctaagtgtgctgtctgttgaatgaaacacatctctgcacaacctgcagctcatggacctgcctggtggacttggaagggctgaacatgcgccacttgtggagacctggtgtgaaagcgctgctgcggatcatcgaggtggtggaggccaactaccctgagacactgggccgccttctcatcctgcgggcgcccagggtatttcctgtgctctggacgctggtgggttgagatgctttttgcagtaactgtgagccatttggaaagcagataacatgcattcatatacacgtgtctgtgacctaaagtcttaacttcttaggaaaaaaaacaataacatgcaaagatataaaatttctcaaattgtttaagaaaggggaaaaacaaaatgtgagtgtcctaatgccatgcaaatagactttacagaagaagtatataaacttgaatgtcttccccccaccctcccactcagaataccacattgtcattttaatcttggacactcaggcagcagagaaatatgactgcatggtcttctcctcctcacaggttagtccgttcattgatgacaacaccagaaggaagttcctcatttatgcaggaaatgactaccagggtcctggaggcctgctggattacatcgacaaagagattattccagatttcctgagtggggagtgcatggtatgtcctgaggcgaggaactgcacatttggccccttatgcaggtgggagaggtcggtgtcgatttgcacaaatgattttcagaacttccagttgtttggatgttttgtttttgttttgtttcttttggccgccatttctctgatccagggttaagctaaagagaaccattgaagtaattgttgatactgtacatttcttcattgttaaatacgaatgagaattcgtagaatcaaatacgattgcagcttgctttgattcacacggctttgtgtgaatcagatctttaaacaattttagaggagctgtcatattttctaaaatactgttaaaaaattgaatcagttctcaaaatttcccacccgcccctccccgtccttttttttatggagacagggtccggctctgtcacccaggctggagtgcagtggtgcgatcacagctcagcagcctgacttggtgggctcaggtgatcctcccacctcagccacccaagtagctgggactgtaggcgtgcaccaccatacccagcgaattttttgtagaggcagagtctcactattttgccccagactggatgacatttttggtttttttttttcttcttgagatggagtcttgctctgttgcacaggctggagtgcagtggtgcaatctcagctcactgcagcctccgcctcccagattcaagcgattcttcagtctcagcctctggagtaactgggattacaggcatgcgccactacccacagctaattgttttatttttagtagagatggggtttcaccatgtcagccaggctggtctcaaactcctgacctcaagtaatccgcccacctcggccttccaaagtgccgggattacaggcatgagccaccatgcctggcctggataacatttttaaagtaaaaaaacgaagggaagtggttctcaacatacgtttggggtttttaatatactgagttgctgggtaatgaagcagaggcctccacttctatatcctgtactcagagaagctcagaaccttggggtccttataggcttctagcccatggtgcacagttgtgtcttgggagcattacggaagccagagcctctagaagtcccagtgacttgttccatggcacacggcggtggctgaactcagcagggagtgaagctccttttcagaagggctctctagtcatccttcatatgaaaagttacccgtttggaatgtgtacccactgggtttgactcaggtatttagctaatgaattggacattcaggggactttggactttctgaatggttagagaaatttagaaaacaaatgaatttagctttcacttcatcagttccactttaaggaaattacaggcatcatcacagtacaatgcaaagagcaagtaagttacagtaaaggttataggaccagaatttagcaagcgcctatgaggttaaaccgcaggctcaggttcgtagaaacctctgaactcctttcatgatatgagctagccatcccgtgttgttgctgcttccaattatgacacgaagaattgagctggagcccaaggagacctgcctcaccgcgttgtgcctgtttgtcacatgccgacctccgtagtgtgtttgcggtgctgagcgtctttgtggttaattgaactgtccaaaaacttgggccttctaaggcttcttcacctctctcctgagctgctgttgaggctgattgttgaaaggaggttgttccctcctgctctctggtggccggaggttactaaccagcgggcagtctggtatttttccaccacgacatcactgctttgacacttatgctgtactgcaggctgaagactgaaatgtttattttctatgtagttgcttcccaaggctaatagaacgaggacttcgattttatgaactttagtgtggagtcattgtgtcaaggtcaattaggagatttatgttatgtacaagttctaattcaacttgtttcaggcaaattcaaaagaagttcttcattagtttttggctggtgttatagaccagtcatttgactttagacagaaaacattattcattgattctgtatcttcactataattccctatcataaaaataatgcctgtggctattgagagcaaaactcttttcttaaagtaatacttttcctttacagggcaatataaatacccctaatgcttatatgagtcagctttagtaactgggtgcagtgcctcacgcattttagtaggaattctgtggtacatcagcttcaacttgttcccgtttatgcagagtaaaacacatgtatttaagtggtttttaaaaacatattgctcagtagtgcagagtgttttacgaccctgccagtgttttccattttctcagcaacctccagaagttgagtgcagggggatagtgctggccggtgtgtctgggtttcgtggggttggtttgtgtttgcacaggtttcactgctgtgtttcttcttccagtgcgaagtgccagagggtggactggtccccaaatctctgtaccggactgcagaggagctggagaacgaagacctgaagctctggactgagaccatctaccagtctgcaagcgtcttcaaaggagccccacatgaggtacgtcctccgccttcctgcacctgggccggcccttcctccgcagagggcctggccctcgcagggcttcctggcagcctttcattcagaacagtccactcgtttttctgctctttgtctttaggcttttgttgacactcgatatttagtttcagtaaatgtcaacgtcgaagaatgggtctctctcagaatagaaactagctgtgcttgatcagagtgcctggaaaggaaattggatctcttgacctccattttactaaagccaccaaacacagagataggaatagctaatctttccttgttggagcacttaactcctgaatttagtttatttcatggttatattgaacaagtttcatgtgctactttttctttttttttttctagacagagttttgctctgttgcccaggctggagtacactggcatgatctcaactcactgcaacctccgccttatgggttcaagcaattctcctgcctcagcctcccaagtagctgggattacaggcacccgccaccacgcctggctaatttttgtatttttagtaaaggtggggtttcaccatgttggccaggctggtctcgaacacctgacctcaggtgatccacctgccttggcctcccaaagtgctgggattacaggtgtgagccactgtacctggcccgtttgctactttttcttggctgggttttggttatttatagatatcttggggattttccgatttctgtaagtctaatggagcaaggagggtgttcctgtattccttttttgctgtcacttttggtagagaagcaagggcgttccgtgttcctgtgcatgccatatgtctgtcctgtagcatcacgagtgacctgaagcaggaggggcctgcagcggaatctcccttctcagctaggacaaggttcgtggcccagagttgttggagaggatggtggcactctgtgcagagcaggtgtcagtgaggatgtggtgctggcttgggcaatggtgctggccgggagctgactgcggcctgcttcctgccgtggtggcacctgggtcagccatctgccagtggcttctgctggggtgtcttcctgagtggctcacctggtgcttgcagggcaggtggataagggaatgctgttgccatggtttgaacaagcagagacagatttggtgtgccttacttgtagatacatacatagaggaatctcagatttcataacgtcttgaggattgtctgtattcatttcttaccgggagggcaggctccagggaccgagtccttgttccttgtttgttaggcactatcgctcttgtccatgtttcaagaacttggggtgcagtgtgtttcgtgtgaatcgggggcatctgtagacatccacatggtaaaaacctccgttctgctttgggtattaaataaagcacagatccgagatggcaacaaactgaaaggaaggctgaagcggaggcccccactgtgaatgcaggaaagaggttccgtcagcacagggggccgaggcctcaggatggagctgcctggggagccactttgctgaagagggggccgtgccacgtggtgccgcctgctgttcttagacaggacccttgtacctcactgaatctgctgtggaaggacattctgaagtggcgtttcagtggtgaggtggcagtggtgggattaaaggggcccggctcgtagagcagccacgcgctgaagggcacagcagacagcgtgcatgggctgagaggggccgtgggcctggctctgctgcttccttaggtggagttttcagtgactgcagaactctgcacagctgcttttcattctcacgtccgcccccgcccaatctttgaaactaactttgattattccctcctgggtagctctgtcggtgctgtgtaagtttggttttcaattggttctcagcacccagggggtgaccacctcaaccccatctctactatgccaggggctcatcccgctcacccagcctcgccactgttctctcgtgtgagcctcacacggcaggcccggttccatgcccctgcttcccccttgctgggaacgctgtcctcaggctcccctgcctgctctttctttagctttcaccttctccagggccttctgttctgtccagcccagggcagtcctctgaaccactcatgtacgagctcacagtgtttggtgtttctaagacctggcctcttagagtgtgtgtgaagatggtgtatgggagatcttggacctctaggtgcaggtcacaaagaacacagagcttggtgcatgacatgtagcaggatccagcggttgaatggatggtggtgtgtgactctggggaaagagatccgtccatacgcattcagcgtttccctccccagcttcagcacctgcaccctggatcccctggagagcacgatgcgctcgcagcatgccggcctggtgctcgtggatcgtggctgcctaacgctgcctctttttcagattctcattcagattgtggatgcctcgtcagtcatcacttgggatttcgacgtgtgcaaaggggacattgtgtttaacatctatcactccaagaggtcgccacaaccacccaaaaaggactccctgggagcccacagcatcacctctccgggtgggaacaatgtgcagctcatagacaaagtctggcagctgggccgcgactacagcatggtggagtcgcctctgatctgcaaagaaggagaaagcgtgcaggtaaaatcacacacaggtcaaatcgcgcatccgtgactccacacggccaggtgattctgtcttgagtagactctttgcttcgctccttgagcagccctgtgtagcttttgaggccctgcttgtggaggagcagcttgcctggaggagcaggaagccaagtgggtctcgtaggaaggagttcaggcctcgcagtggttttggacagaatctgcgacttttcccaaaagcagcctgtgacaggaagggaaggcatcgcacgcacgggcccagctgggcttcataggatttttcccccccgcctcatttcaccgggttgtgtttgtctttttcaaaggaaaatcaccctaaatagaagtaagagggacaagtacttagagaactattagctctcattaccaaaccttctaatttgtttcaaatgctttcagttcccttttcacattgtggctggttattttgggtgcctgtgctcacagtagcctcggggcgggggcattgcttctggccttcataatagatgcatcgttttgctgcctttacagttttcaggggtaaggcttgtcagtgtttcagtggtcttagaggcagagtaaaagaatcctttgtccattttaaaaacaatgaacagctaagctgtgttaaccagtcatgaatttcggagagaatggagaaggagctttccacggattgacggctcactttagggtgacgtgccttcagccccgaacatgctggatgattggcagcatgtcagagaaagtgaggccaggtccagggaagctgtgctgagccctccctccagcatgggtgccaccagcctgccaggctcctgcctccgtaggtggggtgggctgggcaggcctcgtgagggccacggacatggagcttgtccctccgggcttcccagcacccgggagtgaccacactcagtagagggaaggacattgtcaaacctgctgctgaagcaaaatagcaggttctgaatcccattgagatagtttccgtagctacatgaaatcctaaagacagtccccttggcgcttgtcaggcctgtggtaggccaggggtcggaagcgagtcgccctcagctgccactgccctacttgttctagggttcccatgtgaccaggtggccgggcttctacatcctgcagtggaaattccacagcatgcctgcgtgcgccgccagcagccttccccgggtggacgacgtgcttgcgtccctgcaggtctcttcgcacaagtgtaaagtgatgtactacaccgaggtgatcggctcggaggatttcaggtgcggccaccctcgccacagcaggtgctgcggacagctgggcatggttggagggagcctgcagtcccacgccgtgtgcaggatcagcagtggcggcgggtgtcaggaatgcttggagggccaggagggagtggctttggggtcatttgttggcacggtgactccctgcctgtctgcagagggagagtgtcggagacagagccgactgactgcctttgctttagctcacactgccgtctgcgtgcaggctgtgggaagccggtccccctggtgggttactcatgtccatcccccgtttgcaagcactgatggggatgagaagtgagcagagaacagggtgggccacgaagtccagcaggcagtgtgggccggcgggtggttggcagggtggtcctcacgcctcgcccctccctgtgccattacagaggttccatgacgagcctggagtccagccacagcggcttctcccagctgagtgccgccaccacctcctccagccagtcccactccagctccatgatctccaggtagtgccgcgctgcctgcacctagtgtgcagaggggacggccgcccctcctcggacagccagctgcacccgcccacccagcggcgacattgtacagactcctctcacctctagatagcaaatagctctcagatggtaaacgtagtcgtttgatcccaaaactaccttggcaggtagttttaactctgatcctaacttaactcaatagccatagattttgtatacgttgtgcacaaaatccaaccagagcgcaagggctctcttgaaagaaaagtagtttctgtaccaattaaaggattgacgtggtctcagatattgatgcaaaaaatttttccaacgaactccgcattgtccattagtgaatgaattcctgtgacatcctccagagatggcccctcctcacctgggacggaagctgccagctcgcttcccccaagctgcctcatggcccgcacgccgcctcacggcccccatgcttcccgccagtcaagatggtctgtggacttagggccagcccttgaggtccttatcctctgaggattcagaggttgcctgcggagtaccttgtcccagggccagacacacccacaccacccactgtcctgcagtggggccgggggctcaggaggggctctcagggactcctggtgactccaggaaaatgctgccatcgttaaacattactttctctttcctccttttcaaatctttttgatactttttagagcaggatttttctgtatgtgaacttgggtgggggggttcttcccgtttccttccgtgcgtcgcccctctcacctgcagtcagctcccagcccagtgtaggccatctcctctgtgccctctggtggctcattgtcctcagagcccagacagttccagccactaggaggccgtcttggaaccagcaagtcgcatttgccacttgacactgtccatggggttttattagtagctaagcagcagctctcgcatccacttcagggtggcgtgtggcatgtaggagtcctgcttctttgtacatgggaattgtggactcatgcgtgtgtgtgtgtgcatgtgctgtgtgtgtgcatgtgtgcatgacggtgggggtgctggggggacggggtgagtggaaacttagtttgagtaatgaaggaatcttcacagaagcaaatcagaatatgggatttgtttgccttttacattttgtttaattcctgattttaaagcctgctctatctggtacaggcccttattttttcagctttttatgggaaaagcaggttatttgagaatctgtccagaagttgcataggggatggcctccacgataaggacatgcaacacgtgtttctgtgtgcagcagaggccgtgtttttcatgccaaaccccacgcggctgtcaactgtgtgcgtggtaggcatggagatcctggttgtgccgtctcagctccgctctgaaggcactgtgtgggtgctgcgtgactggagagctgtgtggaggccatgtgtgccccgtgcagggatcaggagggcgggggagggaccgagcagccctcttgcccggtcgggtcagccctagtggctgcctgcacactgtagacgtcccagggcctgtgctgtgatcacctgcctttggaccacatttgtgtttgctcttagagatcgagctcctcagtggtacctgaagcctttgcttccggaaagcgcggtagggttcgtaggtagggctagtaggtagggttagtaggtagggctagtaggtagggctagtaggtagggttagtaggtagggttcgtaggtagggctggtaggtagggttagtaggtagggctagtaggtagggttagtaggtagggttcgtaggtagggttcgtaggtagggttcgtaggtagggctagtaggtagggttagtaggtagggttcgtaggtagggttcgtaggtagggttaggtagggttcgtaggtagggttagtaggtagggctagtaggtagggttcgtaggtagggttcgtaggtagggctagtaggtagggttagtaggtagggctagtaggtagggctagtaggtagggttagtaggtagggctagtaggtagggttcgtaggtagggttagtaggtagggctagtaggtagggttcgtaggtagggttcgtaggtagggctagtaggtagggttagtaggtagggctagtaggtagggctagtaggtagggttcgtaggtagggttcgtaggtagggttcgtaggtagggttcgtaggtagggttagtaggtagggttcgtaggtagggctagtaggtagggctagtaggtagggctagtaggtagggttagtaggtagggctagtaggtagggctagtaggtagggctagtaggtagggctagtaggtagggttcgtaggtagggttcgtaggtagggttcgtaggtagggttagtagcgcgtctgtgctgcttccacctggtgcttcctgttcccaaatcacaagggcctgaaggtggtccctgctttctctttctctttctctgtgtctcagatggcgattttgctgacagctgccaagaaaatgcttcactcaacagtcctcatgtgcccagagatgtttatagaactgtttgaattgcagccatcccctgccccctcccaggctgaagatctgttctttttaagttgattcgggagtggcattcttttatacccaaagactgtagtgcatcttgaagagctcaaagcacatgaccgcacaaatgcttacagggtttcctcccgagtaatccaatctcactccccttgtaagggaattctggggcagctatggtttgagtatgcagtttgcatcgtgtttctacctttagtaccttgccactcttttaaaacgctgctgtcatttcccatttcttagtactaatgattctttgattctccctctattatgtcttaattcactttccttcctaaatttgttatttgcatatcaaattctgtaaatgttttgtaaacatattacctcacttggtaatacaatactgatagtctttaaaagatttttttattgttatcaataataaatgtgaactatttaaagaaaagaatgtctttttcttattgtgaaacaacagtttcccttgaagagtttgagattcttaggagaatttagagattgaagaaagaagagagcttctgaagccagagtactgatgctctagaagttcaagaagagctttagcttgtgtgggagtgtttcacaggtgagcggtccggcctcagaagagctttagctcatgtgggagtgtttcacaggtgagtggtcgttcaagaagagctttagctcctgtgggattgtttcacaggtgagcggtccggcctcaggtcacagccgtatgtttgctgatgcagaagcgaacccagtgtttgtcctcgcttctgtaagaagacatgatgtggtttttcttaaacgcagccagatctaacatcactgtgatggggcgatccctgctgtgatgtttccgttgtgataaaaaggattgctttcatcaggcgcctccaagaaaataaaagaggcaggtgtggacctttagaagcctggattaccttatctccactcccctgccaatcagtgggtcttcggggggtcataaaccagtgggcagagcaggctgctggctcggtgaagctcagggcaggccagaaggcggctcagggcagcgtgccagggtgcagaagccagtgcctccctaactgggaaccgcaggatcattggcattcctagtagtccgtatctgtccttggtgggacacagccaaggggtctggctggcacctgggtgggaagcaggggagaccgagggtgccctgcacgtccatgctgggcctgggccgtcagtgtgtccacaggcagtcaggaccttagccgtgccaaaatctgatgatttagtcaacctgcgatggaaggaagaggctttttacctggattccctttatgccctcatatttctgtgtctgttgtcaagtcggacctactgttaccaagcttttggcttggcggtccagttctcagggtggaagccagaggcagcttggaaactaactgagggtcgtaggatgataacccgcagcccgtctcctgaccaccttcagaaagggccacactgaaatggagtgtcttgaacagcagtgtgtttatattgggccaccaaaccattagtaatgcgtttgttctctgttgttgtgggttttttttttttttttttttgagacagagtcttgctctgtgctctgtcacccaggctggagtgcagtggcacaatctcggctcactgcaacctccgttctcaggttcaagtgattctcctgcctgagcctcctgagtagctggggctacaggcatccaccaccacacctggctaatttttgtatttttagtagagatgggtttttgccatgttggccatgctggtcttgaactcctgacctcaaatgatccacccaccttggccccctaaagtgctggtatttcaggcgtgagccactgcacccggccaatgtgatgattcttaaatatatcatgtttcctttaatactccatctctgcagaactttggcagagcccaaaccgtaggttgtcttccagttcttaagttgtggtggaggcattcttattaatgtcaccatgaaacaaaccagttggaatcagttttgcttgaaaagtgagggctttggaaagccagggattctgggaagatggtaatacaactagactgcaaaacctaaaaccggtggatgactgaatggtcactttaaaatggttgaaatggcagcgtttgtgtatgtgttttggcacgatagtaagaacagcctatggacatcatttacggcaacactagctgataaagtatccccataaaccccaaaccaggggtgagtcggggtaaaccaccaatagtttccagagcttccggacccataggttatccgtgtctgagggagaaagcagaggttacatgcaaaacgtctgatggatgggagagcaggagaagccacgaggccccacgaaccccagtgggaggccagtgtgtgctcagcaggtaacacggcccagctgggctgcacctggagcctggggacacggaggctgttgggaagaggatcgggttgaggggagcagaccaggccctctggactccctggactgacctgccagggctcac

SEQ ID NO: 15682 - DNA, 7198 bp, Human
ctttatcaccacgaactcacagtgcttccctgtgcctcagtttcccctcttcagactctatggctaatgacagagcttttcagatttggtggaaatgctctccggggcggggagcagacggggaaggctgccccagctaatctccgcagccagtaccctcgaaggctgagatctcggggagcacagcctccgattcgcgttttctaggcaccaaagtccctcgctggaggaagaggaggggaagaaggcagaggagaggggaggggcggacggatctggtcctgggctcccgcgcggagccccctcctcccacagccgccgctcgcgtccccgcagcgcatgaccgcggcactgcggctgcagggctctctcccccgcccgcgccggattcctggagcaagggggtggggggctcggaggtgcaggacccatcattccgacacgcgccgcgacgccaggagtcggggatgacgcccctgctccctcccctcgttcctgtttctcggagtttttcgacccctgagcgcgtcgctgagtcaccttcccggaacgcgctcgggacgctctggacccagcggggactgcccgggggccgcgcaaggcgaaggcgcacccgccgatacgcgcgcggagctgcggccccagggaccccgcgtcccagccagtgccccccgacccgcccggggactctcgggtcccgcccgtctgaccccccaagtgttgggaaacggggccgagctgcctgggtcctccggaagagaagacaccgcggaggcgtgccggagttcagggcgccgcccggctaattggctgcgtgctcctcctggacctgcctcttctcgactttaagaagcgatgagagaggtgtgtgggggcgggtggggccggcgggggcgcgcgagccccgcagcctcccgcaggggcttggtttctcctaactctggccctacctgggcaggtcaccaatgggccttggcaacttcttcctccgtctccgccgtaaccccccagggatctaactcgaggtgctcgcggacacgttctgtggcttgccgcgataagtgtatcacaaacacactgacaaacgcgtccctactggcctccaaagaagtgacaacttctgagcgcgtttccggcgccccttcttcacgctgagccagagggggcggggggcacgtaccacatgcttggctttccaatcccgacgggggcccccaggcccatctacactgtcaagcctcctctccggctcggagcccccggcctgtcgcctgctctacccgggacagcgcgctaggcggcctcaggctcggtagcccagctgcagcgtcgggaagttaaaaataacctccgtgggagcgcgggggaggaagaaagagggaagctggtgggcggcgggcgagacgccccggcctggagaggcgccccgggtggcgtgcgggcctcgaatttcgggtgggctagggcagagcgcgcaaaaggggcgctgcatcccggcgccgacagcacccgcgggggcgaggtcgtggcgtcgaggtgaaaccaagggtcccccgggagagcggagccgcgcgcgcccggcgctcgctccgacacgagttcgcgcggagcccgcgcctccgtctgcgctgcgcggtcgctttcgcgcgccccagacactgcgctcgcggccgggcccgggactccgcgcctcgcggcctgccgcctcagctcacccggccaggtcgcggcgccgccttctagccagacgcctaggacgagcggcgggggcgcgcttgccgcttcctaggacccgggcgggaaccagctcgtggcccggccgtgggcgcgggccgtgccggaggcggcgcgctgaggccggaggcgggcagaggccgaggccgcgccgggctcaggttccacccccgggagcgcggggcggagccaggccggcgccgaggctcagtgccctcccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtgaggagctagtccgtcggagggagccacggggctctgactcatccgtcgggccggaaccgaaccccaagccccagggagaaagccccggagcaggcgcccttctcagggattgtaggcttagtcacacggcgggggcgccctcggaggcaccggacctcagctctctggacttcccgggaacctggctccccgcgcgtggtcccgggatttagtcgggcgctccccacctctggcagctgcggccccggactccgccagcgctgtcttctctccctcaggtccagccgccgcagggaatgacgccggtgctcctacagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccaggtttgtggggttcctgctgggaagggctgtagggggattcctgttcctcgccaggaatgatggaacgcccagctggacgaaaggggctgtggacgatcgggagaaacattatccctcacgaggccagaagccggccgaatctgagccaaggaagggggtggcaggggcgccgcgtccccaccccaggtctcccagcaaaggccgctcctctggccagggtcaattaccggggtgtttcgggcaccaagttcccacactagtgccccattgttacccgtggccccctagtggtcggttgcggacgtggcctctttggttttgttttctcagcagggcggcccccgggcgtagctcccgcggcccttgcctatgagtgactgctgaacccgcgaaggcaagggcaaggcttcagctcttccggagtcacgtgcagccccttttggctgaggctgaaatctccttcacgctgatgctcactggtgagtacctctcggagggggatttcgggagcatcccctggcaggggatcccccccagtcctgatagctgccggtctccctgcagagcggcggaaccacgcgcgagactggatgcgatcggagaagctgggccgctaggacgctctggtggtcatgtctggagacgggctgatgcacgaggtgaagaccgcactgcgcggctcaggcctggggcttggcgcggtgcgtcccaggctgaggccacgtgtgcttcaacaggtggtgaacgggctcatggagcggcctgactgggagaccgccatccagaagcccctgtgtagcctcccagcaggctctggcaacgcgctggcagcttccttgaaccattatgctgggtgagagcccagggccagagtaggcctgtttcccgtcagtgctcctctaccgcgggggttttcttgtctaagctcccataggctgagatcatttccatttccccttctcccttagtcctggggccctctcctggtgaccccagctgactgcttccatttgctccatctgtcacctaccagtcctgccaactccccagggaccacatggcgctttgccagctcccactccccgggaggaggaagcgggggatacatgggggctcctgtcctgccttatctgactttttccccctgcagctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctgctcgtcctgtcctggtgactggggagagaatgggttctcgttctggccgggactatagaatttaatggtaatgatggccaatggtgccccctgggatgggcaatggattttactggccccaggcatagtcattctggtgggggactcaggaccagagctggttcagcctaatggtgggggggcctctaccaccctgataattatagcacctccaacctgaagcagcctcagagctcagccagctgcctgaccacacacaggatgcagctcggagctggcatgtctcagccagggccacacaagcagctagtcccagcaaatctcatcagagccccatgtggatttagcaggaaaggggaaatatctgagttaagggcattagaaaactgatgggccaggcgtggtggctcacacctgtaatcccagcactttgggaggctgaggtgggtggatcacttgagcccagaagtttgagaccagcctgggcaacatggtaaaatctcatctctacaaaatgtgcaaacattagcagggtgtggtggcggacacctgtagtcccagctacttgggaggctgaggcaggagaatcgcttgagcccgggaggttgaggctgcagtgagccgagatcgcgccattgcaccccagcctggctgggtgagacagagtgagaatgtctcaaaaacaaaaacaataaaaccactggccaccgcccccgcccccccccaaaaaaattggcaaggagcaggagacctcagaagtaaaaaatggcaatatcttgctttttttttttttttttttttttggctcactgcaacctctacctcccgggttcaagtgattcttgtgctcagcctcctgagtagctgggattacaggtgcatgccaccatgcccagctaatttttgtagttttagtagagatggggtttcaccatgttggccaggctgatcccaaacccctgacctcaagtcatctgcccgcctctgcctcccaaagtgctgggattacagtcatgagccaccacacctggtatcttacctttttaaaaggagtctgtcatccaccacaatggtctagggttctagggttctcccagcctccctcagctgtctcctttccctacctgtccctgtggaggagtgccaggcaggagtggaaagaatgtggcagggaaggatccatccaagtctaaactgggcaaccattttggcttagcgtccaggagttgtggcacctgtccaccgccaggtgctatgacgtcggctctcccagaacctggaaggagctgaactggtcagttgtaggtctctggagactacagctgctgggaggctgctctaagctggctcctgaggggcacaccaccggccaggaggaggccagaggactgctccaggacaagaagtacaaaaggcatgcaagcaggtctggcaggcagagggcagtgtgggcgggtgggggtgctgttcacagtggcccccacctggccaggaaagccaggacccactgccacatgccttccctggcaacaaacaaggtctttccttccccaggaagggtgtgtgtgagggacacaaaggcaacggagcccagatgaatggcagagggaggtttaatggtgtcaccttgtcttgctaatgagccaacaaaaaaaaaaaaaaaaaaaaaatgcaagtaaaaaaaagtttaatcacacagcactttatacagatatcgtaagcagtaggcattcacatctccacatgtacaatgcactgggaagcacagccccaccagtcactccgggtgtttctcaaacaagataccgactcggttccaaatgccacggtgtgtggtccggctccatcctcccgcagctctgctggctgggcggtcacagcacagcacaggtgtggagcccacttaaggctgacaagacgcatcatgctttggctttttttttgtctttttttctaataagagttaatatctttgcttttgagttttttttccaaccttaaat

SEQ ID NO: 15683 - DNA, 4475 bp, Human
agcttaccagagaatgagaggtttcatgaaaaaataaccaaggtacccacccagtggactgccagcaccagctgccagatgggtaagtgaggccatcttgaccttccagcccaaccacctcctactgaatgcagccacaagagcaagcccaggcaaaaccagcagttaactgtcagctaacccagagaatagtaaaaaatgataaaccactgctgctctaaaccactacgttttgaggttatttattatgcagtaatagcagctagaactgccttctctgtctttcactttctgaccttgttgagcccctggctcttcattgactaatccagataatacaatttcttttctattacttttctcctcagtgtcaaacttaagagaattattcataactttagcatcatcgtttttataatcaagagattctttcctctccttttggaaacctatgatgtgctttcagttgttcctgaacttggtgttttggctatttcaacttcctataagacagaagctatgcttcactttcgcttcaagtgcttttgcctcgtgaagagctttttttttttttttgagacagagtctcaatctgtcacccaggctgaagtgcaatgacacgatctcggctcacagcaacttccacctcccaggttcaagcgattctcctgccgtagccccctgagtagctggggctacaggtgcgtgccaccatgcccagataatttttgtatttttagtaaagatggggttccaccatattggtcaggctggtctcgaactcctgacttcgtgatccgcccacctcagcctcccaaagtgctgggattacagatatgagccaccgtgcctggccatgaagagctgtcttacctctaagaaattttctaaattcttgttcattattttaatatgaacttaaacttgtctacaaattgccttacattttcttcttggcctacaccacagcaagtacattttcctctggctttaggttactctttttttttttttttttttttttttttgagaaggagtttcactgttgttgcccaggctggagtacaatggcacaatcttggctcactgcaacctccgcccccctggttcaagtgattcttgtgcctcggcctcccaagtagctgcgattacaggcatgcaccaccacacccggctaattttgtattttcagtacagacagggtttcaccatgttggtcaggctggcctcgaactcctgacctaaggtgatcctcccacctcagcctcccaaagtgctgggattacaggcatgagccactgcgcccagccaggttacctttttttaattttatttttttatttttttgagacaggctctcactctgttgtccaggctgaaatgcagtggtgcaatcatagctcattgcagccttgaattactgggctcaagcaatcctcccgtcacagcctcccaagtagctgggaccacaggcatgcaccaccatgtctggttaattttttttaatttattttttgtagagatggggtctcaccatattgcccacacttagatgactttattagtgttacctgattttatccagccccatcatgagaaagatacatgtagtcctattttgttggctgttctcttcaaattagttattagctcatgaaacttctattgatatcctgacacctttttaaggattcctggccaggcttggtagctcacgcctgcaatcccagcactttgggaggctgaggtgagtgaatcacctgaggtcgggggttcgaaaccagcctggcaaatatggcgaaaccccatttctactaaaaatacaaaattagccgggcgtggtggtgcatgcctgtaatcccagctacttgggatgctgaggcaggagaattacttgaacctaggaggcagaggttgcaggaaggcgagatcgcgccattgcactccagcctgggcaacaagagcaaaactccatttcaaaaataaaaataataataataagcttgcaagtgtgctctttgtgaaattccaccatggcatacagtggccagggccagaaagtgcagaaggttatggtgcagcccatcaacctcatcttcagatacttacaaaatagatcgcagattcaggtgtggctctatgagcaagtgaatatgcagatagaaggctgtatcattggttttgatgagtatatgaaccttgtattagatgatgcagaagagattcattcgaaaacaaagtcaagaaaacaactgggtcggatcatgctaaaaggagataatattactctgctacaaagtgtctccaactagaaatgatcaatgaagtgagaaattgttgagaaggatacagtttgtttttagacgtcctttgtccaatatgaacatttattcatattgttttgattacacttatgtttttacaagatggcaataaatgctgtgggattgtttgtattaaaactaataatactaataataataataaatctttttttttttttttctgagacggagtttcactcttgttgcccaggctggagtgcaatggcgtaatctcagctccccgcaacctccacctcccaggttcaagcgattctcctgcctcagcctccctagtagctgagattacaggcatgtgccaccactcctggctaattttgtatttttagtagagacagggtttctccatgttggtcaggctggtcttgaactcccgacctcaggtgatccacctgcctcagcctcccaaagtgctgggattacaggcgtgagccaccacgcccagccaattcctgttgtttttttttaattgttgttgttttttgtttgtttgtttgttttttttttgagaccaagtcttgctctgttactcaggctggagtgcagtggtgcgatctctgctcactgcaacctctgcctcccggattaaggtgattcccctgcctcagcctccctcataggcgcatgccaccacactcagctaatttttgtggttttagtggaggcagggtttcaccatattgcccaggctgctctcgaactcctgggctcaagtgagccaccggccttggcctcccaaagtgctgggattacaggtgtgagccacagcgcccagcctctgttctttcctagaaagaaatcctccacagactaaagggcaaatgccagtaaggcagtgatagggacggcattccagggcactccctctaaattctagatcagagcgggctgctcaagcagcaaaggccctgctctaagttgtgcaggcaaagattttctggagcagtggttctcaaaatttgttccagaaactggcaaggttaaaactatttttataataatactatgacattatctgacttttccgttcccattcactcaggagcatacagtggattgtttccagaaaactccattgccctgaaagctaagataatgtgtatttctatattcttttttttttttttttttttgaatcgccctgtcatccaggttggagtgcagtggcgcgatctcggctcactgcaatctctgcctcctgagttcacactattctcctgcctcagcctccggagtagttgggactacaggcgcccaccaccacgcccagctaatttttatgtatttttagtagagacggggtttcaccgtattagccaggatggtctcgatctcctgacctcgcgatccgcccctctcggcctcccaaagtgctgggattacaggctggagccacagtgcccggccatctatattcttgtgtcttaaattgttctcaggttctttggttggttggttggttggttggtttggttttttggagacagagtcttgctctatcacccgggctgaagtgcagtggagtgatcttggctcatggcagccccaactccctgggctcaagcaatcctcccacctcagactcctgaatagctggaaccagaagtgtgcaccaccacacctgactaatttttttctttttcttttttttttttttttttttttttttgagacggagtctagctctgtggcccaggctggagttcagtggcaatctcggctcactgcaagctccgcctcccggattcacgccattctcctgcctcagcctcccgagtagctgggactacaggtgcccgccaccacgcccggctaattttttgtatttttagtagagacggtttcaccgtgttagccaggatggtctcgatctcctgacctcgtgatccacccacctccgcctcccaaagtgctgggattacaggcgtgagccaccgcgcctggcctgtttttttcttagagacgaggttttgccatgttgcccaggctagtctggaattcctgggctcaagcgatcctcccaccttggtgtcccaaagtgctgggatttcgggcgtgaggcaccacacttggcctaaacttttctgttttaaaatacaaaatgggccgggcgcggtggctcacgcctgtaat

SEQ ID NO: 15684 - DNA, 117001 bp, Human
  misc_feature (1)...(117001): n = A,T,C or G
tgattggaggaggaaacttagcagataagcaagaaagagaacaggttttattttcccctagtctaagtacaagtaatgttctgattacttctgtcctctcttccccatattagaacaactggaattttaaaagttcattctcttgctaaaactgtcatgagacagctggagatggtacatttacaaaaaatccagttctagatggctaactttcaaagtaagacgacagtgaacaatgtctatcttaatatcctttgtacttttgctgggcgcagtggctcacgcctgtaatgacggatcacgaggtcaggagatcgagaccatcctgcctaaaacggtgaaaccccgtctctactaaaaataaaaataaaaaatggccggccgtggtggcacgtgcctgtagtcccagctactcaggagcctgaggcaggacaatcgcttgaacccgggaggtggaggttgcagtgagccaagatcgcgccactgcactccagccagggcgacagagcgagattccgtctcaaaaacaacaacaaaatatcctttgtagttttacacacacacgtatatgtatatacagtacatatatttaaaaaaaccatatacacacacacacaggtctttttttttttttttcctgagtctcgttctgtggcccacgctggagtgcagtggtgcgatcacatctcactgcagcctgaaactccctgactcaagcaatcctcccacctcagcctccagagtagctgggacttcagaagcacgcaaccacgccccactaatttttgtattttttgtagagacagggtttcacaatgctgcccaagctggtctcgaactcctgggctcaagctatcctaccgcgtcggtttccgaaagtgttgcgattacaggcgtgagccatagcgttacatgtggtgggggggaagagagagaaagagagagagtgagaaggaggaggaggaggaggaggaggaggaggaggaggaggagaaagaaggaagaaagaaaagaaaagaaatatagagagggtgttcaaatctactgttcaagtgctttccatgtacatataatctctttttaaaatcccatccagctctgttgagatgagaaaactgaagctctgagaggttgagtaactttatcacgctcccgcaaagataaaagaaccgccatctgcccatattaatttccctgagatgaaatgtgacagagaaagatacctcaaaattaaggaaatggagagcttcgagaatcatcttccatctccgccgagtcccccaggaacttggcccggagtctttgggctgtcccacctgatcttgccccagtgcggctccacaccctggcgggcggcgtacggagcgtcccggcccccggcaccagccagcgtcggagtgggtaggactggagatggcagcctccggtccaggggaagcgggactccacggaagggctgggaagagggagagaagtagtatgatgtggaagcacctgctatgttcagtgtaagaaatattgggaaatactagtcagcaggactccagaaatgaaaatttgtctctgtttgctcaagggtcatttgtttgaagtgaaccttgctgaatgatgaagttgcatttagaaaagtcaagcttattatcgaggatgttcagagcaaaaacgcctaacttgcatggcatggatcttagcagtgacaaaatgtgttccatggtgaaaaaagggcaatgattgcagctcatgttaatgtcaagactgccaatgtcttgcttaccaagactactactacttgctttgcctattctgtgttggtaaaaaacaacagtcggccaggcgctgtggctcacacctgtaatcccagcactttgtgaggctgagacgggcggatcacctgaggtcaggagttcgagaccagcctggctaacatggtgaaaccctgtctcnnnnnnnnnnnnnnnnnnnncgcgagtgtcttggttgagcgcagcgcccattcattgcccgcgagcgtccatccatctgtccggccgactgtccagcgaaaggggctccaggccgggcgcagccgccacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcggtaaggacctccacccggccctccgcggcctcccctccgccctgcccgggctctgcctgcgcggcctcccggctcctaccctgagctctgctgcgctccgcgtggtccccgcaccctgggtcccgggccgtggcgtggaagcaaattcgtgcctttggtcctcgtgccttcttacttcttaacagcttactttctcctgcacccagtcttcgtgcctcaaaagtgtacatttttaaaccacccccagcccaagtggccctgtggatggacctaaactttgcaagaggaggaagaccccctgattaagagtggacttaccggttagctccggttgcaactgaaatccaaccccgagtggcggaatctccaccccacttcacgattttctttcctccaaatcattctggcttgctcagagttttccttttcttttaaaaagaaccctaattaggcgatttcaatgaggttcccacaaggctttgtagtcgcaaaacacagaggtgactcttttaactcagaggcactttcctctgccttgcgttttaattttagagcattgatgaattgatcgagaagacggtccctgccaacatccgtttgaaaagacccttgaaaatggaagaccctgtttgtaagtggccgggagggctcccttggacttagattattctggcctatttgtcttttgtggttccctgaaaatcgagctctggggtaaggattgctcaggactgggaatgtgtggattaaaataaaacagtggcgggtacctccggagccgcgggaaggtgggatatttggttctcggagcagacagttttgtgttaggagagagtcggtgttgtgcggttcttggtctttatcctagggcccccgcgagcttcccctgcgttttgtagcagattccccacttcccaggcaccctctcaccggccagggtgctctcatactttgggttgagaggtgtcattacctgcgcagacccggatagactcaaaggatctaggaattgcctaaggtcgtgcaactggggaagtgaccagacatctcgcctccctcccccacgcttctttagatcgcagtatcttccaattgttttcttacctcacgtccaaattttattatttaccaactgaaagacagcagtacttttcgagtccgaatggtttttcttttcttttcttttttttttcgttttttttttttttttttttttttttttttgagacagaatctctgtcgcccaggctggagtgctgtggcttgatctcggctcactgcaacctccgcctccctggttcaagcaattctcctgcctcagcctcttgactagctgggattacaggggcgcaccaccacaccaggctcatttttatatttttattagagacagggtttcttcatgttggccaggctggtgtcgaactcctgacctcaggcaatccgtctgcctcggcctcccaaaatgctgggattacaggcacgagtcactgtgccctaccccgaatggtttttctagaaaaacacacaaataagatttacatttgtttaagaaaggtcagtttagtcatagactttcttagaattttattttaggtttaaaatatttttaatggtccaagattgcttttcaggggtatttttatgtgggtatttgacttccatggggtggggggacaatccataagtcaagggcacaggctgagctcttaaaaaaaaatctcatctggttatctcactttcaatcatggagatacttatctctttttcttctagagtcaaatgaagagagagcagctgttttattttgttgctatgatagaaaggatctagtgtgcagatggcaagctttattttgtttgaaggtggacatttgaggtatggagcctatctgcttcaggttggctgctcaggctatgctgagggctgctgcctttgttggtttcaaatctgatggtcgttgaaaacctgcatgttttgctgaattgaactaattgagatttagggatggtcggagggaagccttatctatttccattttagaaaatcagaatcctggctgggcacggtggcaaatgcctataatctcagcattttgggaggtctaggcaggtggatcgcttgaggccagcagtttgagaccagcttgggcaatattgcgagaccccatctctacaaaaaatacaaaaattagccgggtgtggtggtgtgcgcctgtaatcccagctactccggaggctaatgtggcagaaacacttgagctgggcagtggaggttgcagtgagccaagatggctccactgcacttccacctgagtaacagagtgagaccctgtctaaaaaaaaaagagaaaggaagaaaagaaaaaatcagaatcctaattcatttgatgtgtgaagagtgaagagttgtgtatctttaaagcagggtattttaggtgaatatttgaacaagtgaatcccttcctgagactttcaaagtcagggaatgtttaggttagctatttttataatatatatactctaaaataaagtgttcttttcagagcattagagcctgggaaacatggcaaagttgtgtatccttttttagtttagttcttggttccagctgaataatttgaacattaagggattctgattcttcactgtggaagtgggctcctgaaaagtaatttgcaacttgaatataaacttaatttttttattttttatttttatttttgaaatggattcttgttctgttgcccaggctggagtgcagtggcatgatctctactcactacaacctctgcctccccggttcaagccattctcctgcctcagcctcctgagtagctgggattacagacgtgcaccaccatgcccggctaattttttgtatttttagtagagatggggtttctccatgttggccaggctggtcttgaactcctgacctcaggtgatccacccaccttggcctcccaaaatgctgggattacaggcatgagccaccatgcccatgccatataaattttaaacctagcagcttctgtgacattttgagcttgttccatctagtttgggatgattcacgcagaaaatattgcacaatcagaagtccccccattccctgaaatggaccagttctccaacaaagcttgtttcttggaatagtgagctgggggtgttgggagagtggaggaggatgcatctgcaaaggatgaattttgactctgaggtgtgcacgtgtcatggtgaatgaatattctccaggtggggagagcaaattggtgcatgtaagctctggtagtagcatttccatttaatagtggagcaccattactcaaacttggtttcatgtgaatgcctgtgttctagtgtagtcagaaaggaattctggattaaatatttgtttgccatgtacagagaaaactgtagtgagagctagttataggagtgttaaatgtcctcattgcagagtaaagattgtgatcagtttggaaatacttgggttacttattacacataactcagtaatctcagacatttatgtagtgcttaccatgtactggacactctttaacgtgctttcatgtattaatgtatattacaaccctatgaggaaaataccattaatacttctgttttaaaaatgaagaaaccgtgatattcagatgatgcatgacttgcccaaggtcatagctggtaagtgatggaggcagaattcaaacccaggcagcccagctccactgtccacactccatccactactttgctctctcttcattttgtcctttgcaaggtcgtgggtgtacaaagtggaaaacttctgtcctgactcacctggaatatccagtttacagatgtgcacaaacccagttgcactagaatcaccctgccatatgccaactgccccagtggaaacgcagcagcttcctggcagcacagacgtgggaacactcaagcctgctgctagggcaagggaaggggtcacggaagtgcaatactgaagaatgagcagtgatgctctgctagataaatctgggggaggctgctggaggtagtgggattaacatgtataggacagaatggccggacagaaccaggggaggacgggtggttcatcagtcactaaggatgctccccctcttcttggacaattcagaaagtgccttgacaaaatactttgatcatgaactggctgctaagtaagtcattattcagagaaacaagcaaagctattcagttcaaaatcctgtcctgctcaagtgaatcctgcattccccatccacatgcactcaacaacaacaaaaggactagaaggatatgtgtcactggcagcactgatttctctgaatggtgcccttattagtggttttagctttcctttaattactttgcagttttggaattttctgcagtgtaggtattcattttataattaattcaaagttaaaaattactttatgaccaaagccagttacttttagctatggtatgcctcgctgtgtagtcttttcagtgaattcatctcaaggcaactagactgaactagactgaactaatcgtagataaactgcagggattaaagtttacacaaaattgcacattgcttgtggaagagagaggagaaactaaaccctccaatgttcacattattcaactagaactgaggagatgagttgtcagaatgatggacttgtgccagctgaatgttccagagtgatttctactaaatggttaatggagggcagtgagtggagggagggagcattgtgtaatgcagctgcaggtgttggctttgtcaccctagttgggttgcgcactctcctgaactgaccccaggggcaactaggccgtggcagctgttccccaggccgaggccacgacttgtctttagccagatgatgcccattgccaggtcctgcctgtaggccccgcagtctgtgacaaggctttcctttggccattcccgactcattcaattcccagcttataggaattattatttcttctttaggatgattccaataaatttccattaaatgactgtaacagtaaagattagctaaatgagagaaacaaaggctgtaatgagcttgctgtagcaagggagtcagacttgcatattggcagaggagaggaaagctttattgtggaaaaaagggaagcctttaggtgtgttctgattggaggttgtttacaagggaagctgtctgaggatttactagaagtcgggcaactgatgtgattggttatgggtacatgtttggcttagcctggttggtcctatgttggaagtgggacaaaaattagggaagctatcagttattaatcgagttctggccatttggggccaattgttagggaagttgttgttcggtttcctggattgtcactagagatagcaatctggctttctctgtaagtctaacttgtagcaggctggcttccttgattgtttattctaagtaagcgggttagtttcctggacaggtgtgggtgaaagttctatttttaaatgtggtctggtaattgtctatttgtatatgtagtccctcacagcagaatctgttttgtccatatatatatatatatatatatatatatacttttttttttatggtgaaaagatatatatatatttagaattaggcagctggactcagtttagatgatcccaattttgttggcaacatccaaagcatcataatcaggagccagtcgaacatataccttcttctctccatcaggccgaatcagggtgttgcccttggccacatcaatgtcatagagcttcttcacagcctgtttaatctggtgcttgttgactttaacatccacaatgaacacaagtgtgttgttgtcttccatcttcttcatggcagactcagtggtcagcgtaaacttgatgatagcatagtggtcaagcttgtttctcctgggggcgctcttccgaggatatttgggctgtctctggagtcgcagggtcttggaccgccggaaggtgggtgatgtgcggatcttctttttttttgtggctatggacacctttcaacactgccttcttggcctttaaagcattcgctttggcttcggctttaggaggggcaggagcttccttcttcgctttcggcgccatcttgtgaaaaagctctgtttttgtcattaattctcaataggcagattggactgtcaccttgttgcctaattgttaaatgtttactgactactattgaaagacactctgaggatatacttttttttttttttctgagacagagtctcgctctgttgcccaggctagagtgcagtggcacggtcttggctcaccacaacctctgcctcctgggttcaagcgattctcctgcctgagcctcccgagtagctgagactacaggcacgcaccaccatgcccagctaatttttatatttttagtagagacggggtttcactatgttggtcaggctggtctcaaactcctgacctcgtgatctgcctgccttggcctcccaaagtgctgggattataggcgggagccaccgtgcccagtgaggatatacatttgaataaacatagtcactatctccaaggggcttacatcttaccttcttaatataaatagatcagacagacagttaaaaagttctaggtgccatgaaagctgtgggtaaaatgtcatgagcgttcagaaatgatgtgaaatgggatggaaagacagagttaagagttggaatatatcttctcaatgtaaagaagcaaagatgaagctgggagcagtgactcacgcccataatcccagcactttgggagggcgaggcgggtggatcatctgaggtccggagttcaagaccagcctgaccaacatggtgaatccccgtctctactaaaaatacagaaattacctgggcgtggtggcgcatgcctgtaatcccagctacttgggacgctgaggccgaggcagaagaatcgcttgaacccggaaggtggaggttgcagtgagctaagccgcgccattgcactccagcctgggcgacagtgagactctgtctcaaaaaaaaaaacaacaaacaaacaaacaaaaactcaagcaaaggcagtaccttcactgagaaaaaggaaatggagaaatgcaatgtgcaagacataattcggcaagcacttgaatgttgttgcgggatcatccctgatggaatcttaaataattatgctatcaattatttgggggatattcagataaatgtcgaagtatatcatggtaaaagtggaggggtgaaaatatttgttttaaaagtgatgagattacaggctgacacctgtaatctcagcactttgggaggttaaggtgggtggattgcttgagccgagtagttcaagaccagcctgggcaacatcctgtctctttgaaaaaaaaaaagtaaaaaaaaatttttaatgtgttgagtcctaaaataaattatgatcagtttttcctttcttattaaaattagaatcccaaactagaaatctcagtcttggctgggcacagtggctcatgcctgtaatcctagcactttgggaggctgaggcggatggatcacttgaggccaggagttcagcatcagcctgggcaacgtggcaaaaccctgtctctactaaaaatacaaaaattagctggctgtggtggtgcatgcctgttgtcccagctgctcaggagtctgaggcaggagaatagcttgaacctgggaggtggaggttgcagggaagagaaggttgcagtgagctgtgattgcgccactgcacaccagcctgggcgacagaatgacttcatctcaaaaaacaagacaaaacaaaattaaaaaaccctcaatcttgataaagcatctttttttttttttgagagaagtctcgctcttatcccccaggtttgagtgcaatggctcgatctcagctcactgcaacctctgcctccggggttcaaatgattctcctgcctctgcctcccaggtagctggtattaagtcacctgccaccacgcctgtctaatttttgtatattttagtagagacggggtttcaccatgttggccaggctggtttcgaactcctgacctcaagtgatccgcctgcctcggccttccaaagtgctgggattttccaaagtgctggcattacaggcgtgagccattgtgcccggacttttttaaaaaaaaaaacaaacaaaaccagttctgctctgtcacccaggctggagagcaatggcacgatctcggctcactgcaacctccgcctcctgggttcaagcaattcttctgcctcagcctcccgagtagctgggattacaggcacccaccaccacagccagctaatttttgtatttttagttgagatgggctttcaccgtattggtcaggctggtcttgaactcctgacctcaagtgatctgcccgcctcagcctcccaaagtgctgggattacagtcgtgagccactgtgcctggactattttgggttttttaattttatttttgaggtggggtctcactctgttgcccaggctggagtgcagtggtgtgattacagctcactgcagcctcgacctcctgggttcaagtgatctcgcacttcagcctcctgagcagctgggactacaggcgcatgccaccatgcccggctaatttttgtattttttctagagacaatcttactgtgttgcccatgctggtctcgaattcctgggctcaggaagaaatccttccgactctgcctcccaaaatactaggatcataggcgtgagccaccttgcccgaccaactttattttttagagcagttttaggttcatggcaaaactgagtgaaagctacaaagatttcccattaaacccactgcctccacacaagcgtagagtctcccattatcagcattgcctaccagagcatttgctacaattgaacctacattaatgcatcattatcacccaaagtgttttttttttttttgagacggagtctcactatctcacccaggctggagtacagtggcacgatctcagatcactgcaacctccgcctcctgggttcaagcgattctcctgcctcagcttcctgagtaggcgagactacaggcatgaactaccacgcctggctaatttttgtatctttagtagagacgggggtttcaccatgttagccaggctggtcttgaactcctgacctcagatgatctacccaccttggcctcccataatgctgggattataggtgagccactgcgcctggcctcacccaaagtgaagattgtttacgttaggattcagtcttggtgttgcacattctaggggtttagacaactgtagtataacatctgttcattattatcatttttattttaaaacattttatttttattttattttatttattttatttgagacagtatcttgctatgtcacccaggctcgactacagtggaatgatcacagctctgtgcaacctcgacctctccggctcaggcagtcctgtcacctcagccttccaagtagcttagaccacaaggaggaccacagcacctggctaattttttaaatttttttgtagacatgggggtctcaatatgttgcccaggctggtctcaagcttctgggcttaaatgattctctcattttggtctgccaacatgctggggttgtaagtgtgagccaccacacccagatcctattattattattatttagagacagggtcttgcactgtcacccagactagagtgcagcggtatgactataacttactctaacctcaaaacatattcagtgctatcaaactgaaatcaattatactgtattataaatatagtgctattcttgagggctattatggtacataggaccatttgcccatacataaagtgccctagactgcttagcttttggtttttggattggtgtttgctatcacctttgttatcagtgggttattaaggtactattgccaaatctccttctacagcttcctccatctgcttccattctgcacttattgagagtcagatgtagaagataagatactgcttcaggcacttggtgtacaaaagtcaggaggtaaaagatgataaagatatccccagctataggttataacttataaggaaatagatattgaatagtttgatgggtctgcaaataggatggagacttcgtctgaagttatggcatgagcagaggcatggaagtgtggaaatacgtggttatttgagggacggtgaatagaccatgtggttagaatgttagattgcagagggacatgaaaaacaaggtatggggccacaatatggagggctcagagccaaaagggatttattttcccccctctaagtaatgggtagacaggaaaagttactatagagggaagtggaaggattgatcctgtgttttgcagagtgcctctgagatcagaggagagggagggggagaagcgggagagggaaggggagcctccaaactaatgcaggtctaactttggtggaaggggagagaagcagaataaagactgggtaggaagagtcttacagtacagaacagatctaagagagtttccatcaggcccacatggagtcctggagctacagctgcccatgggaggagtcttatatctccagagaatgaatgagtctgcattagttttccggcagagcttagtcactggcttcgggcagcccaggagaagcatggcgggtttttttttgttttttgtttgtttgtttgtttgtttgtttgagacacggtctggttatgtcacctaggctcaagtgcggtggtgcgatctcagttcactgcaacctctgcctcccaggctcaagcgatcctccctcctcagcctccctagtagctgggactgctggcgtgagctaccatgcccggctacattttgtattttttgtagagatggagtttcgccatgttgcccaggctggtcttgaactccgagctcaagcaacccgcctgccttggcctctcaaagtgctggaattagaggcatgagactcatggttttgggtttgtttgtttttttctttttgagacagagtcttactctgttgcccaggctggagtacagtggtgcaatcctggcttaccgcagcctccacctcccagattcaagattctcccgcctctgccgggcgcggtggctcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagctgggggtgtttctcctgcctcagcctcccaagtagctgggattacacgcctagctcatttttgtatttttagtagagatggagttttgctgtgttggccaggctggtctcgagctcctgacctcaggtgatccaccctccttggccttccaagtgctgggattacagttgtgagccactgtgcctggccagaagcatggtttttgtacagacgtggtggttgatccagagaggcaggagatgaggctgtcagtcagtttctagatggggtagtgatgttgatgtcattgattaacagagggggaacagggagaagtggaagaagagattgggtcttgcttgagcagaattgggtttgaggtattcgtggaacatgcatttggaaaagttgaagcaaaagttgcaaagtagagtctagagatccagagagagaagagatggagttgcagatttagtgagttttccgacaaattcatgagaattagtgaaatttcccagggatggagtgtggggaagaaagaaaagccaggatataaggaaataaaacatgcagaaggagagaggcagggcagtctgagatgaagtcatcagaggcagaaggatatattttcaggcagggagttacggacccctgtgtcgtattctcgacctttcttaggcagaagagggaagaaagtctgcataaagacataaggatcctccgaggtgggaggagttgaggggctgcatttctgacgatctctctgcatgagagacaggaaggctgagactgagtactagggaaaagtgaatttcagaagagctattgtgtgcatctgggtggcgaggacccttgatcggtctgcagggagggtctgctgagagcatctgggtggcgaggaccctcgatcggcctgcagggagggtctgctgagattgaatagcgggaatttgtaaggcctgtttgagtgtcctccaccccaccatcagtcagtgacttggaagcaggaacagagaaatgtggtgactgagttcagccgaggggaggacttcaaggtccactagtcagctcagtgaggttgagagagaggtggggcagccccacccacattctgcctgcaagctcagtgacccgcctcaggaggctgggagtgagggcccgggctgaaccggggcgcgtgctagagaatagggacgtgagtcgctgtgggcgaatctgtgttgtgacttctattcttcatgtcctcttccccactccatcaaatagcactgtgccttgcttaaacaagtctcagttatacgatgtacggataactttgatctcattttgactcaagtttgctttactttttgtaagtccagagtattcatacaaaaatgcaaactgagaattttagtaagaattctcaatgcctgtatcatcaacatactaactgactgaacaatgaagaaataaaattttgggaagtctgaaattattgtagacactgcattattttatacaactttcttaatagctgcaggtttccactgataaatgtttctctgaggctcacacattttgggatgtagttgaaccaaatgtgagaacaatttatgcattgattcatcatcatgagtctgtgatgggtgagttcctgggctagccatacgtgaaagtttaggtgaattttcattgcaacacattgattcacctgtattttctgagcatttactataagagattacaatttacttggtgtgattctcggttggactgcaaatttctccatatgacttttttttgaggtagggtctcactgtcactcaggttggactgcagtggcatgatcatggctcactgcaacctcaacctcctgggccaaacagatcctcccactactgcagcttcctgagtacctggactacaggcatgtgctaccacatggactaatttatttcattttgtagagacgggggtcttgctgtgttgcctaggctggtctcaaactcctgggttcaaaacatcctcctcccttagcctcccaaattgctgggattacaggcatgagccactgtgcccagcccatatgcctttgatctataaaaaattatctttttctcaagcatgatacactgtttgagttggactcttaggacacagtcttcacttcttgttcttgctctgtaggccatgacaatgtacctttggggcagcaaagagggaaaacaaatcctctgggacctgcactgattctcatttcaaactcagcatttggcctgaatacataggtcagctggtattccagataaatactatgaattgcaatgtttctctgtacatttcttaacatttgtagattaaatgaaaaggggcctcccacaggaaggagtatgatccaagttcaaggagtaaaataacaagacatatcatcccttgtcccactccccacagtgaatgttgttttggttttgctacagctggtagggtcttgaagctatgcatctctcgggtgatcaggaagagctgcagagactgctcactcatacggagacaagggaccaaggagtcatcagaaacatagatgggacacgcctcagctccttttgagtggaggtgtcctgaggagagcggtaacccctgagggtcaggaaggactgaatgaggcgtggtattaattggctgagcaagaagacagggaagagcctggcaggcttagagcaaggagactcagagccccaggttgggcctgcgtgccgctgccctgaccacatccttacacgtggcacagctctgctggtctgcaagggttttaggttcagtttcctctgtacgctgtgcagagcgtagcgtatggattggcttggctttctcgaacgattcaacacattccgtgattcagctgacttggctagtgaaaccctcctctgcccagggaggaaacttgacaagtaacagggagttggctctatggactgcgtaagtgggcttgatccaggtggctatgggggagagaaaggagtgctataaatgactgggtgatgttggggaaaggatcagcatgcagatggaatctgcttccaaattctgacttcccttcagaaagatgagaaagtcctgccatgctgtcattcatggtctgtttatcttgattgacaccccagccccaccccatggttccctctcagcttcacagctgaggattaggatgttggcaagaacaatctgcccaggcagtctctgtcctcacattctggccccagctttccccttaccctctagcagagaaaggcctttctcaaactggtgacattgggcaaattcaaatatgagtgtgttggttttcagtcctgatgatttccttggagaccttttcctagtgtcttgccaagcacatggagggcgaagagtgagggaggctctgacgcggttagtggctgctgtgtgtgaggcgctgctggctgggctccccagaacatggtctgtggatggcctactgatgcctgggactgatgggatgtacacccatgtacccatgtattttacaaggaggatttcattctacatgcaacattttaattttatttatttattttttttctgagacagagtctcgctttgtcacccaggctggggtgcagtggcacgatctcggctcactgcaagctccgcctcctgggttcacaccattctcctgcctcagcctcccaacattttaattacaaatacacaatataggcacattgttcaaaactcaaaagcacaaaaatatatacagggagaccaggtggggtggctcatgcctgtaatcccagcactttgggaggctgagactggaagattgcttgagttcaggagtttgaaaccagcctgggaaacatagtgagaccttgtctctcttaaaaaaaaaaaaaaaaaaatatatatatatatatatatatagtgaaaagcaagcctccctcccacatctattatcttgtatttattatcaatttcttgtgaatcatcacaaagatgttctgctaatatataaacagatgcacatataattatttttaaaatataaatgataacaatattgtgggtatatatatatatggtgtaaaactttaggtatagcatttttagattgtcaaagaagcaaaaagcaaaacctgaatacattttcccttataattgaggccaaaagaaattgtagggttatgtttggggtaatgggttaaggatgggaaacaatgtgtgcatgtgtgtgtgtgtgtttagttgtagcaggtatcttgactcatacagattgcctgtccattttaatgacatttttccagttcttgtggaaattcacataaacaggatattaaaacctagtcctagtaatgtattgaaaatttaacagctacttgggggccgaggcaggcagatcacctgaggtcaggagttcaagaccagcctgtccaatatggtgaaaccctgtctccaccaaaaatacaaaaattagccgggcatggtggcaggtgcctctaatcccagctactcgggaggctgaggcaggagaatcgcttgaacccaggaggcggaggttgcagtgagccgagatcgcaccattgcactccaacctgggcaacagaagactccatctcaaaaaaaaaaaaaatgaatatttaacagcaaaatcatcttattgctattggaaagtatttatttgatgcagtggttagtgcaaaactgttgctattttaggcgcagtggcaaaggagttgctatagaagggctcttatgtggaatgatgtaaagaggaagcattcattctaaattctgagaagcagaatttagcaagcagaagcagcgcaagttcttacctgcagattcttaggaagtgatgcctagaggccactgaactctgttcttggtacattaggaccaggagattatgcaatgctctgaggcagaataaacaagatcagaagcaggcatttattctgcaagaaaagaatttactgtgtaggttcctgaaggattgcctgaattccttcatggctgagagtgcaaaataatgcacagctgctggctgccctgcatagctgtaggcaaggatccggaagatgccatcttgtctccaagtgtttctttttctttaggcagggtctcactctgtcacccaggtgggagtgcattggtgcaatcactgctcactgcagcctccacctcccgggctcaagcaatcctcctgtctcattctttgactttttttttgtagagacgaggtctcactatgttggtcaggctcgaactcctgggctcaaacaatccttctgcctcggcctcccaaagtgctgggattaacaggcgtgagccactgcccccagccttcaagcgtttcttaatggattcccccttttctcatttggtctctttcccccctggttagtttcattgtagttcatgttcaggaattaggcttgtgcacaggagcaagctggttttgtccagttgaaaggaaaagggtgaggaatgtgctctgctgtgagctttgctctggggggaaaatctagttttctttttcccttttcccatttgctttccaaggtttggatggcacaatcaccttctcagaatgcttcttttactactcaggaggaaaaggctgccactttgggattgaaggaccccatactgtttcctctagaaaggtagctcttttccacgggagaagaggtgtacagtggtaggaattgtgtccttagttaggatttggggttttatttagacatcatcatgtcccttaacttggacttagacactggattctgtgaagttcagtttcaggttggttcagcaggtagatctctgatcatggacttttctgtcttctctccttttctctgcatctattgctatcttgacaccaaagttactcaaactctgggcttctaggtacactgggtttgttctcctgcagatctggccaaagtgatatttcatgagtgggtctgagaaatggcaaccagtgaacaaacatttgaaacaattcagacactcactaggctgtatgtttggggaattctttttattatatgtgggtgtggaagcctgaggtcttagattttatcacagtaagaagcagcttacccctctgttcatcaagtcacagactgtcttggcttctagctgggaagtttttgttgggaagttttgtagtgttgggcaatggatgagtgaatggaaagaagcgtgactagggacctactcttaatggctcgaaaatgtccattaacttgttgtataggggacagctcattctattaactcactttgttctcaacagaaggtaaaattgggcataactaccaagctatcatgagaaccaatccaggaaaactcattagtcccaagctggataggggcagagtccacaggtgcttgagaagtttgggtggtcctatagagactagagtatatatttatcaccttagaaacttctttgtctcatgtttgacagtttttatgcttctgggtcttacagataattaatattttgttctttatttaagctagtttgcctttttttttttttttttttgagatggagtctcgttctgttgcccaggctggagtgcagtggcgtgatctcggctcactgcaagctctgcctcctgggttcacgccattctcctgcctcagcctcccgagtaggtgggactacaggtgcccgccaacacacctggctaatttttttgtatttttagtagagatggggtttcaccgtgttagccaggatggtctcgatctcctgatcttgtgatccacccgcctcagcctcccaaagtgctgggattacaggcatgagccaccacgcccggcccactagtttgccttttaaaaatttcaggtatttaattaaagtgtgtaagacatcagtggctgctctgcaggatgctgatttgtatctggagacccagaactgatgaattgggccagtgggttcctggctggtctaatgtggcatcttctcttccttactgtttgaggacatggggcagggcatgaccagtgcctgagtggcaggtggtgactgaagggagggagatgggaactgggctgtagtcagggctctctcgcaaggggcttgacctttacctattacctcctggacacctgtgcggagaggtatgagagaatgggttttcttgtgaaaggaaaattcaaatctctctttacttgagagtctagggacttcagacatcaccatcccccatagcagctctgatgattttcacatttgaatgaaacacttgaaatttttaaaaggccaattagtataaatgaagaacaaaataattaattataaagacccacagtcttgaaacacagtggcaggcaccatcttagttcttgtgtttcttcttctgtcaagtgaaaaaataaactaccatttttatcttccgcaatactcccattcaattgagctgcttctttttattttttatctttttatttcaatcctgctccttctgtagtcaattgcgcttcttgactggtctcctggagctaattgtcaggactggggtggtgccccacccccttcctgggatcctagccttctccttcctttgggtgagatcctatctactccttctcaggaggtggcctctgctgcagacccataaaactttaaccccacctttcctatcagtgagaattaacataacagctagggctactatcacaggagtggaaaataaaccatagtaaagagaccttccaaaagtctgcaagcaaaatctaaacacatttgagcacctctctatggggcgagagcatagatttttgctgaaggcaggcagaggggtggcattttgtgttctcagagggaagcgatctggagtttgatttagttcaggattcttctcagcttctagccccgagctccagggcttctatcacctccatgactttcctgaatctgagtccttgaagtgcatttttcagaaaacttgggtcctactcttcctcttcctttgggtgagatcctatctactccttctcaggaggtggcctctgctgcagacccataaaacgttaaccccacctttcctatcagtgggaatgaacataacagctagggctactatcataggagtggaaaataaaaccatagtaaagagaccttccaaaagtctacaagcaaaatcaaaacaacacatttgagcacctctatatgcagcgggagctagatttttgctacagtacctagtgagggactgtaattgtggctcttggcacaatagccaaattcctatccctctaatcctactgtgtctcctggggctgggtatgaggaaggagagtcctgcactggaagaattaccttagcagtttcacttactatgaggactgttggtttcagtaacccttttggctcccatcaatgtccatttagctatttctaattatttcaactactataatattatttttctccaggcatgcagccaaataaagtcagccattgagttggttctctcagccgtgctgcttgtggaacaacgtgactgcaaggccatattgcttccctttcccatgccaggccgtgtgagtgagagagcaatcagtgcaaatctttgggctggataactggcggtgctggtttgacctccggccgggtcactgagggattgttggggaggctgctgcacccctctgcacagacttccaacatatcccagaaccatagcaccagctctcttaagccagaggataatgttagttagtaaagagaatgatgctattggggtcgattacttccactagtagaatcttaatgatgtgtgggaaaccatgtctctggcaaagtgctggagttcacctgagcctttttttttttctggagacagtgtctcactctgttgccccggttggagtgcagtggcgtgatctcagctcactgcaacctccgcctccctggttcaagcgattctcctgtgtcagcctcccaagtagctgggattacaggcacatgccaccaggcccagctaatttttgtgtttttagtagagacagggtttcaccatgttggccaggctggtcttgaactccttgacctcaagtgatcctcctgcctcggcctcccaaagtgctgggattacaggtgtaagccaccgtgccccaccaacctgagccttttttaactggccagctgggcccaagagtattatcgtgtctcctaaaaatgactgatacagtttttttaattagtttcctatggctgccatgtaatatagtaccacaaactaggtggcttaaaacaacaggaacctgttcactcccagttccgtagtcagaaatcaagatgttggcagggttggctcatttctggaagctctgaaggaggatcagttccctgcctctctcccaggttccttggcctgtggatacattgctccagtctctgctgccatcatcacatggcattcttcttgcatgtgtgtctgtgtgtcccaattttgctcttcttataaggacaccaatcattggattacggctgaccctaatccagcatgatctcattttaacttggttacatcagtggagaccctattttcaagtaaggttatattcagaggtaccatggggttaggatttcaaagcatcatttttgggaacacaattcaacttgtaacactcctcttatccatctccctcctggactatagtgctggcctcttactgtatctccctgggccggggtctcccctcagtgacctttccacaccatcagtagaattatcttactgtattgtaaaaagaatcatactatccagctttatttccaaaggctaaactcagtttgacagacagagcccttcacagactgttgtcattggagagctggaccaacgcagaacagggacctgtcccccctgcacaggatcataattgaagccggactcgcctacaaggcactgctaattaatctttcctcctactgggcgtctgaatcattctgcccctaagaagattatttgggaggtgattggactttttgcatgattgttcctagggatgttgtccttgcctatcttctcagatgtgggtttattgcatttttacttatttcctaaactttcaatggaagaaggcaagatcatcttccataaggtagttagattatattactcatgaaactaataacttcaagactctctttccttactctactgtggcaaagtaccatatctctctctttttttatttttttttttattgatcattcttgggtgtttctctcagagggggatttggcagggtcataggacaatagtggagggaaggtcagcagataaacaagtgaacaaaggtctctggttttcctaggcagaggaccctgcggccttccgcagtgtttgtgtccctgggtacttgagattacggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgatgtaaagaaccaaaaaggccaggcatggtggctcacacctgtaatcccagcactttgggaggttgaggcgggtggatcatctgagactgggagtttgagaccagcctgaccaacatggaaaaaccctgtctctactaaaaatacaaaattagctgggcgtggtggtgcatgcctgtaatcgcagctagttgggaggctgaggcaggagaattgcttgaacctgggaggtggaggttgtggtgagccaagatcgcagcattgcactccagcctgggcagttaaggacatctgcctctgctgttcactgggatataatgtctaactgtggaggaggaaaggtggggactcctaggctcttttttcccatctttttggattggtgccattttatacaccagaaacactgagttgaaattttatttcaaatgatgaattagtcttaaaaggaagacatcttatttgaaaatataggtgtccacttttcatttccagcatggaaacaaatcagacatagatggagtatggtgataattcctaggtgattttttaaaagttagtttgtggaagaggtaactttaatttctagcaggatcatcatgacatgaggacagagtaagtggttgcctctgcaattcaaagtattcctagcaaggggcacagattggcttttagattaacatatgtaaaaaccaactttacttaagggaatgcaggcttcactaagtgggaaatcataagttgtaccaacaggagcttttgaaatacccaagtacatgctcccaatcaatgagtgttaacaatttgataaacactttgcatctttgtctgcttttccatcattgcaaatgtaatcctggtgggtgcatgtgctttgtcgtagatgcaattatttttatcatatcattataggagccagatctctcagcacaatcattccagtattgctgtccctgtacataactcttagtttcaatatgctccactttattaataaggggacaggaaaatcaaagaactagtttctctgtagcgtctgtgaatgcgtttgcattgatgaaggcttctttttcattgtggtattggtaaaaatttgaatggtaaattccaaggttaatttcaaaagaaaatggcctgtttctcttcccccttaagaaaagcctcaaaagtacatgaacgggctgcagcattccagccatctgaatactggccagcagcctttgctcttggtggccataaagaatattcaccatattgctttctggctgtgggcggatgttaatttaccgtaggagcagccagtgttttgagaaggagatgatgttgtcctgtacttttcatttacttttcaggtgcattttaaatactatttctttctattctctgaaagctgatctgaaccagagagtgatattacaccccaccagcgctgatagggagggctgtgcacatgtgggtggtagatttcacattatcatccttctgaatggtttccatagagatggaaccaacaaattccggagacgtgaggggaaaataaatggatgacatagcctcgaaagaaaacaaacatttgggctcttgaaagaaaatttacatcaggtctagaatttattttatgggtttcactattccaaattttcaactactgataacatcagaacatttacatattccttgtagctatttctgtttggtatatttttgtcagcaggattaaaatgagagaatctcaggagtgtttgtcctgcaaacccccataaccccctttcccaattccaaaagaaagtcacagccaaaatgatagagaacactaattattttgggttaaatattaatgccatgttgaatatatcaagcatcctatttgagctgaactaaatgccttcttggatgtgcagatacctttttatatgttaaaatatatttaggaacaaaccagttgaattagtcatttggaacatagacattatagatgacaggcatgttttcttaatcactatgttttacctaattgagtcaaactcttgtaaacatgatggcaggccttttgatagtatttttctcctgaaatgagggttatttgtcatctctcagatccaaggctcactgtcctttaatagatcattgttaagagcattaacacctgtttaatttcagtagtgccaaaaacctctagactaatacaagaagtttacatgtaaaaggagtgagattacatatttggcatatttgcaagacaacaattttaaaggtctctacctttagcaatgctaaataacattaacctcaccttggacttatgaaaggattgagagagaaatattacataagggacagaaaagatgtaactaatttgaataaatagtttttaagtggaaatatgtaataatatctaaacagaattctgcagaagtgcttttaggaaaggtctatcagcatatgctttaaaaacttttttaaagatgaaaacgaaaaaaactccaacttttcaagagccaatgggtcattgaaaatactgatcctaagccaggcatggtggcttgtgcctgtggtcccagctccttgggaggctgaggcaggaagatcatgtgagtccagaagtttgaggctgtagtgcccaatcatcgcacaggtgaacagccactgcactccagcctgggtagcatagcacaagcctgtatacaaacaacagaaaagaaaatcctgattaggccaggtgcggtggctcacgcctgtatcccagcactttgggaggccgaggtgggcagatcacttgaggtcaggtgttcaagaccagcctggccaacatggcaaaaccctatctctacaaaaaatacaaaaaaaattagccaggcctactgataggcacctgtaatctcagatatttgggaggctgaagcaggagaatcacttgaacccaggaagaggagactgcagtgagtggagattgcaccactgcactccagcctgggtgacagttagactccgtttcaataaaaaagaaaatactggttatatactaggtctttttttttttttttaagacaaggtctccgtctgtcacctggactagcgtacagtggtgctctaatagctcactgtaaactggaactccttggctcacgtaatcctcctgcctcagcctcctgagtaggtgggacttacaggcccctcgccaggctaattttttttttttttttaaatttttagtagagacaaggtttctctgtgttgcccagtctgatcttgaactacttgccccaagagattttcctcccaaagtgctgacaggtgtgagccaccacacctggcctgtatactgagtcttaaaacatacacagacacatatagacagaaagctagggattttaaaagtttttgaatgtcttatgaattcaaaataacttacagatgctaatttacagttgctattattcacttgaataacctttggacagtacattagtctgatttgagcattaagaaaaatctctcatataggtgatgttatttccattgagaggcaagagatattggctagagcgacgtttagttatttatcccagttcacaagtacactcatgccctgcgtagtgatattttggtcagtgacagattgtgtatatgacagtggtctcataaaattgtaattctgtatttttactgtaccttttctgtatttagaaacacaaatacttaaccattgttgtacaattgcctatagtattcagtacagtaacatgctctacatgttggtagcctgggagtgataggctatatcacgtagcctaggtgtgtagtaggctataccttctaagtacacgtaagtacactctatgaggttcacacaacaatgactaaatcacctaacgatgtatttctcagagcatatttctgttaagccatgcatgactgtagaaaattaataagattaaggcttggcacagtggctcactcctgttatcccagcaatttgtgaagctgaggtggaaggatcacttgagcccaggaatttgagaccagcctggacaacatagtgaaaccctgtccctacaaaaaaaaaaaaaaaagattgaaacccagggcttcagctgggcgtggtggctcacgcctgtattcccaacattttgggaggctgaggtgggtgggtctttgagcccaggagtttgagaccagcctggccaacatggtgaaactccatccctacaaaaaaatataaaaattagctgggcgtggtggtgcatgcctgtagtcccagccactcgggaggttgaggtgggaggattgcttgagcccaggaggtggaggttgcagcgagccaagatcaggccactgcactccagtctgtgtgacagagcaagactctgtctcaaaaaacaaaacaaaaaccaaaagccagtgcttcttaatacttagtagttttgaagatgcaaggatatctgtgaatcactgtagtgtttaagagaatgcagacagatatgctctttctggagaggaacatggtactatgctctgggagccttagaactaattatcagggtgggcgtgataattacacatgactcacgcctgtaatcccagcactttgggaggccagggtgggcagatcacctgaggtcaggagttcgagaccagcctggccaacatggtgaaaccctatctcaactaaaaatacaaaatttagctgggtgtggtgtcacgcacctgtaatcccagctactcaggaggctgaggcaggagaatggcttgaacccaagaggtggaggttgcactgggccgagatcgtgccactgcactccagcctgggtgacagagcaaaactctatctaaaaaaaaataaaaaccccaaaaaactagttatcatatataatttggaattctacttctaagaatgtatccttagacaaagataaagatcttaactattatgctatttctaatatttgaaatcaaaagtattcaactggaaggaactcgttaaataaatcaagatttacatgaagaaattataacttaaataatttatttcataagttatttaataccatagagcagttaaaatcatgttttttgaatagtatttaaagatgttatgttagacattgttcatggaataatgttaactgaaaaaagttaagatacaaaaactttcttttatttttagtagagacannnnnnnnnnnnnnnnnnnntgatcctccccaccttggccctccccaaaaggttggtattacagatgtgagcctccacgcctggccagtactacttttagtataaatagattatgatgtagaaaagagattggaaaaaatgcacctgaatgttaactgtagttatgttaaagtttggaaattaagtgattttattttctcaatagttatctggattttccaacttgttacaaagaacatgtataacataatcataaaaaaggtggtaaatgtgttcctgacccataagagatggttaatgaatggtagctggtttctttaacatttggaacatacaataaaaagaaaatttagtgttaatcatcttacctcccagagaaaaccagcttacattttggttcatctacttgtttttacaaacttataaaaacgagaacgttttgtattttatgtatttattttttgagacagagtctcactcccgtcacccaggcgggagtgcagaggcgtgatcatggctcattgcagcctcaaactatcctccagcctcatggttattttttgttttttgagatggagtctcgctctgtcacccaggctggagtgcagtggcatgatcttggctcactgcaacctccgccttctggtttcaagcgattcttctgcctcagcctcccaagtagctgggactacaagcacgtgccaccacacccagctaatttttgtattcttagtagagacggggtttcaccatattggccaggctcgtctcgaactcctgacctcgtgatccgcctcctcagcctcccaacgtgctgggattacttacaggcatgagccactgcgcctggcctgatttttttgtagaggtgaggtctcatatgttgcccaggctagtctcgaattccagggctcgagtgattgcccacctcagcctcccagagtgcaagggttacaggtgtgagccaccatgcccagcctccatctacttttctttcattacttttctttctttcttttttgaaagctttgaaaccaacatcttcttatctttgacagggagtgtggtggggaggttgcctttccaagcagtacaatatcgagactttgaaataatttcctgagacttgtattggggtgttggtgtgcggctatgtgtatgtgtgtgtgtgtgtgtgagagagagagagagagaaagagtgtgtgtgtgagagagtgtgtgtttgtgtgtgtgtgtgagagagtgagtgtgtgtgtgtgtatacaacagaatggatttttgcttgaagagactggcttagcaactgtaaattagtttgccagattctaagtgggtggtgaactggaatgaatgaggcacacaatacatggtgtaggcaaatagaaagggaaatctgaacagaaatggggtcatacaaaaggcatagacaacaggcaggcagttgtgatcttgaatcagacaagatctacacacatggcttgacaccgtgaagacagatgtggcactactccagccaagtgcttagattgcttgggtaataaaaaactttcattttacttggaatcattatttgtcatgtagaaacacatacacatgcaggaatacacacatacaatctagtccatctgataaataggaaagacttagtatatccataaagacaggcacaagatatacgacaggaagacagagaataatgttccaaagaattcatcacagcacagaaaacaacagaaaaaacaagcagtgtctgctaaaaaggaaatgataattagacagtgtgaatataatactatgcattcattgaaaatgatgctgtaaaacatatttgctgatgtgggagatgttcatgatgtactaattttttttttttttttgagacggagtcttgctctgttgcccaggctggagtacagtggcgtgatctcagctcactgcaacctccgccccgcgggttcaagcgattctcctgcctcagcctcctgagtagctgggactacaggcacgtgccaccacgcctggctaattgtttgtatttttagtagagacgggtttcaccatgttagccaggatggtctcgatctcctgacctcgtgatccgcccgccttgacctcccaagtaaaataggtgaggtgtggtagctctcgcctgtaaggatgaaggaactaaattggctaactgacatatccaaagccacattcttggctaataattgaaggagataaagttagaatccatgtttacgttgccttctaaacatttccatcctggaatttcaatagccatagagttaactgccatggactcttagtaactggataatgagaattcttaagtagacctctattaatttcttagcatgtagaacttctcctggttaacataaaacaaatatccaaataaataaataaaatgtttgagtattacatgttacattcttggatgctttcctattgtaaaatgtgaatgaggtcttttatctaggggaaagataatagcaaatgaaatttctgtttatgatattataggtagcctcaagtgcagtggctcatgcctataatgccagcatgttggcaggccgaggcaggtggattgcttgagctcaggagttcaagaccagcttgggtaacatgacaaaaccctggctgtacaaagaatacaaaaattagctgagcgtgatggcatgtgcttgttgtcccagccactttggagacttaggccagaggatctcttgagccttgtacattgaggctcagtgagtcgtgatcatgctattgcactccagcctgggtgacagagcgagaccctgtctcaaaaaccaacaaacaaaaaacaaaaaaacaacaccagagagatagaaaaataagtactgcttatccccaaacaaagggtaatattgttactatgatttaattctaagctttacaaaggccaaaaagaagcttactggtgtgttatgtaattctcctcaagataggcaaattattttcaggtactgaattctgaaatgatagcattttgtgtgcttctctaaacagcagtcagtttggacaagaccttttgtttcccttgcaggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacaggtgagaggcctctcaaagtgctggaattccagttgtgggccacctcgcctggccttgttttctttctatagtatattgtgaatattactttagtcagctttctagagtatgacttttcagagaaactgaaaaactcaacaggttcaaaaacctagaggttggatatttcctctcagggtccttcttggtgtctccacccggattttggttggggttggggaagatcagacgggagggctgaggttggcaggcgaggggtaaagacatctgcatatttggtgaggggactatttttgggaggaaggacagggagccggtgccaggtcccccactgggaagtgctggcttggggaagcagccaagcgcaggcctgggggctgcgagggtgggccagcagggttgttcaggggacagggtgaggtctctcaaggcagggcagtgaggctagggtggaaatgtgaccttaaacagctgactcggcacctagctttgggagggcagagggcgggagcaggggagggggaagctcaattaggagtggactttggatagatgtggctgggggtgggggtgagggtgtttcaagggcaggtgtgggtcagacgtgaggatctcccccataacacacacacatgactgagtgcccgggagcctctccgttgttccaaaccttggcagcatagctgagtgtaaaggcatgagggtctctgtttggtggggttgtaagagggtagtgacaaaggtcctggcactatggtcaagggtggattctcaggcccatagagtaggacttctattatctccatggcacttacatggaagtgccataatttatttaatctctcgtctattacacatatagtttatttccgtctcttactgttattaatagtacttcatgtgcatccttataataaatctttgtcaaaacttctgattatttcctgaagagccatttctggaagtggacttactgaatcaggatggttctccatttcttctgcttcccttatttgccttgccagtacttaggagtgtaccttcctggtggaattctcatgtagatggccatctggttgggaaagacgcacacatgctggccgtgtcttaggttttgtgctcctagccctgaatgcccatgtaagcctcttttttggcttatgcagagttggggtggggagtgagctccatacttggtcagcaagtttagaggcctctggtgcattccagccataggcctttctgattcctgagcagccgttgggggtgggttcaggttctcccttctgtcagggacacacagccacaaaagagtgccatccacccacctctctggttattattctcagctttttgctaattttcatcttccctctttttttaaaaaattgctttttatcttatttcatttatttatttattatttattaatttatttatttatttgagacggagtctcgctctttcgcccgggctggagtacagtggcgtgatctctgctcactgcaagctccgcctcccgggttcacgccattctcctgcctcagccttccaagtagctgggactacaggtgcctgccaccacgcccggctaattttttttttttgtatttttagtagagatggggtttcaccctgttagccaggagggtctcgatctcctgacctcatgatccgcccgcctcggcctcccaaattgctgggattataggcgtgagccactgagcccggccgagttaatttatttgttttaattattttgttttttttgagacagagtctcactctgtcactcaggctggagtgcactggcgctatctcggctcactgcaagctccgcctcctgggttcacgtcattctcctgcctcagcctcccacgtagctgggactacaggtgcccgccaccacgcccggctaagggttttttttttttgtatttttagtagagatggggtttcaccctgttagccaggagggtctcgatctcctgacctcgtgatctgcccgcctcggcctcccaaagtgctgggattacaggcgtgaaccaccccgcccggccctcaattgtttttttgaggcagggtttgactttgtcacccaggctggggtgcacgatctcagctcactgcagccttgacttccccagttcaagtaatcctcttgcctcatccccccaagcagctgggactataggcccatgccaccatgcccagctaatttttgtattttttgtagagatagggttttgccatgttgcccaggctggtcttgaacccctgagctcgagcaatccacccacctcagcctcccaaagtataaggattacaggcgtgagccaccatgaccggccaattttatttttttaatacaaaaattggctgggcatggtggcacatgcccgtagtcccaactatgtaggggcggggtgctgaggtggaaggagcacttgaaccttggaggtcgaggttgcagtgagctgtgatggcgctactgcactccagcctgagcgatagaccgagaccctgttctccccccaccaaaaataaaataaaaataaataaataaactattttatttattaatttatgtatgtatgtatttatttatttaagacagagtctcgctctgtggcctaggctggagtgcagtgaggcgatcttggctcactgcaacctctgcctcccgggttcaagcaattctcctgcctcatcctcccgagtagtgggattacaggtgtgcaccaccatgcctggctacgttttgtagttttagtagagctggggttttgctaagttggtcaggctggtcttgaactcctgacctcaggtgatccacgcacctcggcctcccgtagtgctgggattacaggtgtgagccaccgcacctgtccagtttacacttgtatctaatcactgtcctttgctttattttctttttcctcatggtatatttgaaacattttgaaccattttttaaaaattgttattgagtaaacatagaaattgaaccatcttaagactgactttctaaatggggttagaatgggaattggatctatgaggaatgctaatcagtaaatgccattagttactgatgactcaatttttttttaaattttttttttgagacagagttttgctcgtcttacgcaggatggagtgcagcagcggtgcaatcttggctcactgcaacctcggcctccctggttcaagtgattctctggcctcagcctcccaagtagccgggattacaggcatgcaccggctaattttgtatttttagtagagacgaggttttatcacgttggccaggctggtctcgaactcctgacctcaggtaatctgcccgcctcggcctcccaaagtgctgggattacaggcgtgagccaccgcacccggcctactcagtattttttatactgtgcttagacttaccctcggtactatgtttgctttgcgttcttagaagatagtcctatttatttaatgttcacgttggaatgtgctttttcttttcaacagacacaacaagaggaggaaatttctcgttgatccccgttgccacccacagacaatagctgttgtccagactcgagccaagtaattaatttgattcgtgttttaaactcagtataatgtcatgttcatctctgctgtttctttctctttctcacttccaaactgattggaggtgaatctgaaacagggttttttgctgtttaaattggggttgctgagttttgccttacctctcactttcttctgggcatctctctggtaagtaaactgtgtcagaattgagttgggaaatacacaattgccattgctttatagtaagttgtgttttgttttcttcttcttcttttttttttttttttttgagacggagtctcgctctgtcgtccaggctggagtgcagttgagggaacctaggctcactgcaagctccgcctcccaagttcacgccattgtcttgcctcagcctcccgagttgctgggactacaggtgcccgccaccacgcctggctaattttttttctatttttagtagagacggagtttcaccgtgttagccaggatggtcttgatctcctgacctcgtgacccgcccacctccgcctcccaaagtcctgggattacaggcttgagccactgcgcccggcccgttttgttttctttttgtagaaagaataaaaatattgttttgatcaggttttggaacgtttgaaaaacagagaaaaatgggactcacatacaactgttaagattttgtgtgtattccttgcaaacgtagtttacagagggtgtgcagagtccctaggtgagatgctatgtagtttaaagtgtagtacttttctttcgtgctgtaatcaggtaaaacaatcctcgcaacaaccactattggtagatatttgctttccctttgtaaaagttgagcattcttccccctacccataccaccatcccttcagagggggggtttctgacatataattggcattattagttcaggaatctaaggaagttcttcctccttgtcttacttatggttttccattcacttaagagtgatgccagtgaaagaggtgatggctctgttgttaacaaatattggctcattagccctaggaagcaatgctcttgggcctctctgaggagtagattgtgacaggaaagggcaaaggggagtcagaggatagaagagaggaacagaagcagagctgttggatgcgcttgagttgctgtgatgtagttaccactgaagtgcctgtgggacgggatgtgggcaggggtgggaggccactgtgggagggcacagaaaatgaatgctgtcttactggaaaagaaacgttaattaattttcccttataaaccgaaagcacgattgttctttgttgtctgtctttccagatatactggagtcctcactgagctgaagttaccctgtgaaatggacttcagtggaaaagatgtcagtggagtgttgttccagtacccagacacggaggggaaggtggaagactttacggaactcgtggagagagctcatcagagtggggtaggtatacctttcttgtggggggtccgtggaggcgtatcccaacttgtatctgtctacctatctctctctctgtcttttcatgtgccttaatttctttaccattatcacatggaatggtaaaactctccttcctgactccttgctgctacttttttctgttcccggattcctggcacatggtgggcactcagtatgtatttactgaatgaatgaatgagcaatggagttcacaggatgtgaacacactctgcccgtcttcctgtagttaagataatttcctactctcccactactctcagggaaaggtagcaaccttgttccttttctctcacttcctttctagagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaaggtaaaggggctcatgtttctctacttttattgtgattatgatttccctgatttcttctgatcacaaatgttgatttctatctgaattcaactgggccatgttgagtcagttaaggaaatgtacaacatagattcagaagaacaattctgtttgggatatgagctagtacttctcaaatactataaatttgtaaatttttgaaaaattttgtgtataatttacaatgtatcgaagtcatgtaacgcatttgcttagattgatggacgccttgaaagactaaatattttaggcatgttttgtgtctcgacagttttcgttctcaaaagcattatgccacgtggctctgtaaagacaaatgcactgagactgcaaagtacacactgagtttgctccgcgttccttcctagaggcttccgccacgtggccatttgagtaatttccaaatttccaaatgtactttcctgactgcttctcattggtgaaacttctcagattaaaaacgtagatgttcagaagtagtctttgttccttaaaaaaaaaagaaaagaaaagaaaaaaagggctgggtgcggtggctcacacctgtaatcccagcattctgggaggccgagtcaggcagatcacaaggtcaggagtcccagacgagcctggccaatatggtgaaaccctgtctttactaaaaatacaaaaattaggtgggcgtggtggtgggcgcctgtagtcccagctacttgggaggcagaggcaggagaatcacttgaaccacggaggtggaggttgcagtgagccgagatcgcgctgcctcactccagtttgggtgcagagcgagactccatctcaaaaaaaaaaaagaaaaaaaaggaaaaaaaaggagcgggggacctagatgcattccaggattattactggggaaatttagaaaaaaaaattatgtttttgacctttgataaaagctggactttaacataagtgagtaagctgaattagtcaatgatgtgatgataatgtgaagtgtgtttttttaaaattttatttatttatttatttatttattttgagaccaagtctcactccatcacccaggctggagtgcagtggtgtaaacgtggccactgtgtccaactaattttttaaattttttgtaaaaacagggtttcaccatattgctcaggctggtcttagggctcaagtgatctgcccaccccagcctcccaaaatgctcggattaccaggtgtaagccaccatgcctggcctctgtatactttaaatcatcttattaacacctaatgttatgcaatggttgttacactgtattgtttttaaaaatttgtgtgatttgtttttttttttttattttttgagacggagtctctctctgtcacccaggctggagtgcagtggtacgatcttggctcactgcaacctctgcctcccaggttcaagtgattcttgagcctcagcctcccaagtaactgagattacaggtgcctgtcaccatgtctggctaatttttgtatttttagtagagatggggtttcaccatgttggccaggctggtctcaaactctggacctcaggtgatccgcccaccttggccccccaaagtgctgggattatagacatgagccaccatgcgcggctcataaaatttgtgtgatttttaattgttgtattattttttatttttttgaatgttttcagtccgtgattggtggaatctgtggtgtagaatccacagagagccaagtcttttcaattttgtcgtatatttccacttttcctgtgtctcctaagaagttcagagtgaaacttaatcctcccagtcaccattattgtatttgtctgggaaattcctgcaaaattttctttcaaaattcctagacttattgtatatatcttggtgtctcagagtacagtctaaaaatcagtaatcctgctgggcacagtggctcatgcctgtaatcccagcactttgggaggccaaggcaggcggatcacctgaggccaggagttcaagaccagcctggccaacatggtgaaaccccatctctactaaaaatacaaaaattagctgggcgtggtgtcaggaggctgatgcagtagaatcgtttgaaaccagaaggcagaggttgcagtgagccgagatcacgccattgcactccagcctgggcgaaagagcgaaactccgtctcaaaaaaaaaaaaaaaaatcagtaatcatgtttagatgaggaacgtttagaaattgtttctttataaatttgcacccaagtgcatttgctgaattcacttcaagctgggaaggaaagaagtaattctatttatagcatctcccagtgctgtgattatctgtgctaactggatgccttattcttggtgtagagatgccactgggaaagaagtgtatcgtcttgctcttcaaaccagggagcaacacattcggagagacaaggctaccagcaacatctgtacagctcaggtaaatcacacgtctgacctgactactgaatgccttacgatacacagaaatgagctactcattcattcattcatttgttcatttattcaccacctcctgagcagtgagcacaccagaaatggcaagatcttattggtgtagaaggctcattgtcttatgagaaccaaaatacagtattggctgggtacggtggctcatgcctgtaatcccagcaccttgtgaggccaaggcaggcagattgctggagcccaggagttggaaacctgcctgggcgacatggcgaaacaccatctctatgaaaaataaaataaaataaattagccgtcagtggtggtatgctcctgtagtcccaggtgctagggaggctcaggtgggaggatcaccagaatctgggaggttgaggctgcagtgagccatgattatgccactgcactccagcctgagtgacagagggagactctgtccccaactcctgcccccacaaaaaaagttaaagaaaaagacactgtgttttactggtgttctttatatgtacaccatttgcctatgctttctcttcaccatacatgttttaatactaaaaaaaataaaaagcattatttgtttcattttacccataatcacatcttcagatcctgaacaggcaaagcgtaagaaaggacaaaaaaggccagtcttcacttttatatacagacttaaaatatatgtaaatagaaagatggatatcagggtctctagtattcttggcgttgggccaggtttgttatgggtggcagttgagacaccctctcttaggactgagaaggagcctctccaggaatgggttgaggaaggcaaagcaagggcatttgtgatgactgtgcttgaggggatggtggtagtcatgaggcactcttactgggagattatgactggcattcttttttttgttttttcgagacagagttttactctgtcgcccaggctggagtgcagtggcgcaatctcagctcactgcaacctctgctgcccggtttcaagcaattctcctgcctcagcctcctgagtaactgggattacaggcgcctgccacagcgccaggctagtttttgcatttttagtagagacggggtttcaccatcttggccaggttggtcttgaactcctgacctcatgatccacccacctcggcctcccaaagtgttgggattacaagcatgagccactgcacctggccatgtctggcattctttaaaaggatgggataaaacaggaagagcttcctgggttctgaccagggttctgggttctgctccttgaagttgctccagggcttaggtcgaagtgtttgtgaaacccagccaaaccctaggatcagttggaggcccactcctgagcacaggatccattctaagtgcatctctttttttttttcttcttctttttttttcttctttgagatagagtcctgttcctgcgtcacccaggttggaatggggtggcgcaatcttggctcactgcaacctctgcctcctgggttcaagtgattcttgtgcctcagcctcctaaagagctggaattacaggccaccacacccagataatttttgtatttttagtagaggcaggtttcatcatgttggccaggctggtctcaaacgcctgacctcaagtgatggtcctgcctgggcctcccaaaattttgggattgtaggtgtgagccatggcacctggcttctttttttttttttttcttgagacagattcttgctctgttgtccattctggagtgcagtggcatggccatagctcactgcagcctcaaccttcaacctccagggctcaaattattctccggtctcagcctcctaagtagctgggactatgggtacattccaccacgcccagctaattttcaaaaaaatgttttgtagaggcgaggtctcactttgttgctcaggttggtctcaaattcctgagctcaagtgatcctatcttggcctcccatagtgataggattataggcatgagccaccgtgcctggccactgtaattgcatctcttccatgaagtgtcagagagagatgtcacaggtgcttcaatgggaggtagagtgctctttcgtctcagggctttggcgtctagaaccacctctgaaaagcttctccaggaaggcagtgggcaataagatcttcttatagttggttctgcagccacgggtctttggagccatttcctcagttggtccttttgtattatgttttgcctcaggaaggtgccacctcttttcaaatatgagctcttccagtatgataggaaggaaaggtggttggcacaggcttttcctctgttgaacagcaagctgatctttatttatttatttgtttttttggttgttttttctttttttgagatggagttttgctcttgctgcccaggctagagtgcaatggcgcaatctcagctcactgcaaccgccgcctcctgggttgaagcaattctcccacctcagcctcctgagtaactgggattacaggtatgtgccaccatgcctggctaattttgtatttttagtggagacggggtttctccatgttggtcaggctggtcttgaactcctgacctcaggtgatctgcccccccgcccccctgacctcccaaagtgctgggattacaggcatgagccaccatccccagcctagaggcactttcaatgaaacaccattaacaatctttcnnnnnnnnnnnnnnnnnnnntatgataggaaggaaaggtggttggcacaggcttttcctctgttgaacagcaagctgatctttatttatttatttgtttttttggttgtttttttttttttttgagatggagtcttgctctgtcacccaggctggcgtgcagcggcccaatctcagctcactgcaacctctgccttccagtttccagcgattctcttgcctcagcctcctgagtagctgggattacaggcgcctgccaccatgcccaactaatttttctatttttagtagagacagggtttcaccatgttggtcaggctggtctcgaactcctgatctcatgatctgcccacctcggcctcccaaagtgctgggattacaggcataagccgccatgcctggccacatggtgatctttatatggtggcctcactttctgtagcttaccctccatttgttgaattctctgcttacgttttccctttcggtgcagctgactgctcctgtcttgctgtttctcctcaggttcctccaggtttccgtctgatcataagtccatttagggcctcagttttctgcctctaggttcattttccaggtgaatttgggctgtctgcagtgaaccagttatgttcctgtttctttcttttttttttttttgagacggagtctttctcttgttgcccaggctggagtgcaatggcgtgatgtcggctcactgcaacctccgtcttccgggttcaagcgatactcctgcctcagcctcctgagtagctgggattacaggcacccacgaccatgcctggctaatattttttgtatttttagtagagatggggtttcaccatgctggccaggctggtctcgaactcctgacctcaggtgatccgcccgccttggcctcccaaagtgctgggattacaggcatgagccattgtgcccggccttatgttcctgttgcttaatttcttccagttcatgtatagctgataatttattatttaacttgggttgaaaggtctgtatcttttccagcaattgttaaaatgtttgccctggagatggccatactccagcttgtctgattttcatcctcttattctgatgatcttctaactcttcactgtctatttcactgcatatgtgccttttcatagttgattgcatacaagaattactcataactccagtttcactctttgtgagcatgcaagtctccctgttttgttaggagatgactggtgtcttttgagttgttccttttgtgctgtaggtctttgacccccgccttctgttgtagcagctgttccacattcttctcactcttgctcttctctcttgtcactggggtgggtgggggagtccactcttagtttcgcatcgtggatggggcatgactcttttttaatctctgaaagtgtgttaatgattcttttttaaataaatttttctatagggagtctctctgagcctattctggctcagcaggccccattctaaaacaaaactgaaaaaacagggtgcggtggctcacacctgtaatctcaacactttaggaggccaaggcaggaggattacttgagttcagcagtttaaatccatcccaggcaacatagtgagactcctgtctatataaaaaaagtacaaaaattagccaggtgttgtggtacacaccagtatcccagctactcagtagactgaggtggtaggagtgcttgagctggggaggtccaggctgcagtgagctgcaatcacaccactgcactccaacctgggtgacagaatcagaccccacctctacaaaacaaaaaggaaaagaaacaattttttctataaatttgtggcattactacagatgtctgaattttcattatgttctgttctttatattctcttatttctttttttttggagacgagtctcgctccatcgcccaggctggagtgcagtagcgccatctcgctcactgaagctctgcctcccgggttcacgccattctcctgcctcagcctcctgtgtagctgggactacaggtgtctgctaccatgcctggctaatttattgtatttttagtagatacagggtttcaccatgttagccaggatggtctcgatctcctgacctcatgatccacctgcctcagcctcccaaagtgctgggattacaggcgttagccaccatgcccggccatatattctcttatttcttagcttctaccacaatgagcagctctttcattggcttttcttatttttaatataaaaatctttttaaaatagagatgggagtcttactttgttgcccaggctagtattgatctccaggcctcaagcgatcctcctgcctcagcctcccaaagtgttgggatcactggtgtgagccactgcatccagccttgttggcttttctaaagtcaggtgtagtaaagaataatttacactttattagctttttttattgagatgtaactcaccgtaagtttcaccaattgcaagtatacagctcaatggtttttactctatttacaaggttgtgcaactatcaccagtatttaatttcagaatatttttattaccccaaaaagaaattctattcctatgaagtagtcactcctcatccctctccccttcctatagcccctggcaactactattctactttctgtctccctggatttgcctgttctgaatatttcatataaatgggatcatacaatgtgtggccttttgtacctggcttctttgcataaggttttcaaggttcatccatattgtagcatgaatgtgtacttaattcttttctatggctgggtaatatcccattgtttggacatgctacattttgtttatccattcatcaattggtaaacatttggggtgtttcaaataagcctgctgtgaacacttctgtgtaaatttttgtatggatgtaatgttttcagttcttttggttatattcctagcagtgaaattgctgggtcatataactctacatttaacattttgaggaacttccagacatttttcaaagtggctgcattattttactttcctaccagcagcatatgaatattctaatttctccgtattttcaccaatgcttgttacttcctatcctttggttatagccatcctattggatgtcaagtgataatctcactgtggttttgttttgtatttccctaataactaatgattttgagcattcattagcttttgaggcttttaagtaccttaattgtattattgttattttatttatttattttagagatggggtcttgttatgttcttcttgctggtctttaactcctgggctaaagcaatcctcccaccttagcctcccaaagtcttgggattacaggcgtgagccactgattcaagccctttgtatttttaagtttgttcaatttgtgaaagaaattgtcattttcttggtctctattttaatttttttggttcttcttttgatattctagtgccctttgaagtttttaaaaagtggttttatacttctcatcaatttgttgttcagccgtgtgatatagcctcctgattatggaaggaatcatctgtagattaaaaagggacatgaaccaacctctacaatattgtggtggaggctgccagggcattctgtgaatgtcaggcctgggtttctgtttccagcaacacagccatgagcatttgggcacagtgtgtcacagattctttacctcagcctcgccttttccacagctgtaaagtgctgtggagtttctgtgtttatttctgattgttgtaaggagtccataagagtgtttacactttgtctaggacttttagtacaagaatgcctacttccatgttttctgatgtctctttctcctcatttacttccttgtttgctgacttcacctttggaaactgtttcttattttgcattggctccatagagacttcctctagtagtctagcagaaaaaaagatgtacctaacaaaatggacccagtattgaacatcaactgtattttgcagagacagggttttgtattgtcaaccgggctggagtccagtggcgcaatcataggtcactgtaacctcgaaatcctgggttcaagtgatccatctcggcttctggagtcactgggactacagttgcacaccaccccgctcccagctgaagtgcgcattgccgtttttgccagtcctttgccacagattctccattcaactcttggttggcagaagttcagcctctagtgttttatttaagttcttaggagaattttattcctgaagttcttgaatgtttgaaaattgcttgtttctttttattcttgaagaattgcctggttgagtgtaaaattctcagatctcactttttctccctgaggtctttattgcttcactgtcttccaacattaaacattgcttctcaatgtctgatggtagtgtgatctttgcccttaagggtgacatgattttgttgcatggaagaagcccttcgtaatggtcaaatgtgaaggtttagtatagtaacaactccagggtgtcttggatgatggttcctttcaggtagtcaggcaggttatatattaattgtccccaactatcaaagaatgtaggaaatctgatcattttgttttgtcgctgtcttcagttttgacatcccaagtcaagtaattacaccctcccactaattgtcctccatcacgtgattctttaaatgttcttatcttttaggccctcttggcgaatatggctgccatgtttgcaatctaccatggttcccatgggctggagcatattgctaggagggtacataatgccactttgattttgtcagaaggtgagttggtaatctgtctaaaacatttgggcataataaaattgataaatttgagtaaaattgaaaatattgcatgtccaatactatatgcaaaattaaaagtcaagtgagaaacgaggaaaaatactttcaacatccatgattattttgttgttttgctttctttctttctctttctttttctttctttctttctttctttctttcttttatttcctttttcttgctttctttctttttttcttgcttgcttgctttcttgcttgcttgctttcttgctttcttgtttgcttgcttgcttgcttgcttgcttccttgcttaatggagtcttgctctgtctcccaggctggagtgcagtggcacgatctcagctcactgtaacctccacttcccggattcatgtgattgtcctgcctcagcctctcaggtaactgggattaaggtacacgccaccatgtctggctaatttttgtatttttggtagagacagggctttgccatgttttccaggctggtctcgaattcctgacctcaagaaatccgtccactttggcctctcaaagtgctgggattacaggcgtgagccaccatgcctggcttagactgagtgttaatatttttttctcttttactcctggcaagctgtgatatttttaatatgtagaactcttactttcctaccggccccaaacataagaaggatgaacaccctaatagaaaaataggcaaaagacattaaatgtaattttaaaagaaataagtatacaaataaatggccagtagacatagaattttagcctcattattaatgaaagagatacaaaataaagcaataaactagtatttatcccattacattggcaatcagaagaatgctgctatgtagtgagctagacatggttactcgtgtatgtaatgtcagctactctggaggctgagccaggaggattgcttgaggccaggagttcaagaccagcgtgggcaagagcgagaccacatctctataaaaaaatagaaataggccaggcacagtggctcatgcctgtaatcctagcactttgggaggctgaggcgggtggatcacttgaggtcaggagttcaagaccagcctggccaacatggtgaaaccctgtctctactaaaaatacaaaaatcagctgggagtggtggcatactcctgtagtcccagctactcgggaggctgaggcaggagaattgcttgaatttaggaggcggaggttgcagtgtgccaagattgctccactgtactccatcctgggcaacagagtgagactccatctctcaaaaaaaaaaaaaaaaagtgattaaatcatggttcatccatatgtttgactattgtacagccattaaatatggtttaaaatagtgatctataggaaagcatagatgagaccaggtgtggtggttcacacctataatcccatcgttttgggaggctgaggtgggagaattgcttgagtcccagagttcaaggccagcctgggcaacatggcaagatcactgtcttcaaaaaatttaaaaaattattagccaggtgtgatggcatgagtccttgatcccagttacttgggaggctgaggcaaggggattgcatgagcttgagcccaggagtttgaggatgcaatcagctatgatcatgccactgcattccagcctggacaacagagtgagactgtatctctcaaaaaaaaaaaggtataattttatatatatatatatatatctgatactacctgctcccccatttcttgagaaataatacaccaaaatacacgcagtaatgcaattgtatgttgattttccttactcttttatatgtatttcataattttctacagcatgataataaacatgtttagttttttaaaaagcaatcaccaaagcactccccaggaccaacaagagtctagtagaatttatctctttattattctgtgacatgtcaatggctgaggagcaggtttctatatgagagtttgggggatctcctatcttgtgtaggtctcaagcgagcagggcatcaactccagcatgacctgttctttgataccttgaagattcagtgtggctgctcagtgaaggaggtcttgggcagggccgctcagcggcagatcaattttcggctttttgaggatggcacagtaagtcaaattttcagtatttttaccagtttttcaaattttcacattgtttctcattaaaaggttttctctttgtttttaaaaaataaaaaggaaaactttaggcacagtcctattttttcataaacaagtgttatttacattatgcaacactgtggtcttttcagtaaaggatcattcaccctttgctttcttttagacttagtgttttcatatgtgggactgaaatgcacatattttgttcataatactcctctcttcacagtatgactgactttaagataaaggctctgataactgatatacaggttaagggaagaaaatctcctcaatatctgataagtgggttaagggaagaaaaagataagcatgtctagcttcaaaaggagtgtcctgcagccatggaatgttagagttcagaggtggctggcaaaactcgaagccttgtgaaacctgggactggtctagccaccttcctctaagccttagcgtggagataattgtaccctgatattttggaatgatgggattttgtttagcactgtctcccctttgacctctcttgggattcctccagtgatgtggagtttagagttgatgttttccattttgtttgtgtttctgtagcttggtatttctcttgatgaaacagtcaatgaaaaagatctggacgatttgttgtggatctttggttgtgagtcatctgcagtaagtaaaataaaaacatgcgttcctcatcataactattggaggtggtagcaaaagtagcttatcccctgagtgtgagggagaaggggcccaagtgtgacactggtagcttgttgttaaaattattccactgactatcccttgctagtcactgctgacagctggaggtcactgctgtagggctccagccagtattatgcacccaggctagttggaaagattgttaatggtgtttcattgaaagtgcctctaggctggggatggtggctcatgcctgtaatcccagcactttgggaggtcaggggggcgggggggcagatcacctgaggtcaggagttcaagaccagcctgaccaacatggagaaaccccgtctccactaaaaatacaaaattagccaggcatggtggcacatacctgtaatcccagttactcaggaggctgaggtgggagaattgcttcaacccaggaggcggcggttgcagtgagctgagattgcgccattgcactctagcctgggcagcaagagcaaaactccatctcaaaaaaagaaaaaagaaagaaactgcctctactacaaagatgcaagacatttgtatcttggttatgtcattcattggaaaattatgatattcatttaatacatatttattgaggacccaatatgtgtcaggtgctatgctaggccctgaagacacagtggtgaattagacatgcttcttgtcctcctggtgcttacagtttattagggattcagataaacaagcttaagattagaatccaggtgactgatgtgtgaagatgttctgggagctcacaggatgagctccttaccaagaagataagcaggagttatctagaccaagatggcacaagagggaaaggaagatgggtccgagtgttctagacactggagaaagcagtcacaaaggctgggagagggagtacatgaaagctataagcagttcagtgtaatgagttgctttctaaaataatgaagtagtgggggaaagcaagagaaaagttaccattccatgggatgagagtgaaagagagccgacagtagctacctagacctgtggcaaggtgttaatcacaacagcctacactgcctggtgtgtattaatcactaagtaaatatttgttaaatggatagatgaaaggaagtagaaataccttccagagtgctgagtggtgctgtcttgcttatctgtgccctctttgagagaggacttcaaagggttataccagataacattcataaatgatcaaagaagcatcacagtgttctcttttaaacctcaattaaacaggactgagttagctccttctctgtagaactctgcactaaatttaatcacagatatttggttcatgcatttgagaaatgtttctggagcatcactaaggggtcaagagggccattattttagttcatttgcattggagtacctgaggctaaataatttataaataaaatagctttatttggctcatgtttctgcaggctgtgctgtgcaagaagcgtttgcttctggtgagggtttcaggaaacttcctctcatgaaggaaggggaagaggagcaggcatcacatggcaaaagaaaaaggaagagagagagaggagggaggtgccaggctctttttaacaatcacttctcatcagttctcatgggaactagtagagtgagaactcactcattactgtgaagacagcgccaagcccatcttcaacactggggatcacatttcaccctgagatctggaggggacaagtattaaatctgtattagtcatattattagcctggcaaggaatgaggatcaagccatgtattgattatatattctggatattaaatccttatcagatatatgacttacatatattttcttccattctgtgggtagtcagtctcttaactttcttgataatgttctttgatgcacacacatttcaaattttatagaaatttaatttatctaatttttatatatgtttattgtttattcctttggtgtcacatttaagaaaccattgccagatccaaggttatgcagattagcccctatattttcttttttttttttaagatggagtcttgctctgtcgcccagggtggcctgcagtggcatgatctcagctcactgcaaactccacctcccaggttcacgccattctcctgcctcagcctcctgagtagctgcgactacaggcacccgccaacacgaccggctaaattttgtatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcagattgcttgagcccaggagtttgtgaccagcctgggcggcatggtgaaacatcgtctctagaaaaatacaaaaatcagccaggtgtggtggcatgcacctgtagccccagctactcaggagactgaggtaggaggattgagcccagtagggccaaggctacagtgagttgagatcgtgccactgcactctagcctgggtgctagagaaagaccctgcctccaaaaatattaaataaataaataaataaataaataagtaaaattatatatttgatccattttgagtgctttgtggcccagccacccagaagcctggatgtccacatgtggctccaggcacagttctggccctatcatctctgtgtttctccttcaggaactggttgctgaaagcatgggagaggagtgcagaggtattccagggtctgtgttcaagaggaccagcccgttcctcacccatcaagtgttcaacaggtttgtgtgtcttgtgtgacttctgcgttttgtgctttggtaatcagctagggagttaggcagagtgctgctgctgatttcgcctgctgtggcctggttattctggctcagccgtggctcccaagtatttcatcctcataacgatcccgttcctgacttgggaaaagcacactttgtttcctggtggctctgctcccttggcagtcaggaagcagggatgaataattgccaggctgaagttcactcccaagagccctatatcctcttcttcccaaccttcaactcatacccacagtcagcttcttgtccaagacatcctctgaggtttgtgggggtctgtgcccttctctctgagtgtagttgacatattgtccgtggccaaaattgatctgcattttgaaagtagatttcggtgtgtcttatatgtcaggaggatgtgcatggactcatatctacttttggggcccctaattctgtgttttgtgttcacagctaccactctgaaacaaacattgtccggtacatgaagaaactggaaaataaagacatttcccttgttcacagcatgattccactggtagttatttgtggccttttttctcatttccaagctaccccaatcccacgtctcttggtcctacctaatatgctccaagagcaacaaaggggtggccatgctgggagaatggagggttgattgatggactatagaaaatcactaatgtgatacattttggatgttcttcttaaagggatcctgcaccatgaaactgaacagttcgtctgaactcgcagtaagtagctcacttctgtaagtggatactcagcaaggggcagtgttctagcttccacctaagcccagaactagtgaaatctactgggactgtgattctgtgattgaagaactattttaataattctttaccttgctattcaccaatcttgggagtaaccctgtatttctcacgacttcatcatttaaatgtatgggtaaacttattattttttaataaaattaattaaatgtatatggtatttatgcctttctatcctatccctcccccacccccacccccttttaaacctgtcatattaaaagcttttttaaaaaaaattgtttatagttctaaatctcaggtagaattacgaaccttaagccgtctttctagaaatcattcctgtatcagaaagatagggattcaagtcaacagaagatttgtgcaactcgctgttgtggttggcaagtatctctactaggccaggatccattttagcgaagctttttttttctttctttcatttcttacgtttattctgaagtgacatatcatatcagacgaaagaaatcattttatatcatgataagaatatttccctctctatttttttaaaaaatagagtcaaggtcttgctgtgtttgccagtctgatctcagactcctggcctcaagcagtcctcccacctcagcctcccagagttctggaattataggtgtgaaccactgtacctggccttcccatttacttttgtgtttgtttcttgttccacttagtgaagaaagagaacaatctattgctatataagagtttatgccaaccatacctgaagcaactcattgtgtttcatggaaagaaatctgttttgggggcttttcttccctgaaaagttagcaaaacattgtatttttgtgtaagttccctttttggacaactatgtcccacttttaaatgaagacagtaatggtacttaccttataaggttgtggtggaacttaaataaattaacatatgtatagcgcttagaacagtgcctggcacatagcttttctcatcatcgtcattattattaaagttattattgctattgctattataatatgtatatatgcatttttgttttctttcttttcagcctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacaggtaagggcatttcttttcttattgtttcagcaatctattcttgtatagcatacaccacaaaacttaaaggcttagaacaacaacttatttgtgttattctgtgacttgctagacagttccactccactggggagagcatggctagaaggtgcatcgtgttctccctcacatagctggtgaggagctgtgggctgggagtgcatttgaggatgttcactagggccatagtttttctccatatggggctttccttgtagttccttgagcttccttgttccttacagcacaatgtcggggttcagaatgcgtgttcccagatgaagcatggagaagctgcaaatctctaatggccgaacctcctaagttacactgcatcccttccagattagtctatctattaaagcaagtcacgaggcgagcccagattgaatcggggaggggacaacacctgggtgtgaattttggtagatgtcgttcattgcggactgtctttggaagctagcttactacacctgtcagtgacacagcataagaagaaggatcaagcacacatgctgaattccaacaagtgtctcagtttagcagggccaggagaacctggatcctgctttggtaatgtcactaactttgaaaggtcccttctcctcttccagcctcaatttctttgtaaaggaaagactttgaagaagaacagtgattttcaaaagcaacagcctccagcaaaatctcctgagcacttgttaaaaatacaaactccgggccccgctccagacgcactgatcataacctccagggggtgagactaagactctttatttttatttttatttatttatttgtttttttagatggagttttgctcttgttgcccaggctggagtgcaatggcgtgatctcggctcaccgcaacctctgcctcctgcattcaagagattctcctgcctcagcctcccgagtagctgggattacaggcatgtgctaccacacctggctaattttgtatttttagtagagatggggtttctccatgttggtcaggctggtctctaactcctgacctcaggtgatccgcctggctcggcctcccaaagtgttgggattacaggtgtgagccaccacgcctggcctagaatctttatttttaagacaagaccaagtgattctaatacacagtcaatttggaatcccctggatttgtggtctctctgccttcatgatgatagatgacagatggaccgatggacagatgatagatagatagatagatagatagatagatagatacatacatacatacatacatacatagatgaatgatagatgggcaggaatcatgttatcggtatgtgagtttacattttagaatatctttagaaaatgagttatggtatctgcccctaggttcttcacctcctgctgctcaaagtatagttctctaccagcagcctcagagttgacccctctgggagctggttagtaatgcaaaatttctgtttcaagatgccctaccttctgttttgtaacatagactacacagcaaagccatttactttgtaaaaacaatacaccctataaaatacaaaccctttgggaagagggtatgtggcaatgaaaggacacagtgctctcaattgcgtcttaaagtctcacttcataaataggtaggagctgatagcatgaaagtcaagctttagtataccttctttagaacttcattacttatttttgttttgttttaagagacaaacctcagtgaattctgaaccttgagtctatgatagttattaaatgttgaaaattaagaaatttcgccctctagtgacggaatataatcacattttcactgtcatattggagagtgatttttcaagactattttaattctggttattagctcttgcagtaaattgtgatcccagccaggatcccagaagactgacctaagaatcaggaaatttgtcttcttaaagcagtggtttacagccttggctaggaattagatcccatggtgactttataacatccctgatgcccacatcacaatcccagattgaatcataatctcaatggagaatgactggggtgagggaagggacccaggcgtgagtatttctttaaagttccctacatgattccaactgcagccaaggttgagaaccagtgtcttagacatttctccgctgtttttccctacatacctggtgttctttctttgtcctaatttttctcattcatatgatggacagtgagactccacaccctatcccaatcttgcagagggtaagagatcttcatcatgatgtcgttcctggcaatgatgtcttctccagttcctgagattcccagctataccatccatttccaagagctgatttgagcatggcaggggctttgcacaatgtttaggcttagataaaggaatgaaggatgtttctggtcatgagcagaagctgctgtgacagatgagaaaatgccttattctttgttgagaaagtacaagggccatgcttctggtgagtaaagcaatttgatgtcttaattcgcagaaaaaaggaagggatacaccacatattccatatataagtgatttttttaaccttgtttcaatcctattttggcttatttgtgctaatctctgcacaagtgggtgacacatttcttgtcttataattattctgtgtctacaacagggcttacatattggctaatttgtcatgatttactgctggctagagtccagtgaaatctaggggacctatatgcacgtcacattttttgtaagaagaaacacaggtttcttgacaactctgcacagagggagaatttcgaataccatgtcagccactgatgttatactcaaaatagcaggtgcagtcacaggtgtcatcaaggaaccatttcctggtaatttcatttatacctgactaattagagtcagtcaatgtgtctgtagagttctgtagtcacaaaaagttttgaatctgaatgtttcctttccctttcattattgtatgatatttcagatataaccatagcataatttttaggaagtagccttagtagtatttcacaactctaaagtattttttattgtggtaaaatatacataacacaaaatttactgctttacgtatttttaagtgtacagttcagaggcattaagtatattcacactgttgtacagccatcaccattatccgtctgagagctttttgattttctcaaattcaagctcaggacctgttaaacagtaactcttcggttcctctttccctttttccctggcccctggcggcctccattctactttctggctccatgaatttgactactttaggaacctcgtataagtggatcatacaatatttgtccttttgtgtctggcttatttcacttagcataatgtcttcaaggttcatcaatgttgtggcatgtgtcagaatttacttccttttttctttttttcagacagggtctcattcttttgctcaggctggagtgcagtagcaggatcttggctcactgcaaccttggcctcccaggctcaagtgatcttcctgcttcagcctcccgcttagctgggactactggcacgcatcactatgcctggcgatttttaaaagtttttgtagagacaggagtctcactacattgcccaggctggtctggaactcctgacctgaagtgatcctcctgccttggcctcccaaagtcctgggattacaagcatgatctcctgcgcctggcctacttccttttaaggtggaatatttcattgcatatatatagcacattttgtttatcccttcatcaattgagggacacttgagttgttccatcctttcggctatagtgaataatgccactttacattgatgtacaagtatctagttgagtccctgctttcagtttttattttggtatatattcagaagtggagtttttggatatagggtaattttatgtttaattttttgaggaatcgccgtactgtcttctgcaggggttgcaccatttaacattcccaccagcagtgcacaagggttctgatttctccacgtcccccaccaacatttgttattttctgtttcctcaagtaatagcaattctggtaggtgtgaagtggtatctcactgtggttttgatggacatttccccaatgattagcaatgttgagcatcttttcatatgcttaccatgcatttgtacatcttctttggagaaacgtgtattcaagtcctttgcccattttttaattgggtttcttgggagatttgttgttgagttatagcagttctttttttttttttttgagacgaggtctcgctctgtcgcccagactggagtgcagtggcgcgatatcggctcactgcaacgatcgcctcccgggttcacgccattctcctgcctcaccctcccgagtagctgggactacaggcgcatgccaccacacccggctaattttttgtatttttagtagagacagggtttcaccgtgttagccaggatggtctcgatctcctgacctcgtgatccacccgcctcggcctctcaaagtgctgggattacaggcgtgagccaccgcgcccggcccagcagttctttatatcttttttttttgagatggagccctgctctgttgtccagcctggagcgcagtggcgccatctcggctcactgcagcctccacctcccaggttcaagtaattctcatgcctcagcctcccgagtagctgggattacaggtgcctgcccccgtggccggcaaatttttttgtatttttagtagagacagggtttcgccgtgttggccaagctggtctcaaactcctgacctcaggtgatctgcccacctcggcctcccaaagtgctggggttacaggcgtgagacaccatgcccggctttttttttttttttttttttttgagacgaagtcttgctctgtcgcccaagttggagtgcagtggagcaatcttggctcactgcaacctccgcctctcaggttgaagcaattatcctgccttggcctcccaagtagctgggattacaggtgcccgctaccacatctgactagtttttgtatttttagtggagatcgggtttcactatgttggccaggctggtctcaaactcctgatctcaggtgatcctcctgcctcagcctcccaaggtgctggggttacaggcgggaacaccacgcccagcctatatgttctaattccttatcagatatatgatttgcaaacattacctatcattccatgaatttccttttcactgtttacagtgttttttgatgcacaaaggcaactctaaatatacaataaatataaaggatttgcaccttatctagcataatgtctgtggccttctctggtaaatattagcttttggtcaacctggatagtctaacctttatccactcttagtccatttttatttacattaactttttcattcctactattcatgatctaccatggtgcaatttagatttatattctgtattatctgccttgacctgacccatgagagcgacatagaccctgactggagaggaggcctttgcactggaaatgctatgttattgacccagataccagttggccctgaatgctggtaactgtctgtcagagacgccactatgcctctggtatgcttgtgtcttatttggggtttcccaaaatcagaccctgaaacaggaacttcagtacaagaagtttatgtggttgctgatcccggaaagcacagtggagaagtacagaggtgagacagggaagtgaggaaagctggaaaaggttgtattagtgaccaggttatcaccatcactgtatgggatcctagagatcagtcccattgggggcactgagggagactggatggaacatgcctccgatttgtcccagtgaagagctgaggaagccagagtatttaccaactgctccttcgttgcccgggaaggactgagaagctggagttagcaacacttgttcttcatttgttgaaggcttcaccccgggggccttaacccctcaatacttgaggcttgatagttatgggctgtctttcaaccaagaacgtgcctggcagagaacaccctcaggtggagaggcagagatgcttgagttcatatacggtcattttatgtcggagctgtccacagaagctggaagtaagcttcaggatgaaacaaagacctgtgagcagcacaatgatcctgtctgctacaggttgcctatagtaggcatggcctttggcaaatggataataagtattatataactagattaaggaagaagagatgccagtgcctttcaggggaagatggcagcctgagtgggtcctgaatggagaaggggactgataggcaggtaggatcaggaagtgttatggagcagatgggcttgctgcctgatgtgcacagaagccaataactatggcaccagcttttgagaaaagaagggctttatttattgcaaaaccagcccgcaaggagacaagagtcagctgaaatttctctcctctatttgggatctggggcaagttttaagggatcagaaggcaggggaagggatttgggaatgctggcttggcaaggtctaattagagggcttcagatttgacagcttacggtaaggtatgctgagccctacatcttccggatcagtagacccctcacttctgaagaagttctggcatgcagggtctggttctcttccagccttgttggttccgaggggcggaatccctggttctgggtgtcgttagaagtcaaagctttttctattgcacattcccagactacatgacttgcaactgtggactctgttataaggtaactcaacattttgttatcaacagaacaggcccagtgtgggctggtcctgcaattatagaagcagagagcctgcaagagtcaaggagccctagggtgagggtaagagttctttggggcctgaagagaacttggcttatggagatccacaaaccctgagacgaaaggcagttgtctgaaggaatgttcctgggtcgaaggtctctctggccttcagggtgcttcaggggaaatgaagagtggggccaggtcttccgtagttctgagactgtgtggattctagcctttgtagatgaggagattctcccagtgatgctcccactgcccccaacagaggactgacagcttgcagactggttctgctgctgaagatgttgcagcaacctgaactcagccctaagggtgaatggagccgtagccagcaaagggaaaattttagttgcacacttcactggacccagcaacagagaggaagcacagggagagtgctcagaacaggttgcccgggcagccagcgttataggcactggcgtgaggcaaagtcagctagttatagcaatacaacttcgatctcagagctggctgacattcagtattaagtaaaaaggacattctgcaactaaaaccatgagtttcaattttaaacaatcaggactgggcacggtggctcacagtcccagcacttagggaggctgagataggaggatcacgtaaggccaggagtttgagaacagcctgggtgacatagtaagaccccatctacaaaaaaaataataaaattatcaaataaataatcaggatgggatactcttgaaaacaaaattagtgacttggaaaggtacttggaggaaatattccaaaacaaaaacccaaaatatacagattaaggctgtgagggaaaagttaaggaactcagaagacagattcagaagattcagcatttggggatgagaacatggaagagttaattaatattcatctgaggaagtgaaaaaaaattgtataaccaaaatgatggtaaaaaatgaaatgattaaagataaaagctagaatgaatgacctagaagataaaatagtcacaaggattaataaatacaaaaactgattatttgaaagatccagtgaaatcagttaactcttttcttgcctaaggaaaaaatatatatatacaaataagaaatgagaaagaacatacccagatatagataagatccaaagaattataaaggaatagtatatgctaccctgtgtcaacaaatttaaaaacatagagaaataaatgatttcttaacaaacatttaggaacataagggcatgttgaaaacagattaacagaggctgatcacatggagtgaaactagaaataacagaaagatgagcaaaattcacaaatatgtggaaattaaataacacccttataaataaccagtggaacaaagaggaatcacaaggagaactggaaagtactttgaagccaggtgcagtagctcatgcttgtaattgcagtactttgggaggctgaggcaggaggatcacttgatcccaggagttcaagactagcctgggcaacatagcaagacctcatctctccaaaaaaattagcctagcatggtggcaagcacctgtggtcccagctactttgggggctgaggtgggaggatcacttgagtccaggaggttgaggctgcagtgagccatgatcacgccactgcactccagcctagacaacagagtgagactctgtttctaagagaagaaaaaaagagaggaagtactttccaactaattaaaatgaagataccgcatatcaaacatcacgggctgtagctaaaacagtgctaacaggaaagtttatagctgtaaataactacattaaaaaagaagaaagagctgggtgccatgattcatgcttgtaatcccaacactttgggagtctgaggtgggaggatcacttgagctcaggagttcaagaccagcctcggcaacatagtgggaccctctttgtacaaattaaaaaattagccaggtgtggtggcatgcatctgtggtcccagctgcttgggaggctgaagtgggaggatcacttacacccagaggtctaggctgcagtgagccatgttcacaccattgcaccccagcctgtgacagagcaagatcctgtctcgaaaaaaaaagaagcctggaccagatagtgagacttagtctctacaaaaaattaaaaaagtagctgggcacagtggcgtgtttctgtagtcccagctactcgagaggccgaggccagaggattgcttgagcccaggaggttgaggctgcagtgaactgtgatggtgccgctgcactccagcctggttgaccctgttttaaaaaagaaaaaagaagaaagatcttaaaccaacttaatcttccaccctaaaacaacagagaaagaagtacattaagctcaaagcaagcagaaggaaggaaagaatcaggattcgagcaaaaaaaaatcaataacgtagagatggggagcaggagaggaggggaattataagaaaataaaatatagtgaaataaaatttagaacaacagatgttagctgcgtaaaactgcgtgtgtgtgtgtgcacaggggcataggtggaaagatgtatgaaaggatgggactcaaacagttgtctctaggtggtagaatatcaggtgattttactttttgtccttatgtttttagattatttaaaatttttaaagccttgatcatatgttatttagtcaattcaaaaaagatatttttatggtggagaacatgcgtattgtgaaacaactaaatgcatagtaagttggttataggctcatttgcacctggttctcctgatctcagagggttcctccatcagctgatggatatgggataaggttggctttgaagcttgccctggggctggaggcaaaacataaccacctccatctgccctagcggcacctctatcctaataaatacagtgaggtagtctcccagggcacccagttcaaactctgcagaataggataatatttaacatcaagtggactcagaatacaactctctggttctcaaatgaccaagtagcagaatgaaatgtaactttcaggcctgcatctggatttctctgcgtgtggcgctgctggctctgcctcatccttgctgctgtgcctttccgcgctgtcttctcatccagggcatttctgtgttatgcgcacagaaggcttttgttctttctgcagtcattccctgcccacatatatgctgcagcagggacctttctctttggtgaattttctttctaagagagaattcatcagctcaagggaaaggttaggatctagaaaatgtgaggtttttaaggctctgttatgtggcttcctaccaagtcatgttgtaggtttctctagcaacagaaaagtgaatgagatttaattcaggaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagcctggccaacgtagtgaaactccatctctgctgcaaatacaaaaattagccaggtgtggtggcaggggcctgtaatcccagctactcgggaggctgaggcaggacaattgcttgaacctgggaggcagaggttgcagtgagccaagatcgcaccactgcaccccagcctgggcgacaagagtgaaaccccatctcaaaaaaaataagaagaagaaaaaaataaattataactccaaggtgacggcattaggaggtgggagctttggcaggtaattaggtcatgagggttgtacaatcctgaatgggattagtgccattattttaagaaagaccccagagagctctttaccccttccaccatgtgaggacacagcaagaccacagctatctatgaaccaggaagtgcgccctcactagacactaagtctgctggcttctaggatcttggacatctcagcctctagaacaatgggaaatagctttctgttgtttataagccacccagtttttggcattttgttatagcacctggatggattaagacaataaccataaattttgtcaagataactttgcttgatgtagccaagccttcactggtctgcctagttccttaggacattttgatcccaagggtgtttgaagggcctgaaagaaaaaatgtcaagaagcttatccctattttctcctatttatttgttcaacccataaaccccggggagggtttccagcttggtgtagaaaacagccaaataatatttaattaccttttcatttcccactgagcccagcggggcttgcttcagctttttctccataacactttgccactcttcaaatcattcagcagctcataagtacattctaggaattgctagtttagaattatgatgtgatgtttaaggcagacagaaagagtaattaacacctcccatggatatgtaaagtgaaagacaagttggaattattattagctcacttggcttaaaaaattgaggaagttgtttttgtccttaaaaactgcaaactgtgattgttaatgtagacggaggtggccattgcttttcccagaatctccttcatgggaagattcttaaattgtggtgtgaacagggctctcaatggctgtcagaattaattgtgcatgagaatcacctggagggcttgtgcaattactgagcctcaccctacagagtttctgattcagtaagtctggagtagggccccagaatttgcatttttaacaaatccccaggtgatgctgaggcagctcgtttggccaccagcctgtgaaaaccactaggtttaccagaggttcttggacctggctgcatgttagaattacctggggagacttttgaagaacacagatgccctacctactgcacaaaccagttacatcagaatcttcgctggggatggagcccatatgggagagttttggggtttgttttttttttttttgcttcttttgagatggagtctcactctgtcgcccaggctggagtgcagtggcatgatctcagctcactgcaatctctgactcccgaattcaagcgattttcctgcctcagcctcccaagtagttaaccgatgctacaggtgcccgccaccacacctggctaagaagtgggagagtttttaagcaaaaaactctctaattctaatgtgcatcactgggttggagagcaatttggcctggaggaacaccaaagagaaaggtttagcaagatggatgtggctatcatatgcatatcacaaataatttagtgcagggagggtcaaaagcccactatttgccgtctccctcccctcccttcctgagctcatggttgacatcactgatcatttctggtaagttttccaccgagcctagtgcagcttcagaaacagagtactctgggggccaaatatgagagacctgtaagccctctctgatttcccaaagaaacagtcagaatgccaggaaaaaagcagggtgagggatgaggagagccgtctttcgggaaatgtaaagcagtgagaaggaactcctctttcccaatttccttaactctcaagagtatattttgatttttgaagtttgttagactttagggcagtggttctaacattggactgcaccccagaatttctgattcagtattcgtggagtggagcctatgaatttgcatttcttttctttttttttcttttctttgtttttttttttgagacggagtcttgctgtgtcgcccaggctggagtgcagtggcataatctcagctcactgcaacctccacctcccaggttcaagccatccttctgtctcggcctcccaagtagctggaattacaggcacccgccaccacgcccagctaatttttgatttttagtagagatggggtttcactgtgttggccaggctggtcttgaactcctgacctcaggtgatctgcctcccgaagttctggcctgaatttgcatttctaacaagttcccaggtgatgttgatgctttctattgtctgggaactagactgagcgtgagaaccactgctctgaggcgctcttctgataccagctgatttatctacgttttttgactagatagcaaaggttaattatggaactaaacttatgtcaaattgatacagattggtaagaacattacagagtgttgtgttgaggggttttgattttaaatccatagagatagagacctggctaacgttagggtacttgagacatgcagtacatggagtttcactggttaaaatcataccgtttgcaaggtatttgtactgttaaattgttagtcacctgttttttccacctggtagataggaatctgcacccatttttcccttattttcttgagagtggtcctctgaaggtgccatgaactgaagtgggtcatttcgacagtggttgttaggatcactttactgccatcatttttaccgtatcggtttcttagctgatgtttcacttgcatcgtttttgtttctcaacgtaaaggagagtttggatgaggggagtctgacatcaaagatgtccaacaccaaacccttacgtatcacaagcaactgtgaagtatttccttctggggggtgacactgggtaggatggatgggggtcgcttttttcttcttcttttgctttataacccttctgcactgatgatggatttttttttaaaaaatcacataaatgtattcttttatttatttattttttaagatagagtcttgctctgttgcccaggctggagtacagtggcacgatctcagctcactgcaacgtctgcctgccgggctcaagcgattcttgtgtctcagcttcccaagtagctgggattacaggtgtgtgccaccacacctggctaatttttgtatttttattagagacagggtttctccatgttggccaggctgatcttgaactcctgacctcaggtgatccacctgcctccacctgcctcagcctcccaaagtgctgggattacagcgattcttgtgtctcagcctccctagtagctgggattacaggcgtgagccaccatgcctggcccacataaatgtattctatcataaaaattttaagttcacctgtgaaatagatagcattatgtccacgtgacagatgggatccagaggaataatttgcttggagccagacagctttgaaaagggcagcaaataaaaaacaactttgatattagaggtgagagaaactcccgggtggctgcaggaaatacctgtttgtgagatctgcctgggaatgagtgactttaacatgatcttgttgtaggaaacatttaacagtatgtgccacctaagggctcctgtttgcaaacaacagaaaatggcttgcattaacttcagcagaaaaataatttacagggaagttattgggcagttcacagagttgatggaaaagctggagaattagacttcagcagtgagtaagacccaagaaaggctggcagcagagaagaaaatggagtctcaccatgcgaagagtcaccatcttcactgtgggaaatatggaactgtcccattcctttggtctgtccatccagattcataatgtcctggctggagtattgcacaggatgtttcacacctccatgtcttattagtgtttagtgactgggaatgtctaatcctttttgctttcataggggagtgtaggaccgtgtctctcccatagactcacacaaaagagggaattcccccagataataaagccactgaaaggctctgcattcccacacacacctctaaactcagcaccaatgaaaacccagttgattttcaacatcctaatgtaaccctccttcgtacttttaagcacattgacagcatgtccacatgtcattttcccagcatcattttctgaattgcatttgtacttactgctcgttggctatggtagtttgcagatactttctcccgttctgtagcttgtccttgtaaccctaatgggagcaaaaagtttttaattatgatggagttcaatttatcaatttttttcttttatgaattgtgctttgggtttcaaatctaccctagatcccaacaatttttattctgttttttgtttttcccagaaatttcatagttttatgttttacatttaagtccatgatccatttacaggtgatttttatataagctgtgagacttagattgtgcctatggatgtctaagtgtttcagttccatttattgaaaaggcgatctttcctccattgaattacttttgcaactttgtcaaaaatagttgggtatatttgtttggatctatttctggattctatattctattccattgatctatgtgtgatctctgtgtacataggcttgattattgtagctatatatgatagtccccacttatttgcagtttcagttacccatggtcaactggctcaaaaatattaaatggaaaatttgagaaataagcaattcatcctaagttttaaattgtacaccattctgaatagtgtgatgaaaccctgcagcatcttgttccatcccacctgggatgtaaatcagccctttgtccagcatatccactgtgtatatgctacccacccatcagtcacttagtagctgccttggttatcagatcaactgctatgttatcacagcgctttcaaggaacagtgaaatcgtacagtggcacgatctcactgcaatgtctcattgcaaggaacccttattttatttagtagtgtacccaaagcacaagagtagtgatactggtatggtggtgtaattgttctatttattcttagttattgttgttaatctgtaactgtgcctaatttataagttagattttatcataggtatgtatgtataggaaaaatcgtagtacacctgggtttgggtgccatccatggtttcaggcacccactgggtgtcccggaagatatttcctgcagataagagggggctactgttaataagccttgccatcagatgaactgatttgtgccagtttctttcttttttttttaaaaaaagtagctattccagttactttgcctttacatatgcattttagaataatcttgcttgtgtctataagaaaatcattattttgggggaggatgatgtatattttagcttctaaatgttacattttgtacaaagggctgtatgctggatgctatagatattataggtagttgaagggaacaaattcacctcatatttaaacttataatttatcactcataaaataaatatttttcatgaaaaggtatcattttaaatgtaataaaatattttttttaaaaacataccccgagaaactttttttttttttttttttgagacagagttttgctcttgttgcgcaggctggagtgcagtggtgcgatctcagctcactggaacctccacctgctgggttcaagtgattctcttgtctcaccctcctgagtagctaggattacaggcacctgccacaacgcccagctaatttttgtatttttagtagagacgaagtttcgccatgttggccaggttggtctcgaactcctgacctcaggtgatctgcccgcctcagcctcccaaagtgctgggattacaggcatgagccaccatgcctggtcaagaaacttcttaagaagttcaaatataagaagtaaaataggtccactgcttataaataacttcaatgggaacttcactgaaatcacacactaaaggtggccatccgtgcacaaactatgatggtgtgttaaaaactataaaatgattttcagaatatttagggaaaattaaaacaaaaatagatatggtcaatctagatatttagtaattcaaaaatatataaatcttaatttcttggtactataatttttaaaactttagaatccacagcgtggtcttttcttatggcacatttttaacatcttttgacttgtataaaaatacaacattctatttgagaacacaaatactgttttctccatataattacaatgtgattcagtgggagttttggtgactgctggtgttcaccataaattattactttagtgcattctgcagtcttgcaaaatgggtttcatgttactttttgcatatataaaaagcatgcagctacagtgacccatgtccaaatattccaaagcagtcaccatctgagaaattgcttatggtgtctataaagttagccacgatgttttttaatccccccggccatgagactgagtctcactctgtggcccaggctggagtgcagtggcgcgatcttacatcactgcagcctccacctccttgctttaagcgattctcctgcctcagcctcccaagtagctgggattacagatgcacaccaccacacctggctaatttttgtatttttagtagagacagggttttgccatgttcgccaggctggtctcgatcttctaactgcaggtaatccgctcgcctcggcctcccaacgtgctgtgattacaggcatgcaggcatgaggcactgtgcctggtctgcaacatccatttctttttgtttgtttgtttttgtgatggagtctcactctgttgcccaggctagagtgcagtggtgcgatctcagctcgctgcaacctccgcctcccgggttcaagcaattctcccgcctcagctccctgagtacctgggactaaaggtgcccaccaccacacccagctaatttttgtacttttagtagagatggggtttcaccatattatccaggctggtctcgaactcctgaccttgtgatccacccacctcggcctcccaaagtgctgggattacaggagtgagccaccacgcccggcacaacatccatttctaattctcagtatgtttggctagggttcttagtaaagggaaagataaattaatttttaaaatctttaaaatttgttttttctttgaactcccgttccaaccttggcaaaggaacttttagctcttctgaactatcaccctcaccctatctctgccatgtcatctacaaattctttttttttttaagtttacattgagtattgctcctgaacttgcacacctgtgatgatacactgatactgaaagggcctgggttatagtcatcacaatactgttgaattccatcaactccagctgttttcaccttgtgggctcttatacctgttattcagttgttctactttttctggtctattgaatttcttgtggattctttgtagaatgaatctgagttttggaagaagttgtctgctcaatttccccattctgcattaagcagcagctccttaatcagcctgagtaaatgccatacactggagggtcttgtttttcttttcttcttttttttcttgaggtggagtctcactctgtggcccaggctgcagtgcagtggtgtgatctcggatcactgcaacctccacctcccaggttcaagtgattctcccacttcagcctcccaagtagtctggattacaggcatgcaccaccacgcccggctaattttttgtatgtttagtagaaatggggtttcaccatgttggccaggctggtctcgaactcctgatctcaggtgatccgcccaccttggcctcccaaagtgttaggattacaggtgtgagccaccacgcccggcatggagggccttgtttttctaggacagtttaagctgtgctcacataaacttggtgtttctgaggctccccgttcactggccagccctgcagctccagaccattcactacttcattttaaacagatgtcagaaaagcactgacctagcctgtcctccatatataatagtttgttgatggttgcttagtctgggttatgtagataagcaattatttttcataagacttttctaccaacaggtggcactaacaatttgttttactaatgccccagtagtaatccttgtgtcacatttgaatatatcatttgcactttttgggttgaaacatagctgatttttatagatgtttaaggccagagagagagagagagagagaaatccagcatttctgatcaagtctttagcatatagtctttctcctacactactggctcatagccagtaatctgcctcttccttcattcctagtctacaccttgattggcctttcaagaaagtcagatgaatagaattcatgagaaaaacataggggtaaatataaaatgtttttcttgaggttccttactgtaggggaaaggatgacattcatattgattgcctgtgctggaggaattcaatttttaaaatatttactaaatacttattgcagaactactacatgcagagtactgttctatatattccctgttgaagaatatacagaactctgagaattagaccctactgtcagagcttatgctctaattgagataagacaggcatacaaagtaaatgtgaaatcggtaataattttctatgtccagtacatgtataggatattaatgtcagataagattgtagagtaaaatgctatgataatttggaggaggtagaggattatttctttaatcaatctatcaaatattttttatgtcagtgttcttggaatagagaatacaattgtgaacaaggttgacaaaattcttgccttcagggaaggcctctctgaggaagtgacagagctggattggtggctttagggaaggctttgcagagagttgtagccagttgaagaatgggcaggatttggctgagaagcatttgaccttgatgatctcactacacatcacatctgccctgtgtgatgggtactgttactatccccattttacacatctctcaggcacataggcacagggagatgaagttacttgtgatgtgagtggtttcctgaagcacggcatattcattttcttgtcctcaaaatgaaaaaacctcaaataggctaggacttgtttttcagaagccaggaaaacagaagagcagtctttgcctttcttcttggaagagagcggagatagctgcagctgactcagtgcgggtgacgaggaacggggtgactcaggtcttgtaagacaggctttctttcttcttttctttctttttttttttattttttattttagctaaaccccccagttctatcaatcagacaagacttctgctagaaagaaaatcagcatttgctcccacaactctccgtccttggagagcacagtgtgctcagaagagcagcactgcttgcaaagggagcccgtagctctgggaggcaggctgactccacacccaagtcttcatctgtcactgttggccatttggcatgtagcactcagacctcagtttctttgtgtgcaaaatgggggtgatggcatggagaacatacacattttttaaaattcttaccgattttctgtgggtaacattaaaaaaagttattttatttttaaattttcatttgtttaaagtttaaatttttgtatctttttttagtatttaatttttgccttcagcttcgcagacatacacattttgaatgggactgatacatctattactcatttcccttcccttcctgcacggggtactgggaacatgaaataacagtctacgattgagtcagcattgctcaccggaatgttagtcattgcatatgccctgaaagtggtgccttccaggaccgttgagatgaggatggccagcccctaacagccatctgcatccggggcctgggagagccgaacctgagactgccaggaatggtgtcacattaaaagtgcctcattcttttggggctgatcaggcccttgactcgatatttggtaatactaagaaattatagagtgatgatttgttttcacctcataggtgtgtcttccttaaaccttgttaagatgttgacacattacccatttaaagggggaaagaaaagggaaaaaaaaaggaaaaaactgaagttcattgttctaggtgtgacaattgtgtttgtagttatttatttattttttgagacgggatctcactctgtcacccaggttggagtgcagtggcaccatctcggcttactgcagtctccgcctcacagactccagtgatccttccatgtcagcctgcccagtagctggtactacagatgcatgctatcacaccaggctaattttttgtacttttagtggagacactgttccgccatgctgcccaggctgatcttgaacttctgagctcgaatgctctgcccacatcggccccccaaagtgctaggattacaggcatgagccattgcacccggcctgtagttatatttttaaaaacaatacttatctttgaaggctgcatattgacatttgaactgatgataggatgtttgaagtttgcttcaaaatatatagttcagcatgaaagtggttagtgagaaatataataggaaacaagattgaccgtaaaccaaattgttacagctggctgacacacacgtcgtagttccttttgttcttcactgtattttggtatagttttgaaatttttcataataacaaaaggctattttcaatgcgtggtcctgagcaaggatatagaaagctccatctttgggtaggagtggttgagctgtagtgcacaaactggatgctgttgctttgattgttttgattgttcaagaccttttgactccagcagagctccttgatgagcttctctcagcgtctggacagtgaccatgtgtcacgtgctggtgaacccctggccagggcccaataaatattgaatgagtaaatgaaagccagaagacctaaccgtgatccctttcttcttgtctttgcaagcggagcccagggagaatatgctggactggccactatccgagcctacttaaaccagaaaggagaggggcacagaacggtgagtatggcaggaggtggcgcttgctcaccatggggcacagaggtcctggctctcagggtcccttctgtgggacactccctccaagccttcttggaagcagatgagggaacatatagtcaagaaacaaatttctgtgaactagccattatgatccttgcttccaagacatcccacttgaccattttgaggaaaaacattcagagataaaagacttgctcaaacccagaatgcaaacgtcagccagttggctgtggaactgctctctagggagcagagggaggaagagggcaggaatgttgccattgcaagcatcctctccttggctcagccccggccctgggcctggatgaagggcagagaccatgctttaattcttcagtaacccctgttgtgctgaagcccggttctggtcatagtatgctcaaacaatatttgttgaataaataaattctccattagatgattctcaacttcaagcaccaaaaaaggcataaagcagagttcacggtcctgcttcaatgtttgctttggatatgagaacctggtctccaggatcccaatcgcctcttggggaccactgtggggaccagcaggtactaatggacaccactcgctccccccaggggcagtgcctgtagcagtggcctaactcaggcctcagcttgtgccagaggaggcctgtgttcctggttccttcattttgatggccagtgctatgctagagtttgtactgagctgtggggcggaagtccttaataggagcatcgcctaggagccgagagcagggcaaaagcatctgctgatactagagagttgcagacaaaggggatagggtggtgctggctggctaagtaagtagggtggagtggtagtggcccgatcttagtccatttctggttttattaccactggaaggttacttatggctagttgcctggaatttgcaataaagaatgctgaaagtgtttcacttccctttcataacaggggaaacgaaggaacatttttttccctccttcccttgcatagttcatcctgattccacaggtgtgtctttccaggctttcatcttggttggggaatagaattttttttttttttttgagatggagtctcgccctgttccccaggctggagtgcaatggcccaatctcggctcattgcaacctctgcctcctgggttcaagcgattcttgtgcctcagcctcctgagtagctgggattacaggcatgcgccaccacgcccggctaatttttgtatttttagtagaaacagagtttcaccatgttgatcaggctagtctcgaactcctgacctcaggtgatccacccgcccctggacctctcaaagtgctgggattataggtgtgagccactgcgcctggcccttttttttttctcttcatagctcactgcagccttgaactcctgggctcaaggaagcctcccaaagtgctagggagaccaggattacaggcatgaccctctgcacctggccctagaattcatgtctaaagatctttgaaaaacaggccattcgtgaattgaataaatgattaaaccctggtcaaggactgcttgccagtccagagagaagtgaagtggtcaaccagacagacacagaccctgaaattcccccacagtttgttcattcgtggttctgaattctcagctttctaaggaatgattagtttagaactataattgctcttgggacctgagagtctcggcactttcacagaatcagaaaggaaactttggagctccaggtgtccagccagtaaaacaatgccagattctctcctgtctgtttttccctcatggcttccatgttctgaggtcgtctctggagttcctcttcattagtatctttcaccacgaggtgcccaggagcctggggatgctggaaaggggcagcctgtcctgtgtgacatctccacccgactcctccactgcttggcggagaggccgcagaaagcagtgtttgcagaaagcaggtgactagctaatggcaaagggccagctaaaatccagattctttccacgcagtaatgcttcccacccctcgccatttcccaaatttcccaatctgacaccaggaagtagctgtgaatgtccagcagctggggaccaaactggaaaggccaaggagaaagaatgaaaggcctttgggtttggcctgggcggggttcttccgtgacttgtggattctttctggttcctgttccctctctttgtgttttcctgtcctccttcccttctccacccactgtgtgtgatgtttctcttggccccattgcccatcctgccatcactgaagtgtcatgagaggccatttcactctgcaggagggagaggggctgggtgctgtgcttcagggagagggggaaagggagaggcagggaagccctccagccactgagctggtagaaatacaaagctcattagcctggaaatgttggcatccttctggatcagaaattttaattagctcgggcatggtggctcatgcctgtaatcccagcacattgggaggctaaggcaggcagatcacctaaggtcaggagttcaagaccagcctggccaacatagcaaaaccctgtctctactaaaaacacaaaaattagccaggcatggtggtgcacgcctgtgatcccagctactgagggaggctgaggcaggagaatcacttgaatccaggaggcagaggttgcagtgagctgagatcgcaccactgcactccagcctgggcaacagagcaagactccctctcaaaaaaaaattttttttaattaaagccaactttcttagttagagaagaaaatgatttagtattcactaatcagggaagattttttcacatcactgatgtctgaggcagctgctcccacacaatagattctaatggaatccagcaaaatatatcattcttttttgaaagggagtgtggggaagtcatgtgcagggagtgtggggaaatcatgtgctacagaagtgcctgggctcctgatgggtcttttctttcaagctgctttttgaagttattttcacattttctcttaggttaaatttcagaggttcctaaaatggaatgcctaacttcttgatttatgagtttactttgggagaatacaaatttatttaacaaacacttatatggcaattaccatgtaccaggcatggcctttaacactttataattaatatttcaatttgtcagtcaaatcctgacttactcagcagacctccagatcttacgaaaaaataaaaactctaaagaaaaacaattaggtttgctgttcagagtctgagtttcctatacaaagggaaaacattgaccaaaggaaacaaattatgttatatgtaaatcaacaaagaaagctcaaaacctgtatgggaatatttttttcttcccaactgcctgagacaaagtagtggcctttggttgttagattttaccagtggtaagacattagtttcccttgcacaggagatctccttaacccttcactcattcaacaagtctaaagatgacctcatgctattctatgccacgcggcaccctggggagttgagaaaacatagcaccccctaaatgggcatcaatgcaccaaatgctggatttgctttggataaaccaaaacttcaaatctgggtcgtgttacttccatatccctcacaacaatacaatttttttcccccaagagagactctcactctgtcacccaggctggagtgcaatggcatgatcttggcttatggcaacctccgcctcccgggttcaagtgattctcatgcctcagcctcccaagtagctgggactgtaggcgtgcaccaccatgcctggctattttttgtatttttattagagacagggtttcaccatgttggccaggctggtcttgaactcctggcctcaagtgaaccgcctgcctcagcctcccaaagtgctgggattacagacatgagcaacctcgcccggccaacactacaattttaaactgaggaaaaacttaacattataaagaataattaaagtcctctaaatcctcatagaaaaccagaaatgtctgacagcaacatataaatgagtgcttcacaaagccactgtgacttctctttccatcgctccttgtaccaggatgtgtattagtttcctatggctgctatgataaatttctacaggcttagtggcttaaaacaacacacattaattttcttatagttgcagaggccaggtgtcagaaattggtttcactgggctaaagtcaaagtgttggtagagctgattccttctgggggagacaggggagaatctgtttccttacctttcctggcatctgcaggcctcctgcgttccttggctcgagcttcctgcttcagtcagcacatctcccgctccctctgtggtcccatctccctctgcttccctctgatgaggacacttaagaatatatttagggcccagcccaaaatccagaagaatttttccatctcaagatctttctttaccttaatcccatctgcaagtcccccttgccatataaggaaacacccacaggttccgaggattaggacagggatgtctttgggagcccgttattcagtgtaccacagggtggttgacgtttttatatgtttgtgtttcaacagaactcacctggtatgaattcttcattttggctttctatgaatattttatatttatttttaacattcccctttctccttcttatcaatattctgccctgaagggatcctttcatccaacgatccttttgtagactagcaatacctgtgagagaggacagtgcctccagcttgggtcctcagaaattaaagaaaaaaattaactacaaaagggaagcattcaaacaagaaaaacggatttgaggacaacgtgacataaccagtatgagaccaacagccgttctaaagggacacaaaccttctgacagtagaagagtgcaaagtagttcatgtttgcctttggctaatgttttctttttgtacacgtttatttttcttaagtagactcctttgctgtttttgaggaaagagctgtaagctaagatttaacttcatagcctattttcaataatgcccatccatctctctgtgggataaaaaataggaggatgattttcagggtaatcatggcttctccttgatgctttttgttggggaaaaccttctgacttactttcccactgggacacatcgtcagttctacaagagcctgtgtccacatggttgtttggaggaaatgaaggatgatttgagtctgagaattttagcattgcacctactgtccagcttccataaaaattcagtgcagctgtaagctctaacttaggctcagctcttgaggcactttgccttgatttccttaacctgaagctacatccccttgtccatgtttctgctgcatctctggactctagacagtcattcacaggccaccattgttagtgagtgagttgtgtgaacccggggtaggggttggtcatttttatttttagctattttttttttttgagacggagtcttgctctgttgcccaggctggagtgcaatggcgcgatctcggctcgctgcaacctccacctcccggattcaagcgaatcttctgtctcagcctcctgagtagctgggactacaggcgtgcgtcaccacacctggctaatttttgtatttttaatagagacagcatttcgccatgttggccaggctggtcttgaactcctgacctccacctcccgaagtgttgggattacaggcgtgagccaccatgcccggccaggttgatctttttttttttttttttttttttttaaatacggagtttcactcttgtcgcccaggctggagtgcaatagcgcaatctcggctcaccgcaacctacacctcctggtttaaaccaattctcctgcctcagcctctcgagtaactgggattacagacgcctaccaccacacccagctattttttgtatttttactagagacggggtttcaccatgttggccaggctggtctctaactcctgacctcaggtgatccacccgcctcggcctcccaaagtgctgggattacacgcgtgagccactgcacctggccgggttgatcattattaatgcttagtttatggttcttatagaaactaataatttattacagagtaaacatccgataaatattgatataattggtgtattggtactgggaggccttggaattaacgtctgtcattatcatctgtcctggataagccaagcagagcactgaagctgtgatgtgggccctgagtccttgagtttaacttccagtctcatgttcttctaaggtgctttctgtgtatcctaactgagacaaggttagaataagtccaggcctatttttattgtactgggataaaggaagattgtattgatttcctgagcatcttcagggaacaatatttagggattcatatggaaactttttttggacattgctttgcaatgacaaataattaaattgtagcagattttaaagcactagtgttcagcctaaataaaaacaggtggtgtctaatttgtgctacaagcatgttgtagtacttttctgtcattattcatagtctgatgatgattttgctctttctttgcttcctttctattctgtaggtttgcctcattccgaaatcagcacatgggaccaacccagcaagtgcccacatggcaggcatgaagattcagcctgtggaggtggataaatatgggaatatcgatgcagttcacctcaaggccatggtacttgtcttctccttagcagatgggagaggccgggatggggagtgctggtggggatcagggacttgatggattatgtaaatgtcttctcttgcattctaatgaaaagtctgcagttcttcctttgaccagagtctactctacccctcccatcaccaacagggagaaatccccgttttctaattccagcttgtgtaaaaaactgaatgaattattcatggtggtagtaagagtactccttgcagaacctgcctgcctctttctgcccaatcttccctctccttctcgccttccccacttaataatcaaaatggcagtcacacttacacatcttcgtgtcaggaattgtaacacaaatgtcagctttgcaaatatccatgactgtgccagccccatcatgctgaattcctggcatcatgcagcttggtttccaccaacccccactctcaacctcccaacctccaggaagaagttgcttagcaaccgtatctgcttcccaccagcggactggcagctgcatcttaagcgggaaggaaaccagtggaatagcaatgtgattttgatggtggtgttattaggcatggagactgtgaactctgtgcagttgccttctaaaggaagctgaaaatccacaatgctgcacctctcttcgatccacctctacccttccattgctccacaaagcttttttccaacaagtgttccaggccagtagttgaaattattaagtccctccattatagtaatataggacatgacttccctggccacccccatgttctcaaacatgcctgctctgatatgctggccaggaaaacaaacagggatgtgacttttatatatgcttgccttctgtaaaaggaaagaataaagaagacttttatttacagaaacacttcttgtgggaattctttttttttttttttttccaattcctgttctttatctttttgtttgtttgttttgagacggagtctcaccctgtcgcccaggctggagtgcagtggcacgatctcggctcactgcaacctccgcctcccgggttcaagcaattctcctgcctcagcctcctgattagctgggactacaggcgtgtgccaccatgcccagctactttttgtatttttagtagagacagggtttccccgtgttggccaggatagtctcgatctcctgacctcatgatccgcccgcctcagcctcccaaagtgctgagattacaggcgtgagctaccacgcctggcctctgttctttatctttttaaatgacaatagttgtacatagtcatggggtatatagtgatgtttctatacatcaaatgtatagagatcagatcagggtaatcagcatatccatcatctcaagcatgtatcatttctttgtgttgagggaacgttcaatatcctccttctaactattcaaaattatatattgttaaatatagtcatcctgcagtggtatagaactctacaacttactcctcctatctagctgtaatttgggaattttaacttcaacagaaggcaagggaaaggaatggatatgagaagatgagcagagagattaactatgagaatggacgcacctagaaccacaaacgtctgaaatcgttattgagatgacttgaaccaagggaaaaccaccttagagagttgggcccaaaatatccaaaaatcttgtgaatagtccttttggtctggaccatagagacctagcctgaaaggatcttattatttctttttttcttttttcttttttttttttgacgtggagtctctctctgttgtccaagctggagtgcagtggtgtgatcttggctcactacaacctccacctcaccggttcaagcaattgtccctgcctcagcctcctaagtagctgggattacaggcacctgccaccatgctcggctaatctttgtatttttagtagagacggggtttcaccatgttggccaggctggtctcgaattcttgaccttaggtgatctgcccgcctcggcctcccagagtgccgggattacgggcatgagccaccacacccagccaggatcttattatttctttggaatgatttgtgaagggagtaatggctgtggtttttttttattgctgtcattgtactttgagacagttccaggaaagtaaagactgagacttcatctttcttcatcctttaaaatgaaaggcgaggatttggccaagaaagaaacatatcctccctccatgtccttctctaccccttttctttcacaggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaactgaagaggcccgcccttagttcccactgagaaaatggatatgtggaaaaaaaaaaaaattctgacttcttgagaggcttcctgcctgagggaactcagacccacgacctgaccactggtggttgttgatctctcatggccttggaaagccacttatcctggcatcagctttatcagctgtgaaatgggggctcaaagggcccaatcctgattacttgggggacagaggatctatgtactgtgaacctctgaagaaatgctgttgggagcccctgcaggagaggagtgacacaatctttttgagactcttattggtgtttgcttttttcctttttctttctttctttctttttttagatggagtctcactctgtcgccaaggctggagtgcagtggtgcgatgtctgctcactgcaacctccacctcctgggttcaagcagttctgctgcctcagcctcccgagtagctgggactacaggtgcatgctgccacacccagctaatttttttaaatttttttatttttatttttgtattttagtagagatggggtttcactgtgttgcccaggctggtcttgaactcctgagctcaggcaatccacctgcctcagcttcccaaagtgctaggattacaggtgtgatccaccacgcccgacctcttttttttttcctaccattttagagcctttctttggttctcattcatttcacaagtgtaatccagagattgtctattggttctgtagcataaatgaattctgtacctttggtcaccatcaaaattagtcctaacacccaagtggtgggaaggctagtgggatggcatgcctggcatctgggtcatctcgggaagactgcgagccttgccttccctctctcagttcagcctcctccctggtgcccccgcagccccttccatcactgtgcccaacggggccgttcggtaacgtgcatcatactaaagccgaccacgcaggggaaggtagcgctgctcagggaagagttgcctatttcaacaacatggaggttctgccctttcttgtgttagagacacttctctccctttgtggtgtgtggataattaggaagagactgtgtattcaaatccatatttttaaatctaaattggactaaatggtcagttgctatttccatagcaaccacaagcactctgcctatcggatgccagtttgtgactacggaactgggccagtatagaggacatttctgtgaacaccatggatgtggctctgcctgcttttcctctgaggggagaaggcagcaccggccagccatggccttcacactggagggtgcttccaagctcttgacttttgcttttggcccttgcctttgtggtaggtgggaatctgtcgccctggagacttcgggtctgatgtctcgcacctaaatcttcacaagaccttctgcattccccacggaggaggtggtcctggcatggggcccatcggagtgtaagttctgggctgctggtttcaggatggctttggagacagaatgaaggagtggccctaaatagactactcatcccatcaaagtcttcatgtgttgaggataccctcatcggtgtagtgcacttgtaggggctgggggaggagcagcaaaatgggtgcttttaggggatttccaaagaaaagcgtaattagattttactaaccatagcatctggcctcactgagcttccagttgcacatagacagcaggtttattaacagaataatgaatagggaacttcacctgagcatacgtattgtaactggaatattggcactagaaagtgcctttcggacttttggatttcctagcattttttttttcttttttaaaatcagctaatggttccattgaaagtgaattagatgtaaggtgttgagataagtaacacataagtaaggaagaaacaaacctggttactagaaataattggatgaagccagagtaggactgaaggaatatttcttagctgtggataactttttacactgaaatcaaatcatcttgggaaaatgatgatgagagcagctgttttcctgagctgcttcagtctcccaaaaatatgctaaagaagtcagttttcagagttgctggaagcttggccttcttacttttttcttctttcttgttttttttttcttggactacggttaaagtgagattcattttgatgatgattatttctagtaaatgtgtgagctccagtgcttcagctgtcagggaggtggggagaatgatgttcatgtcagcccatggggcatcttctcatcagcccctcctatgtccatcttgggaaagtgtataggggtgagggaatggggctgggagtgggagggagggacatggaactccactgttttatggctgcctgcctctatcaagccctccaccacatttcttgggtgagccctgggacactgatggctggtggacctccaccagaggaggaaggaaggaaggatcgcttcctgaacatctgcctcccagcaggtggagagtcccttccactgtcagagctcctctgctaagaacaaggctttctgggagggcccagaaccttcccattagattaaactgaatcgtttacattttctgaatttgcacttaaaaaaaatacaggaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaaggtgaggcctgggagtatgtgcaggtgtgcaggtgggtgggggcgtcaggcatgcatggggaccggatactgcagacttcttggcttaaaaacaaataaattcatgatctgagatgtggttcaaagaatattgctgatggcctgggtggaagaaaccttcctgaagagatgagctaaaaatcatttcatctctccttcattacactacttcttttgggttctcagagtgggtttaacatcagagaaactgaaacatcagatatatttttccagacacagctaagttccatgagtcatatggatgttctggccgcatcctttggtttcctgcaggatttatatagccccttccgagtgaaaagcagtgcatgtactaattattccactttgctgagatcctgctatatatctcactttgctatatatttcttggggggggccagaggagaagatgaaaaatagcagaaatttgcttctctggtttttccccagagctctttggcctttagggtttgtggtgctgtgctctctgcgtaattagtcagagtacaggcttccttcctttgtcttattccaaataacaccagggccagagttgattttctacagttcttgttcacactgccctgcccacctcctggactgacaagactgtgaataagaacacttgtttggctgctcattagagcagtctccccaaagcagtgcccctctttaaaggaaggcgggctcccactgaaacaaaacccccaaaacgcagctatgccaatcattccagaggactctgtggagctgactgtttatttctggaacagcatggcatttatgattcttcacgaaaagtttcttggaagccggaacaattctgtacctcagacactaacacttgcttttaaaaatgatactcaagttgttttgcaaacaacacaagcaatcagaataaaggtctgcttctttgtaagcagaatcaaattccacttcccttttgatctctgggttctgtaaatctgggttatttgtatgaacatatttgggttggagatgacttcccacatataggaaataaatgccccaaggttggtttggctacatgcctggaacaacagctggtgcctcagtttaaaaactaaataaataaagtagggtttaagctgccccctctggccttgggccttctcttatttcaggctgttattacttatcccctggactctagctttagctgcttctctccctgctgcaattccacaggcgcacctacaggactgctagactcaccctaggcccccacgtatctctcgtggcttcctgttgctttacctggttctcactagcctgcacgaaatccttaggggattctttcagaatgcacatgcctaggccccattccaaggagaaccaaactgagcacatgtagggttggacttaagccgtctgcatttttaaaaaatccccccatgagacataggttgagagccagtggttggctggacaaagtcgaagtccttcctagagaagttttgggcttaaaaatggagtcacaactcaccttgccctacatccactcccagatgacagtcatgtgccctccccttccacgccttcatttctgccattcttctcacctggtataccttctcctttctctttccctatccgaattctacttatttctaagtttctagccaagttctggctcttaatctaggaacccttctttgaccagcctggagcaatgtggcccctttttactttggacccccttaatgataccaaagtactactgttgttttatttggtgctctctcattctctttacattagttatgtatttaatatatatgccaactccatcacatgtgaggtactctgggaagaaagtaggccataagaattggtgcagtcttgatttgaagctctttgcagtgatgatgtgtatcccttatgatcacagggactcttaactaccaggacaagattgagcagtttttaaacataagcagcctctactagggacaatgggaaaataaaccagacaaaattgcttccgtggagatattggcccagatcccatcggattcctggcaattatcaagacctctcaaattcatagtaaacaaacaaaaaaatcacaaaacacatgtaatttaagaacaattcttttctctctttagataacacagtagtcagtagtcagcttgccctgttgtaggctttgctactacaataaagaacgtaaaactactattaaaagaagaaaacaaaaatgtattacaggcttacagggatctgacagatatccttgttggaattttccactcatctttactccagagtcatggtgggctgccttcctttgtgggtggagtttatctgggggtgtcttttggttggtttcttcacattcgtgtttgcctgttcaatggctaatggctctttttccctttgttgcagatgatgggaggcaagggtcttaaacaagccacggaaactgcgatattaaatgccaactacatggccaagcgattagaaacacactacagaattcttttcaggggtgcaagaggcaagtatcaactttaatctatcattactttggtttttttcttggccaaactaagtttgacctagatgcgcttttctgacatgggcaagagacttctatttcttagcacatatcagaaaatagtgtagagttcttggaaataactcgggtttattttattttatcttgttatttttgagatagagtcttgctctgtcacccaggctggagtccagtggcaggatcttgtctcactgcaatttctgcctcccgggttcaagcgattcttttgcctcagcctcccgagtagctgggactacacgtgtgcaccaccatgcccggctaatttttatatttttagtagagacagggtttcaccatattggccaggctggtctcgaactcctgacctcaggtgatccacctgtctcagcctcccaaagtgctgggattacaggcatgagccaccacgcccagccataacaccactttagttaactgtttaggggcattactatatgcaggtttctcctaggctcctagtctacacagcagcccaggtcaataaagattccacaacactgaaatgtgtacataaataccataagctaattatttacaaagtgctatgatatgccttgaaagagtagagtaactcagactgggtagaggcaggatagaatggttgacagcgccttcttgctggagccatttgagatgggcctggaagccagcgtagccgatgagagcctgagtaagcagagacacaggagcaaaccagagaaaagaaagctctctggtctggagtgaaggatgggataggggagagggagcaaatgacaatgaggctggaaatgtagcgtggggccttgaaggccttggaaggctctggacttcacccttgagctggacaatagccattaaaggtttttgagcaggggagggtagggattcatgaagagaccgttacaatcattaagacggcggcaagggggaaacatgccttagaggtagcaaggggctggggtggtggctcacacctgcaatcctgtaatcacacctgtgattgaaggttagctagcctctagggcttacagtagagggaataataggcaggggaacaaagtcaccctggaagtgatgggagggaactaaaaaccaggcatccttttacacattgggctgtgggctcaggacctaatagctgagtcttggaagtggtgaggccccaggaaagaatattgaaggtgagaagccagaacaaaacgcctcaagtagatggctacattaagagggagggagaagttgggtgcctggtgaggggcactccacacctgaggcagctttagaaccctggcagtgcttggcacagtgcctctccctcaacacccctgcctggccctcctgctgccgtgtggctccacctcctccctgcagcctccactccctcctcttgcccacccccgaccccaccccggagcagctgctctcccacttggtattgtctggctctgtccatctgactccagggtccaggagagagtggaggctgcgcctgctttgtttctctggcagtcaacagacaaatgcacgtgatgacgcataataaggagagacactgtaaagagcgggtggctgatttaatcttacttaagtttatttagattttttctgcttttactgaggtatgattgacatctgattttaaattatgagtcttaaaaggaacctttgtctataacaattaggaagcctttggtagcctttgaaagtagtttgggcacaatggtgaggcagacgctgggtgtttaaaatgggctgagatgtggatggaggtcgggaaggagaggggaaaaggattccatgtttgcaggtagtgaaggaggagggggctgcttcagtaggatgtagttatattttctttttaactatgaaaacaacatgattttaagctgtgagaagggagagcaaagatacctttgagagaaaaacagatgggggaacaaagtcaccctggaagggaaaggctggaactgagaaccaggtacaagtccttgctatgggcccagagtaagagcaggacagagaccaggacctggagcttagatcagagagacagacgtcaggaaccagcccaccctcctgcacctgggcaacagcaacaaagcgcttatgggatcttggtttctctggtccaggtggaatgtacctctatagctgtgatctttaatttaatggctggtcttaccttataaatcagtatccaaaggggtggttccacagtttgaaaaagaataggaccaaataaccagaagtgctggttaaaatgctccccagagagcagaaaacacagttgtgggcaacatgtctctaagcagcacaataaaatgcttctgtgaagtgggtactaaagaagtgacaagagcttctaattaattcaaatctagcttagctcctgctctgtgaaatgtatcctgcttgtgtattggctttaaggaatagcttcaatatttatttcatcagattacataaataatgtatatatgctcaacacggacattttggaaaataataaagcatgacaaagaaaatgtaaatggtccatggttccatcaatcagttatagccattactaatattttctgtatttcttctcctctttgtttgtacaattgatcatactacagatagttttattagtttgttgtccaggctgaagtgcagtggtgccatggcagctcattgcaatcttcagctcctgggctcaagtcatcctcctaactcatcctcccaagtagctgggaacacaggcatacacccgccacacctggctaatttatttatatatatattttttgtagagacggggtcttgctctgttgcccaggttggtcttgaactcctctgctctagtgatcctcccacctcggcctcccaaaatgctggggttatgggtgtgagccactgcacctggcctacaaatacagtttttagcctattttttaaatgtatattatgagcattttcccctgtcactaaatattctttgaaagtggcactgtcaattccattgtgtagatgtgccatgatttaaccaattgtatagtttttcttccctttgtttgcatttattacaatgtggccgtgagtatcctttgcttgaaattttaaagaattttgcctgataatttccttaggagagagtcatagaaaaaattattatctcagaggatataaatgcactgaagcttttgacatgtatggcttcaatttttttcccagagactttgtgccaatttatctcacagtgataacatatgagagtggccatcacacaggggcctagtgaggactgagaactagacagaagaacaagtaaacaatatatcatggccaatttgataggtgaaaatgaccttattgttttagtatatgtagccaatgcgctcaatgtttccctagttcttagtgccagccttgtccatccagggtaactgtgttcccccatctgttctgtctacttccttctccttcacagctgactctctgatttcacagcttaaaatcatgttgtttccatatcttaaaaagacatataactgcatcctattggttttttccctaattgcttatttgttcatattttaaacttcctcacgtttaattttatttagtagcagccgggtgtgttggttcacacctgtaatccaagcactttggaaggctgaggcgggttgtctaaaagtatgacacttacatttaatatatagtacctaataataatgataaagactatgctgctggtttatgtattcactacataatgcttcttatcattattattattattattattatttttgagacagagtctcgcttggtcacccaggtgggagtgcagtggtgtgatgttggctcactgcaacctccgcctcccaggttcaagcgattctcctgcctcagcttccccagtagctgggactacaggtgttcatcaccacgcttggctgatttttgtatttttagtagagacagggtttcatcctgttgcccgggctggtctcaaactcctgacctcaggtgatcctcccaccttggcctccccaaatgctgggattacaggcgtgagccactgcgtctggcccccatcattattttagagtgtattccttctactgtaaaaaaaaaatgttaactgtaaaacagcttcagggcggtccttcaggaggtattccagaagaaggcattgtcatcacaggagatagcagctccgtgtgtgttactgtccctgaacaccttccagaggacaagatgtcggaggtggggctaggtgctgtggctcatgcctgcaatcccagcagtttgggaggccaagccgggagggttgcttgagcccaggagtctgagaccagcctgggaaatatcatgagacctgtctcttccaaaaaaaaaaaaaaagaaaaaattaaccaccatggtggtgcacacctgtagtcccagctacttggaaggttgaggcaggaggattgcttgagcctgggaagttgaggctgcagtgagttgtaatggtgccactgcactccagcctgggtgacagagtgagacactgtctcaaaaaaaaaagatgaggaggtggaagacaatgatattgagcatcctgaatctgtaggcctagacaaaggtgtgtgtttgtgtcttagtttttaacaaaaaagtttaaaaagtaaaaagaaattaaatatagaagaaagcatatagaataaggacattgaaaaagaaaatatttttgtacagctgtacaatgtatttgtgtttaaagtgttattacaaaagagtcagaaaggtttaaaaaatttagtttataaagtaaaaaagttacagtacgctgggcatggtggctcacgcctataatcccagcactttggaaggctgaggcgggcagatcacttgaactcaggagttcgagaccagccaggccaacatggtgaaaccccgtctctactaaaaatacaaaaattagccaggcatggtggtggacatctgtaatcccagctactcgggaggctgaggcataataatcgcttgaacccaggaataggaggctgcagtgagccgagattgcgccactgcactccagcctgggcaacagattgagactctgtctcaaaaataaaaaaagttacagtaagctaaggttaatttattattgaagaaaaaagtttttttaaataaattaatatagcctaagtgtacagcgttcacaaagtctatggtagtatacaggaatgtcctagaccttcccgttcactcaccactcactcactgactcatccagagcaacttcagccctgcaagctccattcatggtaagtgccctacacagatgtaccattttttatgttttatgtcgtatttttgctctgtcttttctatgttgagatatgttaagatacacagattcggaccattgtgttacaattgcctacagtattcagtacagtaggagcaagaggctgtaccatgtagcctaggtatatatagtagactttaccaactagtttatgtaagtacaccatgctgtttgcacaatgacaaagtcatctcacaatgcacttctcagaacgtattcccttcattaagtgatgcatgactgtattctgctagaatgaggaaagaaaggaattacctcaggtaagatgatacttttttttttttcttttttttgagacagagtttcgctcttgttacccagactggattgcaatggcgcaatctcagctcacctcaacctctgcctcccgggttcaagcgattctcccacctcagcctcctgagtagctgggattacaggcatgcaccaccatgcctggctaactttgtatttttagtagagacagtgtttctccttgttggtcaggctggtctcaaactaccgacctcaggtgatccacccaccttggcctcccaaagtgctgggattacaggtgtgagccattgccccggcaagttgatacattttaaaggaagaattgcaaaaatccacagctgtctacttttataggaggcaaaggtttgatctgaatggagttcccattagtaggaggagatgactttgttagtatcccaacgttttctttatgttttaatttcttatatgcctatccatttttttttttttttttgagacagagtcttgctctgtcacccaggctagagtccagtggtgcaatctcggctcactgcaacccccgcctccccggctcaagcaattctcctgcctcagcctcccactatgattacaggtgcccgccactgcactcggctgatttttgtattttcagtatagacgaggtttcgccatgttggctaggcttatcttgaaatcttgacctcaggtcttctgcctttttttttgtttttccatcagacaaacagcgactttgcctgcaaatacctgtccctgcggaggtttccaggtggcccttgctgtatgggtgggcaggggcctcaggggctgggccctcacatccttggctcacaagtgaccctgctcagtcccgcttacctgacctcattctcggggaaacctcattctcgcttgaactacagggaaacagccgggaggtttgattctgttagtcatgttctgtggatttcagctaaaaggcttgaccaagcattgattgcccagcagagctttccagagtagttacccagtgagttcatttattcctcagcagccgccttgaggatgggggataagtaaggtctggtcccttctctcaaggagggttttgagcagccctattttttcacagcacactcccatattgttcttaccctcagaagacaatcaacatatgggggcggtggttcccacttagatagccacccaacgtttaccttgcttttccttcatccccccccctcctgtcctccttgcccctttcacgtggtaccttctcagctgtagtcactgttaggtccagcagaaacacctactctgttaacacgaaaagttggtgctgagtggtttattcagtttccacttgatatcgccccaacattgccctatagcaggtttgtgtgtcctaaaagctgcaaagaacatcttaggatctggcttctgacagccaccaagttgaaatttcatccctttcagggctcacatagagatggagagagatgctggaattccaccgcagtttctatttgaacgcaatagagtatggatttagaaaataacatctgaacctcatttagaaaatggagctcttcctaaacctcttggctatggtggggacctcttcagatggcactgtagtattagcagtgctgtgttgggcttggcttgacggtgcctttcagctattactgaacctctgcttggaagactctcctcttgcgctgccagcaagagtgcctcctcccccactgtgtctctcccctcctcccctccctgctgtctggtgtcattccgagcagtgagcttccattagccttcgtcctccaatcattgtcacaatcagggcattttgttttgtttaagagacggtcttgctttattacccaggctggagtacagtcacattatcatagctcattgcagcctcaacctcctgggatcaagcgattctcccacctcagcctcccaagtagctggaactacagatgtctgccacacacctggctaatttttaaatattttgtaggatagggtcttgctttgttgcccaggctggtctccaactcccaagctcaagcaatcctcagctgagcatttaagagtcctggtattaatagttgataaaaacttagtctaatgattttccccttgaacattccacttactattctgtttcagcattttttccctatgtttacctacccatgaataggattttctacctcttttttttttttttttttttttttgagaaaaggtctcactccgtcacccaggctggaatgcagtgatgtgatctcggctcactgcagccttgacctcctgggctcaaatgattctcccacctcagccttacacgtagctggtactacaggcaggcacaactgcacctagctaattttttgtttttttgtagaaacaagctctcactatgctgcccaggctggtctcaaactcctgagctcaagcgatcttcctgcctcggtctcctgaaatgctgggattacaagtgtgagctaccatgcccggctgaattttctgcttttgaatcatactccttacagtttattccccatcattgttagaaagcatgttttgcctgggcgcagtggctcacggcctgtaatcccagcactttgggaggctgaggtggggggatcacttgagcccaggagtttgagaccagcctagccatagtgagaccccatctctacaaaaaatacaaaaattagctgggcatgtggtgcacacctgtagtcccagctactctcaggaggctgaactgagaggattgcttgggcccaggaggccaaggctgcagtgagctgttatggcactactgcactccagcctgagtgacggagcgctcaactgtgtctcaatttcttttttccttgagacagagtcttgctctgtcaccaggctggagtgcagtggcatgatcttcgctcactgcaacctccgactcccgggttcaagcaattctcctgtctaagcctcccaagtagctgggactacaggcatgcgccaccacgcccagctaatttttgtatttttagtagagatggggtttcaccacgttggccaggatggtcttgatctctggacctcgtgatccgcccgcctcggcctcgcaaagtgctgggattacaggcttgagccaccgcgcctggcccctatttcaatgtttttgaagttttttttttttttcttcaagcgtggtttaaaaatatgcagtttcagtatattcagagtcttacgctctttatagttttattttcaaacaaaaccacttctttttttttttttttttttttttgagatgaagtctcgctttgtctcccaggctgcagtgcagtggtgccatctcggctcactgcaaccaccaccttccaggttcaagcaattctctcactcagtctcccgagtagctggaactacaggcacccgcccctacacctggctaatttttgtaatttttttttcgtagagacagggtttcaccatgtcggccaggctggttttgaactcctgacctcaagtgatttgcctgcctcagcctcccaacgtgctgggattacaggtgtgagccaatgagcccagctccacctctttcatgtttattcattctataagaagcagagcagttcgtagactgtcttcaggggctattaattactggagctattcttcacaggcttgagaagttatgcttgctctgagtctctataagtggattcatttttgctgagagtgaggaacgtgggttaagaagaaggagtacatcattatctcatgagtagatactttcctggaaggaaattcatcagttggtggaccgtggaatttgggaagccccggaggaatattggtctatttattaaaacgctgacttaatggtttattcctgatgatggttgtgtggtcagtagctcattctggggagctactggcagcctggacctagagaagaagcctgtttatgaactacaggtcgaatatccctaatctgaaaatctaaaactttttctaaaaatttatatttatttttttgagacagggtcttgcccctattacccaggctggagtgcagttgtgtgatcgcggctcactgcagcctcgacttcccaggctcaggtgattctatttttagtagggctagggtttggccatgttgccctggctggtctggaactcctgatctaaaacgatctgcccacctcagcctcccaaagtgctgggattaccagcatgagtcactgtgcctggcctgaaaatccaaaacttttgggtgcccacatgaggctcaaataaagatctgtaatttcaaataagggatatgtcattggtagaacaaagtgaactgggtcgcacagactttggcctcattaactccttgttacttacggtatactgtttgacgtcgcgtatttctaattctttgtttgcagcctgaaaccaaaacatcaaaaggtccttcaaagaaacataaaattctgtatgtgtcttatggatatatgtttaatatatccatacctatatatacgcaaaagtaattatttgatgttgagggtaaagttgctgaaaagtgtcaatggctctagaaatattttgtataaaaggatcaggactatacaacacatttaactgttgcaagtagattttatgtccgcagaatagaaataatctcatccccagacacctccggtcatatgttcagtaatgccccccacctgccattagccataatcaggttcacaggtgtgtagtgagctgaagataagacacatcggcacagtgtgctaaacatttttatttgtaataagactaaatgaaacctttattgccaataataaacttacccggtgcccatggcttcttggtcctcgctgatacacataaaaagctgatgcacttatttattaaattacttattcatttgtttgggtaaaacaataagctgatgctaatcttgggctgaaacaactttcctgaacaggttatgtgggtcatgaatttattttggacacgagacccttcaaaaagtctgcaaatattgaggctgtggatgtggccaagagactccaggattatggtaagtggcttttgacattcatgccgccgcccatgctggctgtggaccacttcctaaagcacaaatggaaaatgcaggcaccacagtaaactgatctgggggataaatggggagctcagggttcttggcaacctccaaaataatagagaaaaaagtttgcttatgactgcactggtcctgcccttcagaagatattaaaatatgcatcttgaatccattaacagccaagaaaagtgtttaagattaaaattaaaacccctttgagttgcagtgagtgtagtggtaaaggagacagagcaagtaacccatcgaagtggtagagacaaatggcattggagttttatagccacctctgtcatggcgtagctgtttcagctgcttctagagatgaagaaataagtgtagtagttttcacaaagaaaatgcaactttctttgaagcattttgaaagacacggacactttacctgtgcattagtgggtgttcattcagctcagctcactacattttcctagtgaacaatgttattaatattaaaatattaagaccatattacttttttgggggttggggagacagagtctcactttgtcgcccaggctggagtgcagtgatgtgatctcagctcactgcaacctccacctcctgggttcaagtgattctcatgcctcagcctcccacgtagctgggactacaggtgcacaccaccatacccagctatttttttatatttttagtagagatggggtttcaccatgttggccaggctggtctcagtctcctgagctcaggcaatccacccacctcggcctccgaaagtgctgggattacaggtgtgagccagcacgcccagccaatattactattataataatatgaaaatgataataatatcaaggatctttcaattctcagaaaggctaagttggggagaacattgccattcaatggatatggagtcctctctgagttttaatgacttgtttttggaaaaaaagaaaaaaatcttttaaatttaatagtttcactactgcatcataatgggaatcccatgtgtgtgactcactcctctcttgaatgaatgatcttattatgcagttacactgataatagatgggaaagccagagaaaggcttcattaatgaaattaccaatcccatcctcaagatctctgcttggcaactcttgtaacctgacagtagaactcctttcccctgacagcctcccggctagcgattgggtaatggccgactcaggaaaacacactcactttgtggatgccttgcctacttcacacatctaactgcaacagcatttgcaaggagagagaggaggggctcacagggaggtggtaactgaagtcaccacccagtgtttctgaatcatgttgtctcctgacctcaatgttgttttgaagattgatagaaccgtttccacacttgtccaaaagcccagaattgtccaggtgcctggcacatagtaggcactcaacacatagtgttaataaatgagagaccaaatgaatagctaagtcgaaaaacaatgaacatgacaacacagtttccaggtcttaaagcataaccgctgaatgtgaatttttaaggaagagagctgataatctgtatatttaacacgcagcttctgtgtgagtcttttcaggcaattttggggcatactgccttacccagcagttccaggctaattatcagaccaattatcagaatcacctggcatgttttatgactcatagatttttggaccctaccttggacttcctgaatcagggtccagatgcaggaatttcttttgcaagaacttctcaggtggttcaaaatatggggaccactacagcaggatatgttggactgaatttgctcacacatggaattaagggcagacgtgataggtaatcagcttgttctcttaaaaaaaaaaaaaatccctgtctggtttgagtgacaaaggtgtatgcatttaccaaaactcattaaatggtacagttaggatttgtgcatttcactgtaagttttatcacaaaaatatgtgaacagatactgaattctagtcatgatatatatgctgaagggtttaagagtgaagtgtactaatgactgcagtgtactttgaaatgcgtcagaaagtaagacggatggctggatgagtagatgtgataaagcaaacaacagcattgtagaatctaggtggtgggtatatgggtgctcacctacagtcctttcaactcatctggatgttagtgttttttttttaatagagacaaggtcttactctgtcacccaggctggagtgcagtgttgtgatcttgacttactgcaggctcacctcctggattcaagtgatcctcccacctcagctttctaagtagctgggattacaggcacataccaccacacccagctaatttttgtattttttgtagagacggggttttgccatgttgcccaggcaggtctcaaactcctgggcttaagcaatccgctggccttggcctcccaaagtgctgggattataggtgtgtgagccacagcacttggcctgaacatttttaaataaaatgttggtagagaatgtttgaaatcatgcagatgttactttaaagtactccatgtaataatgatgctcaccagaatttgagaaccactgcacattggggcaagattagttcagaggtgtatcaacctgggagttgttcttcagcttttaaaagtttcataggcctggtgtggtggctcatgcctgttatctctgcatattgggaggcagagacaggcagatcgcttgagctcggtagcccggacaacatggtgaaactctgtctatgcaacaacaacaaaattagctgggcatggtggcgtgcacctgtagtctcagctacttggaaggcttaggtgggaggatcacttgagcccaggaggttgaggctgcagtgagccgtgagtgtgccagtgcactctaacctgagcgatacagcaagaccctgtctccaaaaaaaaaaaaaaaaatgctttacagaaaaattataagaaatgaaaatgttgtttttgatttttgtcctggaaatctgtctcttgactacataccttgttgcactaccttacatgtgaaaacctttggaaacagaaacacactgagcctgtgttcaatgtaaaggcaaaggctttccacatactggccaaacttcagtttccttatcatacaaaatggggacaataagatttgctccagagtctttaacacttgttatctcattatttaacttttgataagctataatatttttatttctcttaattgcacataatacatgataattactgaaagactctaaaatacaatcgaagtgaaagaaaaatcccagtctcattttccggccatatttagagttaacattttatgttttcttcaaggcatcttccctcataaaatacacatataagtactttgtccttttatttatatatagaaatgggatatcattatgtggcttgcttttttcacttaatatttttgaatgtttagccagtttaacacatttatgtacttttgaatggttgtctatttaccatataggtgctctgtaaaatttgcttatctgatcccccattgttggatattaggttgtttcctaaatttttcttctatgaacagcactgagatgagtccccacatacatacatttgcaaatgtatctgatgattttcttaggataaaatataagaagggatacgaacttttcttccaaactgggtaggccactgaccttcagtgaggcaagttctcctgtctccctttgcaggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaaggtgcgtaggccctggaacattgcttgaaatgttccttaaactagaaaatgatgtctggacagtgtaccagcaactcccgaactctcaactgaggatgatactcttccctagaataaggtaattcttctgagaagatgcagttgttactttgaagtttccatcgtcttgaacagcatagcagttactcaaggatgatgtggttgtggaagctgtccacagctgtctagttggagaatttgtaacattctgcatctctgtttgatgtactgtagtgagattatggcataaataaaatttacatattcacatcacaaactctgtacaagcacacattcttatattagagcagttatctctgagaaaactggattgacatttggactggatgttacaatgtttatgccccatgttggggaaaagttggttgggcattactctgccgcttccaaaacatgttaattttacatctggtcagagtcctaagtttcttgttagtccagatattaagctggaagatcaggagtggagaataccatgaaggctgtggttgtgtcttcatggctgtaagccagagaacaagtctgatatgactgcagcagctggggcaggtttccaaactgcctacctgtaggagagggcagggaccagtgacttgcagaaggcaggcacctctctagaggtgagttcacagagtcatggaggcatacaagatgattatgcttaccaccgtttattactcttttctctctgaagacacctgcttctttcaggatttaggctatttttttaaatggcaataaacatttcaaagagcataatagtgagttataatacaagtggataataccactcatatgatgatatcagattttaaaatgagccaaattatgctatatgcagtttattaacatatgcagtaatagtataaaagcatgatgagaatggtaaacaccgaattcagaagagtggttagcactgggatggggatatacaggcagcaccaaacgtgtaggtaattttttctaaaagatgaagcaaatatgacagaatgctcattagactttactgggtggtggatgtgatgattattaccataacgttctgatatttaaaatatttcacaattataaatcacattgtacccccctaaattgaaagaaaacaacagctttctctgcctgggctcctgtcagaagattgacggttgaggtgcagggtaggaggagaagagagtgtattgctctgacccctcctctgtccgtgtctctgtctcagatgtctccacactccctgacctgcgttacatcttcccactgggaccggccttattccagagaggtggcagcattcccactcgtaagttctctgaatctgaatgtgccagctgggaaggcatgggccagctcctatcctgacgggtgtacgctcttagcctcatgattacagaaaccatatgtggggcaccttgtgaaataagggtcttgaagaggaatgaggagcaaagaaattggctttcagaggcgaggtcacacagtatcaaccacagatctgggaacccatagggaacagagtgggggaaaactgaatacgagtcctgcccagtggaccaatgtgtttccctccactgtgggacagggagatggcgcccagtgcaaccttcctttcctttctgattcttatatggaggagaaggttctgtgtagtctgtttgagtgaggtagggagaaggctaaaaatgtgccaaattatgctatgtgctgtttatggatctatgcagtaatagtataaaaacataatgagaatggtaaatcctgtattcattggagaggagaggaaacaaaatgatgctttttttttctttctttttttttttttttttttgagacggagtctcgctctgttgcccaggctggagtgcagtggcatgatcctgggttcacgccattctcctacctcagcctcccgctgggactacaggcgcctgccaccatgcccgggtaattttttgtatttttagtagagacggggtttcactgtgttagccaggaaggtcttgatctcctgaactcgtgatccgcccaccccggcctcccaaagtgctgggattacaggcgtgagccatcacgcccagctgatgctttttttttaatcgttcaaatttttattttaatacacagtatgagaaattaacttttttttttttttgagatagagttttactcttgttgtccaggctggagtgcaatggcaccatctcggctcaccacaacctctgcctcccaggttaaagcgattctcctaccttagcctcccaagtaactgggattacaggcatgtgccaccatgcctggctaattttgcatttttagtagagatggggtttctccatgtcgatcaggctggtctcgaacctctgacctcagctgatctgcctgccttggcctcccaaagttctgggattaaaggcacgagccactgcgcccagccgagaaattaacttttaaatcaactgaattgtatggaaaatgacatagcaaataaattagacctatgttaaaagagaaggtcagctaaatatccaaacttaaggatataatgggcagataaacatagattccaaagtcttctttaagcagttgaagtctttcaaacacaactttgctataaactggtccagatatcaacagcacatagggatgcttaacaggggtggtgatcagggacacgcctcctgggaaatgcctcttttttttaaatggtaatgtagggttggattttaggttctcagaatatttgctgggctgatggtgtcttaggttgtgggactagcattgccacctcctttgccctaagagaaacctcccagaacatctcacagcatttccatcttttgtcctttgcagcccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttctcctctttttctgtgtgaggtttttttttttttaatctgcatttattagtattctaataaaagcatcttgatcggaagaatgcctttctcttggtgtactttatagttttaccaccgttacaacctagattcagtgggagctgaagggcaatgagaacacccaacccaatagccattgttacatcatcagttttgccttcgactggctgaagaaacagttgtcttggtcaacagtgaaaaccactttgaccctttttgttggaactgagttagagtgcatgtaactgtactccagctatggaaggtcaatcaaatagcaatttatcttttctcatttaagtccagaggtaataagccaagcactggtgctccttcagttttcccgctctgccctcctttgcataaaattttcatccgcatggtctcaagaaggctgttgcatttccaggcgtctgacatacccattctagttaggattaaaagggaagagcaaaggccaggcgcggtggctcatgcctgtaatcccagcactttgggaggctgaggcgggaggatcacctgaggtcaggagttggagaccagcctggccaacatggtgaaaccccatctctactaaaaatacaaaaaattagccgggcatggtggtgcatacctgtagtcccagctacttgggaggctgaggtgggagaattgcttgaacctgggaggcagaggttgcagtgagctgagattgcaccactgcactccagcctgggcaacagagtgagaccttgtctcaaaaaaaaaaaaaaaagaagagcaaaaggcagcttccacccaaatctgcttcttttgaaatgttttcgaatatgttccactcagtaactgctgcagctggccaaaattggttcaaatctcactcccagctacaagaaagtgtggggaagtctgttacctgggcatgtgactgccccaaacaaaatcaggagtatgttaatttttaaaaaggtggggagaatgggttttaggttggcaactagcatgcctgccacaaatgactttgccttagaagtagcaaatgctctaatcatgactacttggtttcttgcatggctgcttcctccaacattacttagtatccctaggctttaatgctagtgatctgggtgctctattgaattatctgcaagtattccacttatttttatatttaaaaagtttatacaacaatttactttagcctaacaaagcagtacagaagtgatgggattcacggttccttttttacacaataattaaatgatatctattaaatagtgcatctcaggtatcaggcaattttttttttttttttttttttttttgagacagagtctcattcttgtcacccaggctggagtgcattggtgcaatctcggctcactgcaacctctacctcccaggttcaagtgattctcctgcctcagtctcctgagtagctgggattacaggtgcccaccacgaggcccagctaatttgtgtacttttagtagatacggggttttgccatgttggccaggctggtctcgaactcctaacctcaggcctccaactcctgacctcagcctctcaaagtgctgggattacaggcgtgagtcaccatgcccagcttggtattcttttaagtgtttgaaatactacctcatttgaccctcacaatgttccactcttacacatgtggggaagggtatgaagagatgcctaaagtcccactaccagccagtaagagggaggggcagaatttggacccagccttactggctccagtacctatcagccaaaacaggataccctgctgccatggcaactgcagacctggggactctgcccttcctgagttggaaaccctgcttagtgcaagctagccatcaggccctgggacggccccttcctaggaaggacaagtgtatgacagtaaataatggaagcaaacagcaattcttttctacttactttacacagtgtttgtagttgagtgccaaggttgtttccatggctattatccattacttgcccccagaacatagcagagccaaacataggcgattaagagtcaagtgaat

SEQ ID NO: 15685 - DNA, 26103 bp, Human
ctgtgttgagatctgtggtgctggtcacagagcctggctgcagtgagggctcaattgctccatgctggaactggaccagtcctcagagaccatctgatctgctcattctgttgttcaaatggggaaacagaggcccagtgaggcctagcggcttgtttaaggtcacgctatggaagaagtgacttgaactcacttctgattctgaggtgaaggctcttcccattagtgccagggccacacaagtgtttcttgttttgagtgcagatgggtggcttggaagtcagcaggaggcacaggtgtggtgacttgatgggctcagggcccaaagggagggagggcctgggagtggaagatggaacctcattcaagcccgtctctcctttcttctcaccagaaactccccctttctttggacaactggacccccacacctccaccctgtccccatcccttttgctgataatcccatctccttgccctgtaaatgctagggggcccttgatttggggaggaagggaaggctgaagccggtcccggcaccctgagagccccagggccctccaatgccccactccttctccaggtctgccctggcttgctctgtctccctagggcagctggcttttgtcccaggggagcatgggaacagcttgggtgagaatgggggaggggcttcccagcaggtttcacctctcccacctggcataatttctaccctgcacccagtgatgcccaggagccagcacaagaacctctgagctctcctgccggctttccccactgtggggcccacaggatggctgggtgtgctggggaaactgagggagatgacttgtgggtgccagcaccatgggactttgggtgatcttggacctattccttcctccttctaggtgcttcctgagctggcgaaaaggagagctggatgctgggattctataaattcggcggtggatgtgagtctagctacagcatggaccctggccagccctggaatctgagttcagagatctttgaaaaaatgccttccgataactgagcacctactacatgctggacactgcaccaggagatttgtgtgcattccctcattgaatcttacaaccaccctctgggatggtttttgctattaagccgattttatagatgagaatactgagggctagaaaagataagtaccttgtccaaggtgacacggccagtaagctgtggagtctggatttgaactaggctctcttggagtttggagcccggtcttttcatttctggcagagacctgtggcttcagggggcggagcccagcccatgggggaagtaagtccttcctgttagatctgtctgaggagtagtgagtttctcatctaggaaaccatcagcaggccaggctggactgccccatttctagccccctttcttctctgcagactgccctgtttctagccccttttcttctctacccttttctgtagagtgcgttagacccattttacagaaggggactctgagaccctttcttctctgcggggcagggtatgtggttcagacgagccgcttccatccccagttctgtccctaagccctgggtgacctcagcattgagcatcgtctctgagcctcagtttcctgtctatatctagtgccaccaggcatcagaaacgtaagtgcttcaaggatcttgggtgaaaagccgctttagcggcgagcatacactaattaataaaatgccttggccggggctgggcagaggaagtaagcgggcagccgaggtgacagctggagggaggagcgggggtggagccgggggaagggtggggaggggatgggctggagctccgggcagtgtgcgaggcgcacgcacaggagcctgcactctgcgtcccgcaccccagcagccgcgccatgagccgtgagtgcgaccccggtgcccggtggggaattttcttggcctcctggtggagccttgaatgccaggctcagcccctcatctctctcctctgcagggagtctcttgctccggttcttgctgttcctgctcctgctcccgccgctccccgtcctgctcgcggacccaggggcgcccacgccaggtaggcggccccatccctccccaagggaatccccggtcttgcgcccctggcctggtttcaaccccctcctttcccctccagcgggcccagcttcccctttctgctcgcggtgctgagaaagactgaggctgagtcttttggtgggatgggggctccctgaagcccccccggcggtgtggccttggctaatgggctatctagttctttcaggggaaacagcagactgggatctggtgccaacttggggagaagggacagtccctatccatccccctcacctgttctgggccccagatgtctaagcagcctctgcacccaacaaccccgctgtttcctataggggcctctttgggaggaagccgcaggcaccaagggaaatgagttccctttctccagcctctaaccgtctgggaacccatcctgattcccattgccagtggagaaggtctcccctggtgaagacttcgggagaacatgggagatggaaatacatttaggagccgggatgcttcatctggggtttaagagatccccattgagcaaatgaggaaaccgaggctcagtaggtgccatgattccccaagctcacaaaatacatggtgggcccaggatctgaactcaggtctgtctgcgtccacacacttcgcaaggtctttccacagaaagctgcttctacccacaatggacccggagccactctgggtttcatgggggaggttgatggggaaattccgcccttccctcccccatgcatgtgccaggttccaggtgaaggaattcagctcctcgctcagccaaccttcctcccccagctcgctgcttgtgtgtgtgcgtgtgtgtgagcatgtgtcccagttggatatagtttcctccaccacctagctgtgtaaaatctctaaaatgaggcccagagagggcaggagggagcagagggagtccgcactttctgctgtgatgctctaaggatctggtgcgtgggggaaagaggaaagatatgtacatggattttggatcagaccaagtttcctgaaacgggctttgggtgggtggcatttaggggacccaaagagaggacggagggtgctctaggaaagggattgcgttgaataaaagtctggtttatgggaagaggaggaggaagactcatgtggccagcactttaaagtttacaaaggttggttgtggacatccacctctttggtgctctcaacagccctgccagagagatgcgttagacccagtctacagaaggggactctgaggcccagagggagtgaagccacttgtctgaatcctcacagtgagctggtggtggggagtagaaggggctcttcaggttgcctcgctgacccatcttgtcagtccctggatcagcccagcacttcctctgaggccccatctggcctcatccaggcactcttggtatacaggtcccacccgtctgtattcttttttagtccattcactaatgcacaatgagccatggtctgtgctattttgttttttgccttttctgtttccttttgtataataaatgtttacacggaattgtttttttttatccccaagggttatttatgccagtctttggctggggcctggagacacggagctgggaggagctgacaggctgatggtggagccagaaatgccaacagactgtcatccaaggggaccagggctgtgcggagctcatgggagggagcaggggtatagggagcccagggaagggagcaggggtgtgcggagctcaggggagggagcagctgcctctcagtgcgaagaattgagggaggcttcttggatctgatgacttttggactggacctcgaaggaggtggcgggtgggggaaacactaagagactcgaccaggaaacaccgtaagggtaatgtggagcaggaggctgaggttggatgcgtaatgtggggatgagactggaggccagaaaactggtaccgaggctcctgcaaggatctaggaaagaacgaatgactggtggagtgcaggggcagaaggtctgggttgccctcatatttccaagtctgcgagtaaactgagggccaagctacttgggcatctgccccaggaagccaaagcctgtcttttgcctctagaggcaaaggagatgaagagatgagggctgcactcacctaagagggcaggcggagggagagaatgctgcttttgcctctctggtgggtgaggagatggaggccagcctggaggcaaggctgtgccgggggcgccctgaatgctcaagtacttcccctctagtctctggacttgactcagtgcccatcttctagatggggatagggcatgacctggcaaccagagctgcatgccaggcagaggagccccaggccagctgacccgggcacatggggcaagatgccagctgtgccaaggctgcccgggtgcctgcacctgctctcgccagcaccagttgggtctgtgggccgggagagggcttccccaccagcaggctcttccagctgctgggcccagttgtctggatctggtgcggtggtgcttaggtgtggggactggggcccaggccaaaccagtcagggttccccaccttttttttttttctctctggctgccaggtccccagagactctctaaatattactctttaggggatttgggtcctgcctcttcactgggcaatcttgcagcctgacacctctgcatcctggaggacttggtgttccctggctgtgcctgtcccctagtcacgctcagtcctggacctggagccctgacttttgggctagggggtgttccttgcccaaacccttggaaaggtcctggaaccaggcagttctggacagtcctcatctgtggggatggggactagcagcttggcctttgggctgcgtgtgtctggtatgcagcgtggtgtgctgatcatctctgcctccgcgtgtcttggggactcagtgagagcaaatgggaaggttctctgctgatggggcagttgtgggagggttgtattgatacaaataatggagagggacagattggctctacccagagtagagggcctggacgtcgaaaggaaggcctcctttagcccgcctgctaaacccccttcatgggatatacagaaaaatgaggctccagaggtgggagggactcacccaagaatgcacagccagtaagagcagccactctctaatacagctctcccaagcaactacttggtgcctggccctgtgctgagtatgggggactcaaagtgaattagacttggtacctgcatctccttggttttctttcttgatgaacaggggtgtcctccactgagcatagaactgagttggcgtgaaaacatgcaggattgaagttagaccgaaggaaggccttcctgtacgaatacttcctaaagatctggttgtggcaggagatggtgatccccctggggtcctggtttcattcgttctggattttcaaggttcactttgaaggaatgtgacaaatccaactcaactgggtcatcctcagtctgcatcaaagcgactctccctttccatcccttccccaaatccagtcctgggtacctccaggagtaggaggaggagggagattaagtcttggctccgcaacttcaaagcagtggggtctgggcaagcctcctgctttctctgggccctacattcctcattatgcaatggggagtctcacctacctctcttagggagtgctggggagataaatgagcgtgggtgtggaaggttgtggacttggtcggctggagccctggctttctggctgggctgtgatggtcaggctgtagtctagtggcacccagtctcctctccgcccaccctgacaccttggggcaccagcggcaggcccactgttgtccttcctgggagaacttttcctgccccagagcagtggtgtttatggaaagaacgtggcgggggaggcgggaggggggaagctggatgggccggactgggagggaggagcctcagctcccgcacagcctctcttggcagggagggtgtgggcagccgttccagcttcagcgtctggagcttgtggctcttctgcctgccgaggcagagctctagggccatggcgggaggccttccggctccacctcagacagctgttgagggcctggaagatgagggactccttttggtcaggctggaggtgaccaatctcctcacttcattttatttattccacaaacattcgttaagctctggctaccacatctggatcccagacctggttaagccccaactgtgtgcatagcctgtgctgggggaagagaaagccttaagggaagcgggggtcccttctcctggaagcttatggtggagaagagcaggttgaattggaacccggagccagggcaagggagagtgggaggagggagtgtggacatttggggaagacttcttggggaggcaaggcgtgggctcagctgatttggaggaaatgtattaaggaggctaacagcctggatgaaggatggagatgctgagggtttggggctaagggaggggctggcgcagaatgttggagctgcacggacctctggagttcattttgagatccctgctgtggcagggatggggaaattgagcctaggggaggcctaacccctgtgcccttagagtggtagaactagaccgtgagtcctagcggaccttgtgtgccagggttgggagctgggcagtgggtgctacaggggctcctgggcaggtgagagagccaggccagcaggaggggcaagaagaagagttctagcagggtgacaagtcctttcttgggggaaccagacctctgagccagcacgggggctgctccagaggcttcttggcctttctgggcctgtggctgggggaggcgggggctggggtactgccaggccctttccctggatcctgcctgccaggtttgcctgtggctgcctgataaagcctttttgtccagccttcttcccctgacccctccctcctacacccctgctggggccattgtggggctgtggggagttgccagggcttaagcaaaactatttgcatgattcttgtggtccttgcttgtgtgtgtgtgtgtgtgtgtgtgtgtgtgtgtgtgtgtgtgtgtatttgaggtggtgttgccgtcttcgaagtggggaccaagaggactctgctgcccaggtcaagccctgtgctgtgaagtgaggagtgaggagactgagaccagggcaggggatagggggcaggtcttgcccagggtcatgctctctgatcctagcaccctgagatgacagcatttcaccctcagctgctctggcctttcactacccttttgacctgcaataaccagttgcacaaagaatccatattccctgtaacgttggctctgagcccagataaggaagtatgtttgcagaaaggagcccggcgttttctgtgtaaggtcagagatggagcctcctgccaggcgctaggagtttttggtctgcccagctctgttctgtttccttggccaagttatcacctgtccctgaacctcagtttccttcactgaacagggtggtgggggtgatggtggatcctactgaacctgaggagtctgtaactttgctgctaaagaatcactgaggcagatttagcaagggggtggtggtctgagggatctgggttagatgccaagagggatttccttatagagtttctccaggaggcagcagggcggatgccagagctccatgcaccctcccaggagattttctagccctatctctcctattcccttggtctgtgaccttcttctggatcctagagcccagaccccaccctgatgtgggccaagtctgattccatcaggaatgggggctgaggcagctgagaccttggagtccccctcctcctgcacacccaccctctgtccccagggttctggaaaacttctttccttagacttggctgctgaggctgtgggggtggagtggaagtgaagggatgggcatttggtctggtgagacttgtggggtgataggtctggctttccctttttctggcttcaatttccccatctgcaatgtggacattatgatacctgctcttctctaccttctgcagaaatggaggaatggtgagggatctcgttttcctagtgttcatggggtggtggtctgggagaagtccccgtcctcgtcctcgtcccttttctgaccgcccccccaccccccgccccggcctgctcttgctactgaactctgactaggcaggaagtgaacgctctagaagcccgtggctgaggagttttatcagctctttcttaactttcagtgtcacagccggggaatcttctcctgccgccgtttggtggcaatagggagggagggggcgcttcccctgggggcctgatgtgggctaggctggagttccagagcagggcctggaaatgtcaggatgggtggtttatgttcacagaggtgggaacaggggtccccttgggggaaccctgaagccctggcacccagtgattcaggacggagctgcgacttaagtccatgcctctggcccctcattcccccatcaggggctagatgggggtcaggaggccaccctagcatggtctctgacctccatttctcacccacagtgaatccctgttgttactatccatgccagcaccagggcatctgtgtccgcttcggccttgaccgctaccagtgtgactgcacccgcacgggctattccggccccaactgcaccatccgtgagctgggccttcagccctcactccttccgtcttgagcccttctgctccccgggccctttctcctagaccctaacttcctaccctcctctctgaccatggccctgttctccttccttgcctggttctgcccctctccctgacctggcttcagcatgagctctcgctcttggtccaccctcactccctgcttctgagttccatggtgagtcttcaccacatgccctggcccctgtcctcacgcccggttctgtctctgtcatgtgtcattgctcccaaggttccatccttacccacttccccataggtgctactctgttccaccctggcccttgtcctcagtgccccatcttccaccctggctacttctggttctggtaggagggaccaactgagtgactgccattgcccctgcagctggcctgtggacctggctccggaattcactgcggcccagcccctctttcacccacttcctgctcactcacgggcgctggttctgggagtttgtcaatgccaccttcatccgagagatgctcatgcgcctggtactcacaggtgggtgtggggcagggccccctgacctgggggagcaagcaagcctgctagtccttttggattcttggcatctgataagggtagtgggtggggagagtctatgatgcctgataaaataagccccaacccaggaggaggcaagaactgggatggagctgggggtggaaacacccttgtcaccgttatttttgctctctgcagtgcgctccaaccttatccccagtccccccacctacaactcagcacatgactacatcagctgggagtctttctccaacgtgagctattacactcgtattctgccctctgtgcctaaagattgccccacacccatgggaaccaaaggtaaaatggggtgaggagctgggcctggggattacaggaggtgctcagttcttctctttgggaaaaatcaggcgaagaacaattattgacccaattctgcagatggctagaccaaggcaagacatatgacatgtccagagcctgggctgagaacaggcaagggcagcagagggtcttgcctgaggtcacctagagtcagaccaatgtttccatagttccagggtgcctctttgcttgatccttttctaatgatcagttgggtcctgccggggtggaagtgacttagaagttgagatgtaggaaagaatagtgagctatttattgggtgctgtctctgtgtttgggtctttacagatgtaaatagttttacatgcttcaccagtgtaaggtacaaataagccacatttttttctttcgttactcaagacttcacttagccacactggcaggggtcttccttgtaagaccttcccatgccacctgtaattatccaaaaacctgggatattattcatttcagacccatcagttcagcatcaagtacagagaggacaagagaggctcatcagtccactgctgctatactccagttcctgccacatggtggcactgttgaatgccagtcctgtgcagcctcatggttatgtgcttttttgggttcaaaaccttgcaccatgtccctgcttgggtctcaagagcactactgtgacggttttccatcatatggttagctgcttttcccaaagcatgactattctaccaggatagctgagtcttgccaactttgctgaaatcatgcttgcccagtgtcagtgagtgatgattccaaattacggttgacagatcactccctctaacttcccttttggtggattttctttaggggtacttgatattttttcctgccagaggaacccagtcagccatcttaatccaagtaatttccattgatcttgaaccttcaacatcagggctcacatcttgatgcattgtgaagagatgcctttaccagaactcaaaaaattctattcctttctgtgagggcaattgggtgacaactcatttgacactgacataattaaggaaggcctctcaatacttattctaaggatgacttgtctttatgccagacatagaaagattggcatcatttaaaataggttgacacacctattttaaggggagcaagcaagcctgctagtccttttggactcttggcatctgataagggtagtgggtggggagagtctatgatgcctgataggtggtggtgtggtggcacacgtctgtaatcccagcactttgggaggttggggtgggtggattgcttgagctcaggagttcaagtccaacctggatgacatggtgagacaccttgtctacaaaagaatacaaaagttagctgggtgaagttgtgtgtgcctgtagtcccagctactcaggaggctaaggtgggtggatcaattgagcccaggaggtcgaggctgtagtgagccataattgcggcactgcactctggcctgggcaatagagtgagaccctgtctcaaaaataaataaataaataaataaataaataaataaataaataaataggttggcaaactacagcctgcaggccaaattcggcccacctctccatttttgtaaataaagttttattggaacacagccacacacatttgtttatgtgtcatctgtgactgctttcccgctacaatagcaaaaactgaatagatgtgacatgtctgtatggtctgcaaagcctaaaatgtttactatctggctttttccagaaaaagcttgctgacctatgatttaaaaaattctacccactggttctctgccatgcttacattatctctcgcagtcctcagattcactgtatcaaatgggtatcatttgcccctttttaaagatggagaaattgacacccagagagatgagatgatttatctgtattcacacagctagcaaatagcatagtcagttgcaaacacaggctaccttgactcagggcaagggagttcatgtttgtttttttctgtttctttatttctttttggtgaaatgtttcattatggaaaaattgcaaagatacacaaaagttgagagaaaagcagaatgaactatgtacccatctttcagtttcaacatttacccacagtttcttcatcttatttcatttctcccctctcatatttttataaagtattttaaatcaaattctaaaaatcatgccacttaaaattctaaaaatcatgccacttcacccataaatacttctagggtcttttggtagagagtgggttacttggtggtggtggggaggtggtcctgaggaggccactctgggcttcctgcttgggccagtttgcctggtgagcccagatgtccccagggcagcaagatccagataggagaagctactgctgtttcctaccccccaaccagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtgagtacctaggaggggctcaggactgctctggacctaatttggcacgcgtatgtcatcgacagtgggccggcaccctggtgacctgagggaacccctctctgtccacaggtagacctcggccacatttatggagacaatctggagcgtcagtatcaactgcggctctttaaggatgggaaactcaagtaccaggtagtgctgggccagggggtagggcagagggaggggtctcccatggtcttccctggcaaagactgcttggggcgggggtctgggtcatgtcctgagagggccaaccacgggagtgggaggcttgtgccaggagcgacagtatacgctgggaggaggcagcaggtatgagaagccagggaggagcagacgtggcctcccatgtcagccagggaggtggattttggagctcaacaggagatgaacatttgtagtctgcatttatttatttaattattccacaatattaattggacacgagaatatacctggcacaggtgattgagtagtgaccattatagttaatgggccctgccctcaaaaaaccacaggcaaactctaggatgttcattctatgagggcttttgtttaaatcagaacggtccaacagaaatataatgtgaaccacatacatagttaaaattttctaatgtccatattaaaagagggaaaaagaaacaggtgaaatgattttaataatacattttacttaatgcaatatgtccaggtaattagcattttagcatgtaatcaatacattattaataaaatatgtcacattcttttttcatgctgaagcttcaaaatctggtgtatatttcacactcacagggcatctcaatttggatgctctattttcactggagtgatctaatctgtattaagatttcataaaatgtacagctgaataagtagagtgacatgtccgacttgttccacgcatacttaaaggttttccaatagctgaagtatcagttttaaaattcaaatagaaattaagataaacctaaataaaataaattaagtaacattcagttcttcattcacactagccaaatttctagtgctcagtagctacacgtggctagtggctaccatattggatcgtacaaatcttaggcaagcaccaaaacaaagtttgatgctgaatctttagggctaagaacagtacttggcatgtagtagtctcttggcatgtatttactgaatgaatgaagaagctgccatataattaggtacacttgtagctgccaccaaggagaagctgtgagtgccactagagtgtttggatgatgggtaaaacttccctaggaagttacaaataaacccagagttgcataaaggatgaggaggagttagggatgctaagaatgggagagggctttccaggtagagggtttagcaagtacaaaagcttagaggtggagaacagcttggtgacttggagggagtgtaaaaatgggagcgtttgctgagcctagtgatggagcgtaagaatgactttacaggaaggtggagatgtctgtggggaccgtgttaaggaattctactttctgccaagagcagagagagtatttggaaaggttttaagtcagctcatgatgcaagatttgttgtttttttttttttaagttttttttttcttttttttttttttcttttttgcttgggtgcagtgcagagactggcctgtctggggataggagtggaaatagggagcccacttagggaaaggagtcagagtggaagatgagcgggggttgcttgaggtagtggtggtagagatggagagcaggggactgattttaagagacattttggaggtggaatcaacagccttggctgaggggaactggcagctggaggcaggagtgggagggagttggttgtgggcagctgtgggtgacccccaaccccaggttgccaggtggccccatcccacaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggtgaggactccagacctgccctgccctggaaggtcattccctccatcctgagaagttgggggcgggggggtacttagaggtggaggctgggattagaatcctcacccttctgcttagtggctagaagaccttgagcaggcccctcaacctctgtgagcctcggtctccaaatctgtacgttggggtgaacgatgattgtaaggatttattgagatcatgaatgggaaggcaactagcacatagcaggccttcagaaaatagatgactgtgatggttgattattagctgggtgactcagcacatttgattagccaccctgagtctcggtttcccctgtgtgctgcgcccggatgcatacttgtggtccccagcacgtgcagggtcaaactgtaacttgcccggccttcaggaatcttcatgttcccttccctgcatgtatctaccttcctgcagtttggtagcttctaggtgactcagggacaggatatttttgtgttccctatgggggcgagtctgcaacctaaaatgtcagatggtttcctgcctgggagcttggcccctgacatccctgtccagaccatgttcgctctgagtcaccagtaactcccttcccccacctctggcaccactgggcatggctggtcccaattatagagcctaattcactggagccatgaagagccaggcattgggaataggaacagtcattagagggaagaggggctggttctgaagtttcagcgttgcaaagaccttgacctgagagagctggaggctgtccagcacactggctggagatgaagctgtgaccaaaggcaggaccctagggcaccatttaactcccctacaacctcatgagccgggtatgattaccctgtgaaaatcaagattcagagaggtgaagtgaactctccagggacactcagcagatggagacttgaggtctggttgccaccaaaatctatgctacttccactccatcacaaagggggctcttcttgaatgggaaggggttgcaaacctgagtctgatctgtgacatgtgagtattggaaagggattccccctcgcgtctacacttagtattcctacttttggctgacatatatggacaccccgtcttatgccaggcactgtgccagcagttttgctgtattcattgtctacttctctcaacaaccctaatatagtattgcattgatgttattattattattatttgagatggagtcttgttctgttgcccacacagtagtgcaatggcgtgatcttggctcactgcaacctctgcctcccgggttcgagcaattctcgtgtctcagcctcccgagtagctgggattacaggtgcccgccaccatgcctggctaatttttgtatttttagtagagacagggttttgccatgttggccaggatgatcttgaactgctgacctcaggtgatccacccgccttggcatcccaaagttctgggtttataggcatgagccacagcgcctggccgcactgatattattataacacacattttacagttaaggaaagtgagattctgagagattaagtaactcagcccaagctcaggtggctggaaatggtaaagccaagatttgaatccaggtctgctgatcccacagtctgtagctccaggtcgatttccaaaagccaatttgtctaatggctaattggcctgcatatcagtttctttcaatatctagttgcccagttttaattttgttacagaatgttcaatttgcattttccctggctttttgctttctagctggttatagctacaaatggggcagaggaaaaacttatttataagaatcctgttatataagaacatataggaaatatgttttttgaaatatatttagggctaggctccccttctgtcctcagtattctcttttgccactgcagcagctctgagtggtctccttgaagtccccctctatcaccgagggtgtcagcatgatgacagctctcaccagtaaatcctccacttttccatcttttgtagtctctccaccttcttttaatgggcttcaggagggaggtcataagaccaattcttggacacctcctttgcatgtcctgcttagctgggcctagaacctccctctgaaatgtgggagtagctggtgctcttgtcttgagacctcagtcaaaatagaccaaaagttctattttcacatcctgttacaaagagacaaaatggaagaggccaaacaaaattaaacatcaacagcaaggccaggtgtggtggctcacacttgcaattccagggcttttgggaggctgaggtgagagaagtgcttgagacttgcagttcaagaccagcctggataacatagtgagaccccatctcttaaaaaaaaaaaaaaagaaagaaagaaagctgggtgtggtggtacacctgtggtcccagctacttgggaggctgaggtgggaggattgcttgagcccgggaaagttcaggctgaagtgagctgtaattataccattgcgctccagcttgggtgacagaccaagaccttgtctgtaaaaataaaaataaacatcaacagcaacaacaacaataaagagaccaaaagcaagcacctctcatgaactggcctgctttccaagctgggcatctaaatcactgtgcttggctgaccctatttccaatcctgccctgcccaggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccgggtaagccccagaggagtgctggtgagggcaggtgggctgagggatccagcagacctgggtccaaattccaggttcttcttctgtaaaatggggctgatgtcacttctacagggcagttgtaagcattcctgtgtgagttcattggttcatttgtccattccacaataccagacattactccaggtactggagatgtagtgggaacaagacttttgtggttcttggctcatcttttagtgctcccaccctagaaagtgatggcagtcatacgacagctgacagcattagggcccttactgcgtgtcaggcactgttctaagagcttctcctatgttatcagaattctaagagtatgttataaaccatagtagaaaagcccaccatgctctgggagtcaggaagggacatctgacccagagttgcgggttatgggaaaagaagggatgtccaagcagaaattggaaggagggatagagatttcccagggtaagaggtggtgttagtggcaggggatggctgtgttccagatagagaggacggcatgggtgaaaggcatggaagtcagaggacatggcagtttgaggaacagaaggacattcagggcatggtaatgtatgtaacagtgcccgcctatggtgtttattaaatcataagcctccgctctgggctgaattgtggctcttttaaagttcgtatgttgaaatcctaaccgccagaaccttagtatgtgactgcatttggagacaaggtctttaaagaggtaattaagtttaattgaggtcattaggctgggccctaatccagtgtgacttataagaagaagagattaggtcacacacacagagggaaggccacatgaagatgtagggagaagaaagccatctacaagccaaggaaagaggcctcaggagataccaaccctgctgacaccttgatcttgaacctctggtctccagacagaggaaataatttctattgtttgagccactcattctgtggtacattgtcatggcagccctagcaaacaaacacattctctttccctggaattcccagccaacgccttcctcaatctccccttctccacattcggaagctcccatctgcttcatcgcagtctctggctcccctgttgcctcacagtcctctgcttctctctaatccttgtccctaaaccctgtcatgaagctgtggcacacatggatttccatttccttctggtaatttgactgaaattagcatttgctgccccggtgggcagctgctggctgctttatggcctctttgtcggtttctttatggttctttgtggggacacaagacatgaacagagacaatagcctttgtgtgaggctggatggttttcagaacgttttcaaggaatgaccatgatgatgtacgtgaaaagccccggcgtcgtacctggcacaaggcagaaaggccgcagagatgtatggactgtcaagattttttttcttttttctttttttttaaatagagatggggttttgccatattgcccaggctggtcttgaactcctgggctcaagcgatctgcccgcctaggcctctcaaggtgctgggattataggcgactctcaggatattaagaagagtgagtgatgataagacagggcttcccctgataaccattgtccatggctaccctctcaggggttcccatgtgaccaatactgagataacagctttgcatagtttatcccatttaaattgaccacagccatatcaggtagatgctcttcccttccccatttttacatatgcgggaactcaaacttagcttgaatagctgcccaaggtccctatattagtttcctcaggctgctgcaacaaagtaccacaaactgggaagctcagagcaacagatggaggctagaagtctgaattcaaggtgtcagcagtgccatgttctctctcaaggctctatgcctccttggcatctggtggtggccgacagtccctggcattcctcagcttgcagaggcatcgctctagtctctgcctttatcatcctgtggtgctctccctgaacttgtctttcctcattttataaagacaccagttattggattggagcccaccctaatccagtaggatctcatcttaacttgattacttttgcaaagacttcatttccaaataaggatgcattcacggatgcagagagttagggcttcaacacatatttaatattttagggaacacaattcaaccctcaacagccccacagcttgtaaagctgtaattggcaccatcctctgcttgctttgctcatattatttcatccaaccatgcctttcttttttgcccaattatagttgttgatcaaaatgactatctcttaagcatgaacgttattatttcatcctaagcaccagagctttcttttctttccttttttttttttttttttttgagatacaatcttgctctcttgcctgggctggagtgcagtggtgtgattttggctcactgtaacctctatctcctgggttcaagtgattcacctgcctcagtctcccaaatagctgggattactggcacctgccaccacgcccagctaatttttgtatttttagtagagacgagtctttgccatgttggccaggctggtcttgaactcctggcctcaagtgatccacccgcctcggcctcctaaggtgctgggattacaggcacaagccactgtgcctggtcagcaccagagctttctttagactaatgcgccttaactgttagtaatcagaatctttttctgcagcttttttatcttgccaggttacctgggctttgagttctattttccctcccttcacagggggttacactacctcttggtgtaattcaacggtctggggagcagtgtgagccacaaaagaggtcctcttggcccattccacacttcaaagatgaggaagctgccggatgtggtggttcatgcctgtaatcccggcagtttgggaggctgtggtgggaggatcatttgagaccaggagtttgagaccagcctgggcaatatagtgagacctcacctctacaaaaataaaataaaacaaaattagccaggcatggtggcacgtgtctgtagtcctagctacttgagaagctgaggtgggaggattgcttgagcctgaggaagttgaggctacactgagtcaagatcatgccactgcactccagccagggcaacagagtgagacagtgtctaaaaaaaaacccacaaaaaaaaaatgaggaagctgagactcagaggggcttcctgagagagcatgacagcagcaggcccggggcaggtctgcagcatcacaactgctaggctgcccaacactctccatcctagctcagaagggactcccactggaagctcttgtcccaggaacttacccaggctccaggacagcctggcctggctcccagaccactgctgtgcttctctctcggcagatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggtgagcagctgtttcctggatgcagtccctgcccttgagggactggcagcaaagtcagggagacatcaaggaaatagaacgggacaatacatgcggcaatgtgtaacaaccagacttataatgggcgtggaagtgctgtgccagggtggtaaataagcctgcttggggagagaaggtgacttttcagctgggtttggagaacaaatggcattttcagtgggagaagagagggaggagtgttttaggcagagcaatagaaagtacaaaggctgccgggcaaggtggctcgcgcctgtaatcctagcactttgggaggctcaggcgggtggatcacgaggtcaggaaatcgagaccatcctggctaacacgatgaaaccccgtctctactaaaaatacaaaaaattagccgggcatggaggcaggcgcctgtagtcccagctactcgggaggctgaggcaggagaatggtgtgaacctgggaggcagagcttgcagtgagctgagattgcgccactgcactccagcctgggcgacagagcgagacaccatctcaaaaaaaagaaagtacaaaggcatagaggtcagacagcaggtatctagggaaacagtcatagatgtggctggggcaaggagcttatgttgtgggaatgattagtgatgggaggttggggccaaaccgtgtagaatcttggttttcatactaaatattttgagttttatttggtctagtgctttctaagtacccacttacgggccagctgcataaaaatcatttagaaagctgattaagataccaaatctcagatgcctctcctacggattctgattcaaccagcctgggtggtgcccaagaatctgcgtattcatatgaataaagtatatatacatatatatgaatatatatatgaatagagtatatatacatatatatcaatatatacatatacatatcaatacatatatacatatacacacacatatatatgtgtgtgtatatatatactatatatatacatatatatatatacatatatatatatacatatatatatacatatatatatacatatatatatatatatacatatatatatatatatttcccccaatatcctcagatgttgggcagccaagtttccagcccttgtcacatacaatggggagccactgaagcaggtgtgacatggcccatgagagttcccagtggaggatggatttgaggaactgggcagggaagcagggaagctccatatttgtctccccttggccacatgaacatgtggatattgcagagtggagcagattctgtgcatgagctccttgtgatcctggaacagcatcttattctttactctcccatgacaaatggtccccgggggcagaaggaacactgccactgaatttctgtgtgagctcggacatgttacatctttgagctctagtagtaaaagggcttggcccaggctaaggtcttgaaatctgtctgtgaaggaagccagatggggagcattctcccttctgtgatgatcaggtaattagggcccagagttgctcaaggttataggctgtttggtggcagatctaggcccctgactttctctttagtagcattttccttccctagacccagtccctgaggaggggcaatttgtgcttttcctcttgacccttttccccagtgccaaccatgccaaattctagggcacatgctcagttgctcaagttagtctcctggagtccctattatccccagaaaaaggtggacctggaagggtcccgccccaggttgaccttaatggcatcatggatctgatgctagcatttccccttatctccttgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagag

SEQ ID NO: 15686 - DNA, 34314 bp, Human; identical to SEQ ID NO: 12031

SEQ ID NO: 15687 - DNA, 107458 bp, Human
  misc_feature (1)...(107458): n = A,T,C or G
ctttcctgtctttttacttccaacttttccgtatcaatttatttaaaatgtaattcttattagcagcatgtgattggtttttatttttttaatagtctaacaatcttattattttagttaagtatttattccacttacatttaatgaagttactgatttcctttaaatttgctatcttactatttgctttttttttttttcctggctcttgtatatttcattttctctccttacttgccttcttttttgcttgttttttattattccattttctttttctgttatcttggtagtttacgttctctgactattcttttagtgtttccctaaatattatgatactcatctctaactttttaaagtctagtataaattaacagttttactactgcctggacagtgccaggattttatattatttttagctatttttcagttctagaatttccatgtatattccttttttatagtttttagttcattttccgttgctattactaatcttttaatttattgatcatgttaagcatagttatgttaaagtctatgtgtgatatttccattatatgtacccacttctgagtttctttctattcttttgtttatcttggcttttggttaggtagtcttgcctcttgtatgtctggttggttttaattgagagacattataaatgaaaaattttagagatactttatggctctatgtctgcactactcagtatgagagacactagccacatgaaactatttacatttacattatttaaaactaaaataaataaattcttgttgtactacttacatttcatatgtttaacagccttgtgtggccaatggctgtcttatcagaaagggcagatatagaacttttacatcactacagaaagtttattggatagcacagtgctagaggatcttatctttcactggagagaatttacttttacttatggtactagcagcagtaggaatccatggtcaccttaatgcagtcgggtttgagatgattctgaattggatgtcagcccttatgagggctagtatactattatttaccttttagtcttagggtgtagccttttgagatcacaatctgaagcctggaggattaccggggctgcgttcttggcaggccctcatcaccagtgtttatcccttcaggctgtgagtctcaaaagctgtgtccagtgtctcagacttgtctttggaattaacagatgcctctaggaggaaagcaggcctaaatgtgggctcacctctctagccttcccatctcttcgttattttcagaccttgtaattcttcactgtcttgttgggtctctaatgtattcacacttaaaaaaaaatattttgaccccatgtatattttttaatagttcttaatgagaaggtttttaaaaacagtccatcatagctgaaagtagaattcctctgtgagtgatatttaataaatatttctaacagttctgcctaacaactaacatttttagtatactttcatcgatgtgctcctatttgattctaactacaattttgtgatccgtatactttgtattcttatttaaaagatgagaaaactgtaggttcaaagagattaaataaaggtatctgttatagggatagctgagattcaaacccaagttctcagaccccaaatcttgtgtctattgtttggcctagtggctagcagtaataattatgcaataaaatgtttaattcgtgatggttgcaagcatgaaaacaaatctttcttatcggcacctcagatcgttcaaaagtcccctttctcctttaaaatgaattccagaatgagtctccttctcacataattaaaatacctgagctccctaatatttaagataatttaaaagaaatcattctaagtattatataaatatttctttatttatgagtctatattttctatttcttttccagttttctattatatagctcagtctgaatcctgttaactatgttctttttcctccccaagataactgctaaaatatcaagcacggcagttactagacctatagctactggatatggggtaggtttttgtaagctgaaaatattaagatgctttttctcatacaatagttcactttaggcagttctgaataattttattatatcttaggtcataatccaaatatattttctattttggatacttacaaacattatacaagtctagtgtgattaataaatttgaatattgtcattttgatttgtaagtattggaaaatattttattaacctttttccatttgtaaaccctgtgttcgttgacttcctttcattttctacatgatacaaccaagtctcgtgtattccattcatatattttatgtgaagttagattttacataaatgtaatagtgtatataattgggaaacatttactaattaacaaatataaaatgtaagaaaagtgtttcagaagtgtgtatttgggtcttatattagaagcctttggaggaaagatatatcaaactctataaaagttataaactttttaatcttgttcaaattacctgtaatttggatgttttagcttatatgaaataacaggaatgagaaaaatggaagaattaggtggaatagcttttcttagtcaaaaaaatatcttcagaacctagaggtccagggcacttgcctttataatgttcctttatatgagtgaagaaagtagccttgtacataatataaacgtgtgtcatattaaacatgcttttattagttagcctgagtgtgtattactcataaatttgatttttggtggtgtttcagaaaaagagcaaactttttccatgaagggctagatattttaggctttgcagatcatatgttctctgttgctactatccaactctgcatttgtaaagcaaaagcagccacaggcaatgtgcaaaggaatggggcatggctatgttccagtaaaactttatttacaaagaccatgggttgtagtttgctgctccctgttttatagttttatggttttaccctatacgcccaggaggtacaaggaataaattatgtttgtttatttgccgatagaatgaagaaaacttctataacttggtttaaacatttaaggcagatatttttaggaatctttttaacttaacttttctgtttactagtccaagacatctctggcatcatcaataggaagaccaatgacaggggctattcaggtatctctattggatgcatgttcattttgtgcctttcttgtgacttggaatttactaccaaagtttttttactttattatattattttaaaatgttaaagaagatattacttatatagtgacccagattctttaaattgtgggctaaagtctacactgttgtaaatctttgaaggcgaagtctctttagatttatttactcaggtatcaaatgaattcccattggggtgtggacatagaactgataattgcttatatgatgtattctggggcccatttttcctgttaccatttacaacaatttctgtggtttctctcataggcatgtaagagaccaaccaaaagtaagagagtagctggctaataagctgattaattttttttaaaactatagcccaattacatcaaagaattgaaattgtaaaggtgagagaggacatgattgatacatgaggaggtagaagtaaggagtaaacgtatagtgattgaaaatcagcatttttttaaatagggctatattaaggtgtgtgtaatgtgcagaactgtacataggagatagatcttatttaagaataaatgattcccattctctttaaaggatggagttactagacccatgacagcagtgagagcagctggttttaccaaagcagctttgagaggtttgttacactgtctctactaataatcttttttggatcttttaatcttttatcattttgtgatataaatattactgtcattttaaataaaatctaacaatgccattgattataagatgcactgatattttaggtaccattaagaaaggaaaaggatgatgaaaaccttctacatatctgttggggtggtaattaaaccatggtgtaatttgtcaaaatgcattgaaataatatgtaaaaagttaaatgataatttaaaaataaaattataacaaaaattaatgtttagtatgccaataaggaaaattaaaaagccaatagcaggttataagacatgtgactgataatttagagttgataatagagatagatcactgtggaagagaaagtaaatgctgagaatatcttatttttgtttttaagtttaacacacgtattatttacatagctttatgtgtgttaaaaatcttaccaatttcccagtatatgaaatgtttatgtagacacaatgttatctccatttaataaatagataattgaaaccatttaataaagaggtaaatgaaatagcttatgcgaggttttatattttcatatattcttcgattttgctgagttacaaattgaatattaactcttgaattgtgtctcaggctctgcatttgacccccttagtcagtcaaggggccctgcttcccctttggaagccaagaaaaaagataggtatgtaagtccttatgttgttgtttgttgttgttgctgcatattttaaatttttattttccaaatacacaatttttttttttgagatgatatctcactctgttgcccaggctggagtgcagtgatgcgatcttggctcactgcaaccttcatctcccaggttcaagcgattcttctgtcttagcctcctgagtagctgggattacaggtgcctgcgactacatccagataatttttgtatttttggtagagatggggttttgccatgctggctaggctggtctcgaactcccaatctcaaatgatctgccgacctcagcctcccaaagtgttggcattacaggcgtgagccaccacaccagctcacataattacataattatgtgacttccataagaattacataattatgtgaattccataagaattacataattcttaatctttaaaaagtttgtgtcagcagagtagtaaacaaaaaatcatccctagttgccagaactaacaaaattaagaatagccatatgtattctgtgcaattttattgtgatattatatgacttgaagatatggtctaattttttatcagggccagtattgagtctcctgacagccaaatggggttgtaaatgttgtaagatatgattatcttgagaggacatttcaagggaaaaaattaagagaacacatatgaaattaatgtgtcatattattgagaaatttaattttttatagaacaaacttaatttagtgctagtggctagacagtagccaaaaagctatggtatacatttaattatatacatctgctggtatccaagtaccttgatgtatacattttacaaatagtaataaaagctaacattaactgagtccttgctgtgtgccaggcacttttccaagtactttccctatgaaaacagagctattattctcactagtttataaagaggggagctgaagcccagctatcttaactttctaaggctagtaaatgacaaggcttagattcaaacccagtttttctagttccagagcttgggctctggaactagaactggaattaatcactatactgttttgcttctatagaatatatgtttttaaattgtaattctttttttttgtttcttttttttatttaaattgtaattcttaaacccagtatttaggctttcgtgtaaattacataatttccatttttgactagcaaggaacctctatagaaaatcatgttattttttatcttaattaatgacagcacattagctaataaaagcattttttatttaaatattatgtcattcatggtccttttggctgctaataacagaaaacatgtttaaaaaaaagtaaggacacaggccgggcgtggtggctcatgcctataatctcagccttttgggaggccaaggtgagaggatcacttgagcccaggagttcaagactagcctgggcaacatagcgagaccccgtctctacaaaaaaattaaaaaattagctgggtatggtggcacacacctgtagctccagctactcagaaggctgaggtgggaggatggcttgagcccaggaggtggtggctgcagtgagctgtaatcataccactgcaccacagcctgggtgacagagcgagaccctgtctcaaagaaagacttaaaaaaaaaaaaaagacatatacataattaacaagaaaatttattatctcacataataggaagtctggaggaagggaagttctggggatggttaatttaactgctcagtaacatcatccctggtccagcttctctttgtttcccttggctttccccaagcgcctgccgatcattatgatgccaagagagtgttgagagttcaaaatctccatgtaactgatatagtctagaggcagaatgttcctagtcttaggtctcttaaaaagccaagaagatctttctagcagccctgtacctgaagcagatatgccttcatttctcagtgtggaatgcatcaaatgctcgtggctgaaccaaacacttggcaaagagaatgagattctcttgacttgcttagattctgcatgcaaagaagaagggcgggtggcaggctctgtgtgggtaggtagccaacagtgcctgaatatagattgcattttttttgcatttgatagggacagggtaagttactttcagtgtcttcataaagttctcttacagatttttaagtttaaaattctatgttgatattttgaatttaataataaaatctgtaagcaacatttaagacatacattcaagtgtttcagacaactagaaaatagaattctatacttcatgtaaccttcataaaactaccatctattatgcttactgctcagttagaattttacagatctttataaactaataaacttttgtagtcttagtcccaggtttcctcaaagaatataattttatagaaaaagttatgctgctcaatttatttctatatacttttataaaatccatttgtagagaattaagagaactactatctattctgatatagcagtagtaaaattttatttaggcattgatgtgtattcagagtattgttgtattttgccaaaagaaagtggtagcaaaacaacattactgttattttgaaaggaactgatttgggaatacttgatttgctattaatagagccaggatttttaaacttcttcacctcattagaaactttctctatggccaggcatggtggtgcacgcctatagtgtcaactactcaggaggctgaggcagaaagatcgcttaagcccaagagttcaagccgtagtgcgttatgattgtgcctgtaaatagccactgcactctagcctgggcaacatagcaagaacctgtcgtttatttttatttttttttatttttttgaggcagagtcttgctctgtcacccaggctggagtatggagtgcagtggcgcaatatcactcactgcaacctctgtctcccaggttcaagcaatattctcctgcctcagcctcccaagtagctgggattataggtgcctgccccaacacctggctaatttttgtatttttagtagaggcagggtttcaccatgttggccatgctggtctcaaactcctgacctcaagtgatctacctgcctcagcctcccaaagtgctgggattacaggcaggagccaccacgcctggccatgttacctaccttgactgttgttattattttactattatgaataattacatgatgtagttgttaaaaacagtactacatttgctctttaataccatgtatacatttgtcttatctataactattcttgaagtttaaatgcacattgttcaatgttgaaagtaaattaggctgggtgttgtggctcacacctgtaatcccagcactttgggaggctgaggagggaggatcgcttgaggcctggagtttaagaccagcctccctgggcaagatgaggagactctgtcactacaaaaaacaaaaacaaaattattcatgtatggtggcatgcacctgtagtcctagctacttgagaggctgaggtgggaggagatgacctgagcccaggagtcaagactacaggctgcagtgagctatgattgtgccactgcactccgtcctgggcaaccaagtaagaccttgtctgtaaaataaaataaaataaaataaaataaaataaaataaattttagtatagatttttagaggttgaatgatttaaattgtacctgcttttgtctttaatagcccagaggaaaaaataaagcaattagagaaggaagtaaatgagttggtagaagaaagctgtattgccaatagttgtggagacttaaaattggtaagttcataaacaagattcaaaattatgaagcatttatagatgtatgtctgcttttatacatacaccgtatgtatagacaaatatttttgtttgccgttgactggtcttaggataagaagcaattattttgagaaccaggaattgtaactcagtttcataaatttgaatgtcagaataattggctggttttgtaatttttgacattggtcttttcagtagggaaaaaaattctaatgtatttgtatacttaacttggcagcctggtggactattggattagatagcaatatgctgctgaaaggtgtagctaccatgagccacacacagtactaagggctgttttcttcttgaagtctctctactatcaaatattttttcctaagtaaactaaaaaattagtttgctttttgggaatctaacttggctttttaaatatcaatctttacttttaatttgctttgttcatgttactttgattgtcatatcatataaatataatttctgtgagttattggattaatgaataccattagaaagaaatgttcactttaaaaagctgcttttactactcatagaactggggctttttttgtcattctaaaaaacaaaaagtccctttccaagggaagtttctggtaagagcacacaggggtgtcttgaggaatctgaggatagaaaatgaattcatccaaccttcatgtagatatttctcaaatgcataaaagttgatgaacactcaaaggaagttacaaggtataaatctgatttcaggccttagaaaaggcaaaagatgcaggaagaaaagagagagtcctggtgagacagcgagaacaagttacaactccagaaaatatcaatttggatttaacttactcagtaagtattgaaatataacacaatttttaaataaaattttgactagggttaatgggttccagagtcttttttcttttatttttaaaatcttactggtcttcaggtgctcacaattagattaataataatctttagttcataaaacactcttgtctttgttttgtgcaaagagctcttttctttagttatttaactagttattttaggctgggtgcagtgactcacgcctgtaatcctaacaccttgggaggtcaaggtgggaggattactgagtgagctcagaagtttgcgaccagcctgggcaacatagtgagacctcgtctctatttattaaaaaatatgtagccgggtgccgtggctcacgcctgtaatcccagcactttgggaggccgaggcgggcagatcacaaggtcaggaaatcgagaccatcctggctaacatggtgaaaccccatctctactaaaaatacaaaaaattagccgggtgtggtggcgggcgcctgtagtcccagctacttgggaggctgaagcaggagaatggcgtgaacccaggaggcggagcttgcggcgagccgagatcttgccaccacactccagagcctgggcgacagagcgagactccgtctcaaaaaaaaaatatatatatatatattttttttttgataacttagtaagtacctgcaaacctaccatgcaatggctctatttcttgaagagcactaattttaatgctctatcaaggtggttattttgatgagattgtaatgtagacttttcggtcagtgattttcaagaactttaggcatataaaataatgttctatgagggtagtggggaaaaaaaactaatgcctctaatttctagcaacatttatttaattctgaaaagacacctccataatgtttgcacttctgtttaaaagggtgtattttcagtgggtaaaggtttcatatgctaaacacataggaaaaaaagggcgtttgaaattttgaagtgttagatgcttactgtttatagctgatactctacgattccatgaaatctttcagggataatttatgatgatcattttttacctttaggaacataatttactataaattaattacttaaattgtaatttagtatatagagcttactatacagattcttctgatagactttaaggtttaagatatttccacgtttaatttatatttagttcacgatcttgcttatttctttgatcaccagcagcattaatgatacacatttattctttgtaggtcctccagagattaatagatggcaaatactactaaattaaatagaatacatagaaaattaaggtgaaatttagaggacagctcttcttttcttaatgttcatttgtaatgcaagataattcttttgtttacttaatttcataattggctgagtatcttgatataagtagctaactttgttataggattttaatctctagaaagattataggtgaaaggggcctaaagtggtcttatgtgtcttttctataatattttcttccttaggttcttttcaatttggccagtcagtattcagttaatgaaatgtatgccgaagcacttaacacttatcaagttatagtcaaaaataagatgtttagcaatgcaggtaagtgtacataatcagtttttccaatagatgtaattctttcgtagtgttaatttatgtctcttcattttatgcttccttaaaatgaaatgatctatgctctaaacaaatcagtatttatgataggggtatcctgcttaaacatactatttatataaaaatccttacagatgaagaaatatagttagtatgaggtatattgcctaatagtatcctgttatcacaagtagaatgagccatgacatcctcatagaatgtgcttttccttatataaatttatccccaagagattatagtttatatttagcatttatattgtgtaattttttggtagcagtattaatgtttatcagaatgtcgtttcctttaatattattaaaatgtatgtggcattcttgagtctaacttttaaatgtctttaagttccatgttttcttagaagaacgcacaataatgtaaagcacaataatgtaaatcagttgttttctagccatagtttcaggaatctgtcttaagttccatttcttcacaggaggtaagtttgaaaagtataactgttttaaagttagaattttagataatatctgagacttcataactgagaaatgcttcagagaatatgaattaaaagtcatctaaaatatcaaagagtggaaaaatgagagtattatacattcattaaatttttttaaattaggaatattgaaaatgaatatgggaaatatctatttaaagcaaagaaattattccaaagccattaaattctaccgaatggcattagaccaagttccaagtgtcaataagcaaatgaggtaagtttataacaatagataataattgtaaaatttaagtgtttttctgaaacaagataactcttctgacctgttttcagtgggttgaacatttcaaagtgtttgtacatgagatttatacgtgtagtattttgatctgttcccttcttactacttgtacacatttttataatgacaagttaaaggttaaagcattgtatatgatcatatgaaataaaactaagtgaccaataaaggggttaaccctgaaggccattactaccctgatataacttaatgcggacacaaaatcataatagcagtcctccagaacatatcaatacaaggctagaaattaagctccccttacgttcttgctgtagcttgagaatgaaatagagaaaaggattacttctgagtcttagaagagggggaagctgggatattttctattataatattcaggagcagaaacagtaagttctcttatggtctagtgataactgtggggacataggaagtttccaagatatttactgatcataatttcccctaggcacagtacagtttctctgtgaaagttaatttatttgcaataccatcttttaagatcattcgtttttgaattttacataatatctcattatcattagcaaatattatctaacttacagaacacaatgcccttgaagtacttttaagccaggtgagaccaagaatttgagcattttagaaaaaaaattgtattgagtaacatatattaagtgcttcataatcaataatcaagacaatgggtgctataataattcagtggaagaaatcattattgagaacaagaatgatcaagaaaggctttatgaaggaggcatacttgatattgactctttaggaggagagaagggataacatctgagaaaaaggcaacacctgagaccagtcagggaaataatagtctttatgaactgatcagagaattatgaataaactaattgagttgaaatagagggattatattgaggagtgtttagaaataaggtgggatcacatccattagaatggctccaatcaaagaaacaataagttttggtgagtatttagagaaattagaaacctcattcactgagatgtcaaatggtgcagctacttcggaaaacaggcagttagctaaaaaagttaaacacaaatttaccatgtgaccagcaattctgcttttaggtatatacccaagagaaatgaaaatatagatcgtcacaaaggcttttacacaaacattcataacaattattcataatagccaaaaagtagaaacaagacgaatgtctaccaagtaggcaatgtataaataaaatatggtatgtattcatactatgaaatgctatttgacaaaaaaaggaatgaagtactgatacatgctacaaaatggaagaatctcaaaaaattatgccaagtgaaagaagcaagacaaaatatcacaaattgtatgactccatttatgtacaatgcctagaagagacagagagacagaaaatagactaatgggccgggcacggtgcctcatgcctgtaatcccagcactttgggaggccgaggcgggcgaatcacctgaagtcaggagttccagaccagcctgaccagtatggtgaaaccccgtctctactaaacatacaaaaattagcccggcgtggtggcatgtgcctataatcccagctattcaggaggctgaggtgggagaattgcttgaacccaggaggcggaggttccagtgagcagacatcatgccactgcattccagcctgagcaacagagagagaccctgtctgaaaaaaaaaaaaagactaatggttacctagggctgggaataagaatggggaatgactgttaatgagcacaggttttatttttagggtaatggaaatgaattaaaataaggatgtggttatagttccacaactatataaatacagcaataattatcgaatcatatacttaaaatgagtgaattttatggtatttatataaagcttttatcaataaagctttaacaaaacaaaaacgaagtaaagtgggagacgaaaaaagaaaactatttgtgaatggtttgaatgccatactaaagagttcagaattttaaagctaatccatgtctttttcttttaggattaaaataatgcagaatattggagttacatttattcaggctggtcagtattcagatgctattaattcatatgagcacataatgagcatggcaccaaatctgaaggcaggctacaacctaactatctgttattttgctattggagaccgagaaaaaatgaagaaggcattccaaaaattgattactgttccattagaaattgatgaagataaatatatttcaccaagtgtgagtatgaaaaagacatttctgtagccacttcccacttatctgtgcttttctgttttcagaatgagaaagccagaatagatgacttcttgggtttttcccaggcctgtatcaatgtgttttattattgatgtatttcattttttatttaaattgggttgagaatgagactctattgaaatggggtagagattatggttaaaacagactgcacaattttagtaaaaaaatcattaaaaataagattccatgtcattcattaagcataatatcttttttttttttttttttttttgaggcagagagcctgccttccaggctggagtgcagtggtgcagtctcagctcactgcaatctctgcctcccaggctctggcaattctcatgcctcagcctcctgagtagctgggattacaggcatgcgccaccatgcccggctaagttttttatttttagtagagaaggggttttgccatgttgcccaggctggtcttgaactcctggcctcatgtgatccacctgcctccactttccaaagtgctgggattacaggtgtgagcctggccaagggtaatatcttgaccaagaaacctccaaatccttatttcacctattaagagccattgtggagcagagggaacctcaactgtgtataaatatctcaagagcgaaggctgggcgcagtggctcacacctgtaattccagcactttgggaggctgaggtgggcagattgcgaggtcagtagtttgagaccagcctgaccaacagggcgaaatgctgtctctaccgaaaatacaaaaattagctgggtatggtggtgggcgcctgtaatcccagctacttgggaggctgaggcaggagaattgcttgaactttggaggtggaggttgcagtgagccaagactgtgccactgcactccatcctgggtgacagagcaagactctgtcttgaaaaaaaaaaagtgaaataaattccttatccttactcatagagtggaacataatgcagttatcaaaagtcatattttcaaacacctagagaaatattatataatgttaagtgaaaacatacagctatgcacacttatacatgaacataaactggaagaattgacaccaatataaaacagtagtttctgagctatgagattgtaaatgcttttgaaatattttccagatttttacaaataaaatattggcatactgtatattagtttaaggaaaattgcctctatttgtagataaaaatggtacattttcaatttcacagagttgaacttttaatagattttcttaacagattatattagctgggcatggtggcgggtgcctgtaatcccagttactagggaggctgaggcaggagaatcacttgaacccggaaggtggaggttgcaggagccgagatcgcactattcactccagcctgggtgacaagagcaaaactccatctcaaaaaaaaaaaaaaaaagattataagagtactgtagcatagcagagtataggctctgaagccagatgccttggctctcctactcagctcttactctccctgtgtctcagttcttttatatatgtaatgggattaactattataacctatcttacagggttaaggtgaggattataggtgaggattaaatgagttaatgcatgtgaaatgcttaaaatagtacctggcagctgggcacagtggctcacacctgtaatcccagcactttgggaggccgaggtgggaggattgcttgagcctgagagttcaagatcagcctgcgcaacatggcgaaactccatctctacaaaaaaatacgaaaattagccaggcttgatgttgcacacctgtagtcccagctacttgggaggctgaggtgggaggatcacctgagcccgaggaggtcaaggctgcagtgagccgtgatcacacccctgcacactagcttgggtgacagagtaagaccttgtctcaaaaaaataaaaaattagccagcctggtggtgtgcacctgtagtcccagctactctggaggctgaggtgggaggatcatctaagcccggggaggtcaagggtttagtgagttgtgatcacaacattgctctccagcctggatgacagagtgagaccttgtctcaaaagtaaaataacaaataaaaaaaatatatattagccaggcatggtggcacatgtctgtagtcccacctactcgagaagctgagtgggaagatggcttgagcccagaagttgagactgcagtgacccatgatcatgccacagtgctccagtctgggcaacagagcaagactctgtctcaaaacaaaactaaccaaacaaaaaaaatgtatgtgaaagatagttaagtgctgggcaaatgttaattattatatattattttcatattgagaaaaaataatatatgttgtaaaatcatctgtgtttttaatggggagtagagatatggatcatactaagtaattgatgattgaagcatttatatttgagtttagaattaaagtattacatatttgtactaacaaccccagcttctgtgtacttggtcctaatctttccatcctgatccttttatcagcttcttagaataggttagttcaatggagaatgtgattggtaatcagaaatatgaaaaagaaagttctaatttacataagggaaaatagaaggattaatttactctcccttttttaaaactaattagtagggaggcttattggaaattcaagttcgtggctggacatgatggcttatgcctatagtcccaatactttgaaaggctgaggtgagcaaattgcttgagccaaggaattgaagaccagcctgggcaaaatggtgaaacctcatctctacaaaaaatacaaaaattagccaggcatcatggcatgcccctgtagtcccagctacttgggaggctgaggtgggaggatcacctgagcccagggaggtggaggctgcagtgagccatgatcatgccactgcactgcagcctgggcaatagagtgaggctgtatctcaaaacaaaacaaaacaaaaattaagttcttgctgtttacttctgaattattctttttttcttccattttattttaccaggatgatcctcatactaacttagtaactgaagctataaaaaatgatcacctcaggcaaatggaacgtgaaaggtaatattttaaacttaataacgtagttattaattacattatttaaaatatttaatgtttagtattaagatacttaatatttgaaacttaaaataatttagttttaatttttataaaagggttgaatgtgcattctgtttcttacagaacttgttatattcaatatatttcttgaatagtgctattatttcaccatttttatacttactggttctcttttctcattcagaataatctcagtgctcatgctaatctcaattactcaatctcagttattctgtcagttgtttccctctgcatttggtacattattggaactttgtttatcttacctttatttcaaaaatgacgtctttatgtttttttatcctgcctcacaattaaggatcagctctcagagacaaaattctatttatttcatttcttccttcctctaatatggtactacaacttgtttctacttacaacacttctgacaccaaatgtgtggtttttctcacaccaacaaccaattatccatctccctggacaccaagggcttagtcccacaagactactaccctgttcctcactacagatgccagttgtaagcctgtaagcctgggcctcctgaactcctgactgacctgctatgaatggaaggctcccactaccccctcctcagggtcagtagttttctaggagagctcacaaaactcaggaaaatactttatttgtacttaccacgttattataaaggatacaactcagagacaaccaaatggaagagctgcatagggcagaatatgggggaagtagtgcagagcctctgttgactttctgggtgcaccaccctcccagcacctccgtgtgttcatcaacctggaaactctctgaactgtgtcatttagggtttatatgtaggtttcatgatgtaggcatgattgatttttatcattggccattggtgattgaactcagtctgcagcctttctcccttcgctggagattgagggtggaattaaaagtacaactggggtggtgtcagaaaaggccaagtggggagctaagactttaacccctaaagcctgttccattcctctgatgtcagtggatgacacgtggggagcctggaattccacccctacccagcagtactgaagcatcccccaaccctttctccttgggtagtgtcagaggaggcttagtggagcgtcagggctttaactgtcacccagttgtaacaaagccctcctatcatgatgttagtaggacggactatttgggaagcaagaactcccaccctgcccaatagatacaaggacccctctgcctattctgggtgtcaacggaggccatgtggcaggggctggatttccaccttcacctggcagtggcaaggtggagtgtctccttcctctgctggagtggtatccagaaagccagctaaaacgatacttaaaatccagggtctcataattcagaaatgtccaagtgttcattaagaatcattgtttgctgggcacggtggctcacgcctgtagtcccagcactttgggaggctgagccgggtagataacctgaggtcaaaagttcgagaccagcctgaccaatatggtgaaacctcatctttactaaaaatacaaaaattagccaggcatggtggcatgtgcatgtagtcccagctactcaagaggctgggacaggagaattgcttgaacccaggaggcggaggttgcagtgagtgctaagatagtgctactgcactccaggctgggtgacagagcaggactccatctcaaaaaataaaataaataaataaataaaatagtgtgaatagccctataaatcttaaggacattgaatgatgcttttaaaactctgaaaaaagaaacctatctctaggcccagatgggttttactggagaattctattaagaatttatatcaggggcaggaaggggcagccacttgggcaggatggcggcggctacagtgggcaatgtggtcaactaggtgatcctgagtgccttcctgttcccggtgactgtgtccttgtgccacatcctggtactgtacgtggggctcctgctgctgctgcacgcctggcgcttgccccctgcaccgcccatctcaggccccgggcccagtctgcattcgtcccctggcctgctgctgccgcagcacttctacccgtactgcgtgctgccactcaccttcggcaagtacttcgcatccctgtcagtgcacgtcagcttctggaaggtgcccatgtcctatgcacacaccattaaggccaccatgcccatttgggtggtcctcctgtcccagatcattataaagaagcagagcaacaaggtgtacttgtcactcatccccatcatcagcggcgtcctgatggccacggtcaccaagttgtcttttgacatgtggggaggccgccacgctgtgcttcttgtttcagaacattttctccaaaaagatcttgagagatttgcggatccaccatctcccgctgctcaacatcttgggctgccacgctgtttttttatgatccccacctgggttctggtggacctctcagctttcctggtcagcagcgacttgactacgtctcacagtggccctggatgctcctgcttctggctgtcagcggcttctgtaactttgcctagaatgtcattgccttcagcatcctcaacctcgtcagctctctgagctattcagttgtcaatgccaccaagagaatcatggtcatcacagtgtccctgatcatgctgcccaacccagtcaccagcaccaatgtcctgggcataatgactgccatcctcggggtcttcctctacaagaccaagtaagatgcaaaccagcaagtcaggaagcacctcctcctggcaccacagtggacctgagcagcaaggaacatcaccagagcccactggagaagccccaccaatggcctcctcttcccccagcacggggactatcatggctgcaacaatatcttaacagaccacttccagtacagctggcagagctacccaaactcttagtttgaaccactatgacttgtagagtccagaggacaggaccagactgttctgcgacggcttcccctgcccccacagcagtttcagaaacttctgacatccagtgaatgtacaacccagccgagggaatggtgtgtaactcttcatcagaagcaccggggttcctggcgccccatgagccacaggaggatgcgttgcctgcagcacagacggctgtgggctctgggcaaacctaaacagacactggtgtctcatgctctttctttctggagactgtcatctgagggccgggtccctgccgagatcttggccacgttgtacctttccatgtggaattattccccaaacggtgtatctcaaaacacttgtgtctgcattccagataacattcaggaccctgtctggaaagctgggatcgctgtggctgtagaccatgggctggcagtgggggtgtccagggcggtgcttgagaacgtcagactggccattttaattccccggctgagatatgcataggaccaacagggtcactgagcagacaaggagcctgtgagaatcattcaaaaacatccccagccacagagatggatccggtttcccagtcatccccttaatagtttgaagttcctggcaaaggttccaaagtgaaaagcgattgcaattagcatccaattcttgcagccttgcagcctggtgctctgccctgcatgtcagagttggcatccggctggatccagaggaaagggaaactgctctctctctctcctctgcctccacttctcttggggtaacaaaaaggatcttcgagaaatcatgttcagtatttcaagctctatttctatggcacttatcttttgagaggagtcttcacctcttcagtgatgacttggtaggttgtttggtagggagatcttgattttctgaggatgttgcatttttctagggaatattttgtagttgtgtgtgtgtttagcctcgatccccattaccctatgcgttaggactggcttatgggtcaaaaactgttttatttctaaatgtttaaaaacaaaattcccactggtgatgcctgtgtgacacatttgggtatttagtaggaaacaatgcagtgtttcaaagcttcgagagaagcttcaaaatggacacaattgctgaaaacagaatgaatcatgaacattatctcagtgttttgcataatagacaagaccacggcgttttggttccctgacctgttttgtgtttatgttaggatctgaatcatgttctgggtaaggagaggaggagcgaacactgcactaagatttggtttgccaaatcagattctttggtcaagagtcagtttagggctgggtgcggtggttcaaccctgtaatcccagcccttcgggaggctgaggcaggtgcatcactagagaccagcctggccaatgtggtgaaatctgtctctactaaaaagatgcaaaaattagctgggcatggtggcacatgcctgtagtcctagctacttgggaggctgaggcagaagaatcacttgaacccaggaggtggaggttgcagtgagccgagatcatgccactacacttcagcctggccaatagagtgagactctgtctcaaaaacaaacaaacaaacagaaaaaaaacaaaaaacaaaaaacaaagaaccagtttgggttttggcagaaatcacatcaggaatattacacgaccccagtaggtaaccctgagtgctcaggtctgagctgaggtctcagtcttttatggcttcatgaaaggactgtgccctcagggaggggaccatggcttggcttgtggggtcttggtgatgactgccatctttcttcatcaccacacccagcttcttgctggcatttgcgaggagacagcagcagataagaggttcaccctttatctcccagtgagcaagatgcttccctgttcagagaggaagtaacactgcttatgcttgactgctgtttttttttttttgtcttttgtttgcttttcttttgattggaattctgtatttaagatgttaagttgtgtcagcttacatatggaacattccaggagaggtgactggccccccaccctgcttggcagtggatttctgcatcaccagcttcagaagtgtccctgttcgctagtctgttgtttgcttgctttgtaaatactttggtcccaagctgagacaattgctgtgtaaaacgggaagagtcaatcttgaagggtattatttttcagaagaatttgccgtgtgccttcaccgaaggcagtcaagtctgcagttggatttttctcactagggaatgacaggaaacggggataattttgcactgtggatatattacaggagttgtctatacgattatagtacctgattctttggacatatcattgaactccgaaatgaattcaacctccaggtttaatgaaatctctgatgttactggaaaaaaaaaaaaggaatgaacatcagttctacatttctttcagaacctactttcctttatgaatgtagaagtaccctactaccaaaatcagacagtaccaaaaaaaaaaagaagaaaactacagattaatatcatacgaatatatgaacatagactcaaaagcaaattgaaatattaacaaaatttaaaaagaattatgcatctggaccaaatgggatttgtcccaggaatgtgaaactggtttaacatgtaaaaatcaattaatattatacaggtggccaagcgtggtggctcttgcctgtaatcctagcactttgtggtaccgaggtgggtggatcacttgatcccaggggtttgagaccagcctgggcaacatggtgaagccctggctctactaaaaataacaaaaactgaggtggaggatcacctgaacctggggaggttgagtctgcagtgagccgtgatcatgccactgcacaccagcctgggtgacagagtgagaccccatctcaaataataataataattaataataataatatataggatatcagtggaatgaaggatgaaaactacacaaccatctcagtagaaaccaggaaaattttttcacaaaattcaaaatgttttcaagattaaaaacaaaaagtccaacaagaaacaagtagaaaggaagttccccaatttgataaagtacatctgtgacaaactcacggctaacatcatacttaatggaaagagactaaatgctagcctgggcaacatggcaaaactctgtctttacaaaaaaatacaaaaattagtcagacatggtgatatgcactgtagtcccagttatttgggagaattgcttgagcctgggaggtggaggttgcagtgagccaaaattgtgccactgcaccccagcctgggagacagagcatgacccagtttcaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcctgggttcgagcgattcccctgcctcagcctcctgagtagctgggactacaggcgcctgccaccatgcccggctaattttttgtatttttagtagacataaggtttcaccgtgttggccaggctggtcttgaactcctgacctcaggtgatccacccaccttggcctcccaaagtgctgggattacaggcatgagccaccgcacccggcccactttcaccagttctgttcatcattgaactggaagattctatctttggcagtttgcaaaacaaataaacttaaaactggagttaaagacatccagattagaaaggaacagtttaaaccatcttttttcagatgacatgatcttgtacatagaaaatcctaaggaatcaactttaaaactgttagaataaatgaggttgtagagtaaaaaaaaatcaatatacaaaaatcaatagtgtagtgcagaaatatattaatatcttctcagccgtgtggctgagatgaagtgtagtatttgtatatctgatgcttccgctatccaaggacaatctgttaaatggatttttggagcagggagattgaataggaccttgctccatctgctgtatgcattgacctggtagtgcagtaactccaggaactgtgcaccccctcaggaagaaaagaagaaatacactatacactacccatgaattatcccaaaaatgaaattaacatttataattgcataaaaattattaggaataaatttaatgaaagaaatgcaaaacctaaactctgaaaaccataaaacatgggaagaatataaagatactaaataaattatgtcgtatttttatggataggcacttaatgttattaaaatggcagtgctccccaaattaatgtacagattcagtgccacccttgtcaaaattccagcaacatttttacagaaagtgacaaattgatcctaaaactcatatggaaatggaagggaaccagaatggcccaaacagtgttgaaaaagaaaagcaaagttgggactcaaactagaaagcaacattgatgaagacactgtgaagacagaggcataaatgaatggaatggaattgagagacaaggaaaaaactcttacgtttatagccagtggaggtgccaggaaaatttaagagaagaaaggagagtcttttcaacaaatcgtgctgggaaaagtggatattctcttgcaaaagaatgaagttgtacatctctttcacaccatacacaaaaattaactaaaatgaactatagacctaaatgtaagagctaaaactataaaattgttagaaaaagaagagaaatatcattgactgtcggttaagcaaaggttttgtagatatgacaccaaaagcacaagtgacataagaaaaaaatagataaattggacgttatcaaaattaaaaacttatgtacttcagaggacgctatccagagagtgaaaaaatgacctactgaatgggagaaaatatttgcaaatgatgtatctgagaggggacttatttctagactatataagtaatgtccaactcaataataaaaaggccaatagcccaattaaaaatgtgcaaaagatatgaatagatatttcttcaaaatagatacacagatgcccaatacacacatgaaaagatgctgaacttcagtaattgctagggaaatgcagctgaaaactgcagtgagatactacttcacacctactagtatgctataataaaaaagaaaataacaagtattggtaagagtgtggagaaattggaactcttaaatgctgatggtaggagtataaaatggtgctttgtaaaacagcatacaagtgccccaaaaggttaagcatagacttaccatataacccagcaattttacgtctagatatttacccaaaagtaatcagagtatatgtccacatgacaacttgtatacagattttcttagtgatattattcataatatcgaaaaatagaaataatccaatgtgcaacaattaatgaaggtataaataatatatggtctatccataatatgggatgtgattcagccatacaaaggaatgaagtactgatacgtgctgttaggttggtgcaaaagtaattgcgatttttcccattgaatgcaattgcttttgcaccaaccaatacaatacagatgaaccttgaaaacatgataaatgaaagaagccagtcacaaaagaccacgttttatgattctgtttatatgaaaggtataaattaggcaaatctataaagatttgccagggagtgtctgctaatggatattatgtttctttttgggatgatgaaaatgtttcaaaagtgattgtggtgcttgttgcacaaatctgtgactatacctaaaccattgcattgtagactttatattgggtgagctgtatggtatatgagttatctccctataaagctgttttttaaaaattcagaaatatgtttttaaaattacacgccatgaccaagtaggattaattcgaaggctgcaaggttgcttcattatttttaaatcaatcaatgtaattcaccatactaacaaactaaggaaaaaatcacgattcagtaatgttgagaaagctgtctcttatttcgtatgtttttgtgatgaatgagtgttgaattttgtcacatgctttttctgtaacagttgacatataacatggatattactcagcaacaaaaaggaatgaatattgatatacgcaacaaattggatagatctgaagggaagtatactgtgcaaaaatagccaattctggaagattatatataaccttattctttatatataacactcttaaaatgataaaattgtagaactggagatcagattaatggttgttaggagagatgaagaaggggtgggagttggaggaaaacaaaggaatggaaatatagtgggaatattctgtttcttgactgttatcaatgacagtaatctggttgtgatacttgaaagatgttactgttggaggaaactgggtaaagggtacatggaatctcttatgttttacaaatgcatgtgaatctacagttgtctcaaaataaagttcaaaagaaagaataacaagatgaatgttgaatgatttggaaagattatttcttttcttttttttttttttttgagacggagtctcactctatcacccaggctggagtgcagtggcccgatctccgctcaccgcaagctccgcatcccaggttcatgccattctcctgcctcagcctccttagtagctgggactacaggcgcctgccgccacacctggctaattttttgtatttttagtagagacggggtttcaccatgttagccaggatggtctcgatctcctgaccttgtgatccacctgccttggcctcccaaagtgctgggattacaggcatgagccactgcgcccgtcctggaaagattatttctatattaatacagcatagtataaagaacaagttatagaatagtatatacattttgagtccattttaaaaaccactacttatatataaattcaagaagaaatgactaagagaacttttacccaccactataaattggtatatccactttgaaaagcacttggaaattttccagtaaccttgacgataacacattttatatatgtacgtacgtgtacatatacatatacacacacggatacagatacacatatatgcacacaaaagcaacaaatagtaattcagttttactctttaccacacacaatttcttcagtggtaatttcaccctttactttcgtgtctgcagtgtaggctacgtaagttccgctgcagggccttgtgtttctccagtatctcttcagtttgtcagaaggcatcataaagcagaaaaagaaaagaaatgaacaccgttgacccggcaggcaatcatggcttgctaattacgtttcctagtcatggttttaaacctgaatcgtaaatagatttctatggtacctgtccattgtttagtaggcttttgtggtatgttagttttgatagataatgtttacacttaaattttaggaaatccaaactattttatactgtatctctaaatacaactttttggtttatttgatataggaaagccatggcagaaaaatatattatgacatctgcaaaactcattgctcctgtaattgaaacatcttttgctgcaggttatgattggtaagagagaaagtctataatactgcatagatgtggtttttttcataatttatacttttaaatttaaattaatattgtcattagaaaagtggatatgaatgttgattcatatttatcaagcagataatattgtatgttcagattaatataggctattataaaagttattaataagatacttattactcatgttattttgtaaataaagtagttatataacacatttcagtcaacaatggaccacatatatgacagtggtctggtaagataggaagctgaaaaattcctatcactagtgacgttgtagctgtctcgaaattgtagcatgatgcattattcacttgtttgtggtgatgctgatataaacaaacctatgctgccagttgtataaaagtgtacagtaatatcctaggccttcacattcactcagagtttattttgtgactcatccaaagcaacttccagtcctggaagctccattcatggtaagcaccctgcacaggcatgacattttaaaaatcttttataccatattttaattgtaccttttctatgtttagatagatttagatatacaaatacttaccattgtgttatattttcttgtagtattcaatacagtaacatgctgtagaggtttgtagactaggagcattaggctataccatatagcctaggtgtgttgtaggccatgccatataggtttgtgtaagtacaccctatgatatttgcacaatgatgaaattgcctaatgacataattctcagaacatatccccatcatcaagcgatgccttactgtacagtaaatacataaaccagtaacataattgtttattatcaagtattatgtactgtacataattgtatgtgctgtgctttcataagactgacacagtgcaggtttgtttacaccaacatcaccacaaacacatgaggtgtgatacagcattacagcacctaggatgtcacttggcaataggaattttttagcaccattatcttatgggaccactgttgtctatgtggttggtcctggaccaaaacttttttttggtttttttttgttgttgttgttgttttgagacagagtcttgttctgcctcccaggctggagtgcagtggcgcaatctcggctcactgcaagctccacctcctgggttctcgccattctcctgcctcagcctcccaagtagctgggactacaggcgcccgccaccaagcccagctaatttttttttcagtttatgtaaaaatttatttgaccaaaatgtagaaaaagtgatactattacatatgatacagttgcaagaatctaaagaaaagtgtggattttattccattgcacaatttgctagtgtgtttcctgggtagtgtggtgctgaataagtaggagtgggttggtggggtggggtgggtaagggattcagataagccagaagcagggtgatttttagtcggaattgtaaactttagtcggcccccacacgctgctggggaatgtggaatgttccatctctgagatgttaactgagaaaagagaagtcaaacaaagccgatacgtgcagccctgtctacagaatccttcattatccagtttaatcaggagtttcttggtcttttattaacttggtcccaaagaaggaattcaagtcctagataagtaaatcttcaatttgctgttccctgaagtatggaaatgaagttgggccaatttttaatctctgctgccagagaggccctttctgctaatagataaaaactcttttgctcaacttagtaatgccttgtggtcttttggatatggctgacctgaattggactgaactccaccatattcctgctgagtgggtcattactggaatgagacatttgctcttcagagaacaactttatttttattttttcttgagatggagtctcactctgtcgaccaggctggagcgctgtggtgcgatatcggctcactgcagtctccacttcctgggttcaagcgatcctcctgcctcagcctacccgagtagctgggactacaggcaggcgtcaccataatttttgtatttttagtagagacatggtttcgcnnnnnnnnnnnnnnnnnnnngggtggagggtgaggaaaaggtaaagaagaggatgggaggtgagggagaacgatgaaaaaatggggggaaagaacaaggggaaatgggggggagtgggcgatcgggtggggtagggtggaggaggaagtgggaaagagagggcaggagggggggagaagaaaggagaaagaaaggggggcggcttaaaagagaaggggacagatgaaggaaggaatagagggggcgacaagcgggggatgagtagcggtgtgtggaaaaggagtaagactggagatcggaaatggagataggcggtcctcaacaacgagagaaaagagagaggggggggggagtgggggaaggagagaacttgaaccggggcacagagggggaggaggtgaggataaaggaggggaaagaaaaaatggcaggaataaacagtggatgaaatccgtcgtaggcgggtatgatcagtggataaaaggtgataagagagcgaggaggcgaacaaggatacgagtgcggagatgagtgaatcttcaatgtgctattccctgaaggatggaaatgaagttgggccaatttttcatctctgttgccagagaggccctttctgctaatacgtaaaaactcttttgctcaacttagtaatgacttgtagtcttttggatatggctgacctgaattggactgaactccaccatattcctgctgagtgggtcattactagaatgagacttcagagaatgcagactggaatgctcttcagagaacaactttatttttattttattttttcttgagattgagtctcactctgtcaaccagtctggagcgcagtagtgtgatctcggctcactgcaatctccacttcctgggttcaagtgatcctcctgcctcagcctcccgagtagctgagactacaggcaggcgtcaccataatttttgtatttttagtagagacagggtttcgccgtgttggctgggctggtctcgaactcctgacctcaagtgatctgtcctggcctcccaaagtgttgggattacaggcgaaagccaccgtgaagcccagctaatttttttgtatttttagtagagacggggtttcaccatgttagccaggatggtctcaatctcctgacctcgtgatccgctcgccttggcctcccaaagtgctgagattatggtcgtgagccactgcgcctggccggatcaaaacttttttatgtagcacatgatcgttgttcattggaattgccctggttacttgttaaaagtgcggataatctggctccccacatctttctctgtagatctgagtcagggttctgaggtctggagtgagtatttacatttgtgtcaagcctccccaagtgattctgatacctactatactgtaactctttaccagtggtatgactgcatattaaaatcaggggattttaaatagtcccaacacacaggctgcgtggtagactagttgaatcagaatttctgggtgttgggacagagggatcagtatttataaagccgcctagggggttctgtgatataaatcccacatacagctctatactatgcaaatagttcttgaatgccactgactgaggagctcattaaaagtagagattcagttggtcttaaatgggatagaacatctatatttttttaatgctctccaggtagttgtcatgtgtaatggaaattacgcataattcaactgttctactgaaaaacagaagagaaaacttagttctgcaattatttgcaatttttactatgaattcttctggcattcttactatatttctgttaacttctttgtatatgattaaattatttttttttcccttttttttttttgagatggagtctcactcttgtcacccaggctggagtgcagtggtgcaatctcggctcactacaagctccacctcctgagtccacgctattctcctgcctcagcctcctaagtagctgggactacaggcgcacattgccacgcccggccaattttttgtatttttagttgagatggggtttcaccgtgttagccaggatggtctcgatctcctgacctcgtgatccacctgcctcggcctcccaaagtgctgggagattaaattatttttaaccttttttctggaattgtttatgtttgttaaatataaacatacaaaaaattatccgaaatggtaactcagctcaacgatacatcacaaaacaaacaaacatttagccattgcataccctaataaataaaatttaaagaatagaacattgttagcacattacaaaatgccaatcctaatcactggctacccagctctgaagagtgactgatgtccctgaagagtgactttgatgatgataacttccttgcttttcttcattctttaaccatctaagcaggcatccataatttagtttttccaggttttaaaagcatcatataaatggaatcataccgtacatattcttttgcatatgacttcttttactctgtgtttgttagtgttgtccatgtcctcgcatgtagctgtggtttgttcattttcattgctatctagtagttcatggtattaatatgtaaaaatgtatccatttcaatgtgactgggtgttgtgatttgcagtttgaacctgttgtaaatgctcctatcaatattatggtacagttgtgcacatctcttggtgggtggtgccgatatttctgttagatacatacctatgagtgaaatggcttgatcctatggtgtgtatatgttcagctttaatagataccgctaaacagttttccaaagttcctgtatttgtttacacccccaccaacagtgcatgaaaattcgaatagcttacaaatacttggtgtattttgtattttttcattttagccagccatactgtggcatctcattgtagttttaatttgcatttcactctcagcagattttatatgtttatttaccatatgaatattattttttgagaagtgcccgttcaagacttttgcccttgtttctatttctttggttagttctttttgtgtccttttaaggcaacttttgcataccccaacttcatgaaaatattttcctatgttttcttctagaggttttacctttcacatttagatacaggatctatatggaattgatttttgtgtgtagtgtgaagtaaggtcaagattttttttttcttttctctctcttttcttttctgtagtagggctatccagttaacccagcatgatttatggaaaatagtttactttttccactgcactgtaatgtcacctttgacatataccaagtgactatatattggtctgtttgtagaatctttattcaatccctttggtccatttatctactcttgtcgtcaaaccacattgcctacatttctatagtttatagtaacacttgatatctggtagtgctatgatctgaatatttgtgttcccccaaaattcatatgttgaaacctaacccccaaggtggtagtattaggaggtcgtccttttcaaggtgattaggacataaaggtaggacactttatttttatttttgttttttgagacggagtcttactctgtcgccaggctggagtgcagtggcgcgatctcggctcactgcaacctccacctcccgggttcaggcaatttccctgcctcagcctcctgagtagctgggactacaggcgcctgccaccacgcctggctaattttttgtggtttagtagagatggggtttcaccatgttagcctggctcggcctcccaaagtgctgggatgatagacgtgagtcaccacatccagctggtaggacactttttgaatggaattagtgcccttataaaaagagactctggagagctagctagcccctactattatgtgaggacacagcaaaaagacagcattctatgaagcaggaagtggtcactcaccagacagccagcctgctggcgccttgttcttggacttctcagtcttcgtaactgtgaaaaataaatgtctttgtttaggctacctagcttatggtttggtgttttttttgttttgttttgttttgtttgacagagtcttgctctgtcacccaggctggagtgcagtggcgcaatctctgctcaccgcaacctccacctccctagtttcaagaaattctcgtacctcagcctcccaagtatctgggactaaaggcacacaccaccacacctagcaaagttttgtatttttagtagagacaggatttagccatactggccagcctggtctcaaacttctggcctcaagtgatctgcccacctcagcctcccaaactactgggattacaggcgtgagccaccatgcccggccgagtttatggtatttcattatagcagcctgcacaaactagagcaggcagtataagtcctccagctttgttgttgaggattaccttgagtattcttggtccttgtcatttccacatatattttaaaaccaacttgtcaattttcccaaaacctgctgagataaaaaaaaaaaagacttttttaaaaaagtaaaaaatccaaagactttttttttagaacagttttagtttcttagcataattgaacagaatgtacagagtttccatatattttccccacttcctacccagagcctccctcaccaatatgccatcccagtatggtacatttgttacaatcaatgaaccaatattcacatagtattaccatgtgaagtccatagtttatgttaggattctttgtgttttaattctgggggttttgacaaatacatgatgtcctgtacccaccattgtagtattgtatagaatagcttcactgccctaaaaatctcctgtgttgtacctattcatccctccctctcccaaacccttagcaaccactgatctttttactgtctccatagttttggcttttccagaatatcacagggttggaatcatttagtatgttggctttgctgattggcttctttcatttagtggtatctcttgagtatcccttatccacaatgcttgggaccagaagtgttttggattttgaggtttcttggatttttgaatatttctgtttaccaattgagcatcccaaatccagagtctgtaatcctccaatgagcattttctttgagcatcatattatgtctgtgctcaaaaagtttcagattctgttgtatggatgtttattcattcacctattgaaagacatcttggtggcttccacattttggcaattttgaataaaacatccattgtgtaggtttttgtgtgaacatacagtttcccctctttggataaataccaaggagcgtgattattggaaattacagtaagtatatatttggttttgtgagaaactgccaaactctttcaaagttgctgtaccattttgcattcccattagcaatagatgagaatttctggggtgccacatcctcaccaacatttggtaatgtcagtgtttcaattttggcctttctaataagcgtatggtggcatcccattgttgttttaatttgcaattccctaatgacatatgatgtcgagcatcttttcatgtacttattagctatttgtataccttatttggagaagtgtttgttcaggtcctttaacatttttgaattgggtggtttggtttttgttttggagttttaggagttttctatacattctggatattaatccattatcagatgcatgatttgcaaatattttctcccattctgtggattacctttttactctgttgatatttctttgaggcaaaaacttcttaaattttcatgaggtccactttgtctattttttcttttgtttcctgtgactttggtgtcacatccaataaattgtcaaatctaatgtcatgaagcttttgctttgtgttttcttctaacagtttttttagttttagattttacagggaggtctttgattcattttgagttaatttttgtacatagtgttaggtaagggtgcaacttcattacttatgcatagttttcctggcattgtttgttaaagactgtccttttctcactgaatagcgttggcatccttgtcaaaaagcatttgactgtatatgtggtggtttgttttcgggctcactactctatgctattggtctacatgtctgtcttcctgccagtaccacactgttttgattactgtagctttgtaattactttgaaatcagaaaatgtgagtccttcagctttgcttttctttttcaagattgttttggctatttggagtcccttgaaattgcgtatgaatttcaggatggatttttctgtatctggaaaaataagccatggacattttggtagagattgcattgaattcatagattgctttgagtagtattgatatcttaaatgtagtaagtcttctggtccataaacatgggacatgtttccatttattgatgtttttgttttgttttgttttgagatggagttttgctctgtcgcccaggctggagtgaagtgtcgtgatctcggctcactgcaagctccgcctcccgggttcacgccattctcctgcctcagcctcccaagtagctgggactacgggcacccaccaccatgcccagctaattttttttgtatttttagtagagatgggtttcactgtgttagccaggatggtctcaatctcctgacctcgtgatcctcccacctcagcctcccaaagtgctgggattacaggcgtgagccaccacacccagcctccatttatttatgttttaaaaaatttctctcggcaatgttttatagtgttccatgttcaagtctttaacctccttggttatccttattcctaagtattgtattctttttggcactgttgtcgatggaattgtactcttaatatcctttccaagttgtttgtttttagtgtatagataaatggaagtgaattttgtgtgtggattttgtatcctgctacattgcttaatttccagcaagttaggcatttcttattatcttttccttttttgatttctagtttaattttattgtggtagaagatattcattgaataatttcaactctgaaatttgttgcagcttggtacgtaatccaaatggacttgaaaagaacatgtattctgctgttgttggggataacatcctgtgtatgtcatgtcaagtttcttaatgttttgttcagacctctttttttttcttacatttaccagtttgttataataaaggattttgcaaaggatagtgatgcagggatgcataaggtgaactatgagagaaggggcatggagcttccatttcctccctgggcgccaccctctaggaacctacacgtgttcagctatccggaagctccccgaaccctgtcctcttgggtaaaaggaaggctagtgacttcagcattccttccaccagggttttgggtgagactctcatgtgagggccacaaacagaaaggcaggggaaggtcagaggcctgcacttgaggcctaacatccccattataccagaagactctaataaaggctatgggaattatgagcaggaaccatggatgaaaacctatatatatatcataacaccacaggccaccccctgattttcaaccatggatcctttatataaattctctctctctcacacacaacacacacattaataattagttcagtccatcatactgtgtgaatgtcttccaggaggaggccactcagttttgcaggtttccttacacttgctcaggctggagtgcagtgatataaaatgatatatatttatggtatacaaaatgatgttttgatacatgtacacattgtggaattgctaaatcctatgcattaccacacatacttgttattttttgtagtgaaaacacttaaaatctactcttagcaaattttaagtatataatatattattaaccataattcccttgatgtacaatagatctcttcaacttattccttcgtctaactgaaatgttgtgttctttgaccaatgtcttcccagtcccaccaccccctatctcttctgttattgaagtaagagtcgtgacccactaaattgatttcaataactcagtatgaaaaatgccagtcttgatgcagtgagtttggtatcaacaagaattgggttcaaattcttagttgacactcattttctacctttgtgatctcagatcttccattttcctatctataaaataaaaataatccttttagggttgttgtgagggttaaacgtattaatgcttgtagagcaattagcactgcccctgttatagagtaaacagcaaatattttgtgcttttataaagagatctatttaagttgggacacaaaaaattaaatatattctacaagttctgtagaatttttctcaccctgagagcatttaatatggaaaaatatgtggaaactgtcgtctgttacaaattgttataatagttaattcaaaaatgagaatgtaggtatcagtccaatttttacttaaaatgattagacattaaaataggctaatgataaattggataagaaaagtaatttagaactgaacacttcagtaactgaaaacctgtgttggagcaaatcgagtgcttacctttacagagtactagggaccctttaaaaaatctttgaaaagccacatttaagaaaaccaacagcatcaatatactaaaacaaaatcaagtaaggttttttatgctttcccttataggtgcgtggaagtggtgaaagcttctcaatatgtagagctagccaatgatctggaaataaacaaagcagttacatacttgagacaaaaagactataaccaagtaagttttaaaaaaaattttagatggaattccatatcttaattggtcaaagcattaaaaacaggtaaactcctttctagaataatgttatctgtgattattctgaagttgaataatatttttatttctattttatgttaattttcattaaaatagttttaaacttttattaatttttgcctgtttgtcggttctttttttttttttttttttttttttttttttttttgagatggagtctcgctctgttgcctaggctagagtgcagtggcgtgatctacactcactgcaagctctgcctcccgggttcacaccattcttctgcctcagcctcccgagtagctgggactataagcacccaccaccatgcctggataattttttgtatttttaatacagatggggtttcaccgtgttagccaggatggtctcgatctcctgaccttgtgatccgcccgcctcggcctcccaaagtgctgggattacaggtgtgagccaccgcgcccagctgttgtttcttaaaatgtaaatactttctttgtatagcatggttgctaaattataaaccatattctattccggagattaactttcccctagaggttttcaaagtgttccccaaagcataaagtttttaggaacactgattgtgctagggagcatgggaagccaggagtctgccatcctcaccagagcagcttccttgtagtctgttttatgtgtttggtttcctcattgacactgcattgggattggaagggtctcatggctgtatggggttttagaaccccgcagatctctcactggcactgctgctctcttgctagcttgggtggggggtagagtgggtgctcccccttcagcagtctctcaattaggacagagctgacacacaatcaggaggcttagacaggtgtaagaaagagggataaccaaagagagtaaacagaatgacgtgatgtcctagtctgtaacaccagtggttagtgtcattatatgtcagcaactagaaaactcagctcttcccagttagatccagagagcaaggaccagagaaagctatagcatctttcccacatcctctcccaagcctatgctttcagtttatcttcctatttagagaactttttgctctgggagacaacagaaaggactaacaaaggaagtggggagaacactatctactaaagaatatgagagtagaaaaaagcaaccccaatgttcacgaaataaatacatataattaatgtagtaccatggggtggttccattgcatatgttaatttactatgcttaattttttgagcatttacaaaacatttgaaaaagacttttcaaagtatctatcctgtcatttaatcatcacatccttggtcatgaaaaatgccaccaatgactctccaacattgttgtaatgctttttacatggaagtgacgtgaatcaaattggtttttattatcttgctaaagtgctatatggacaagaaaaattttgtgtgtgacatgtactgttatggatgacaaaatggagaaaaccatgtctgctagttttcctttgacattttatttttaaatgatctttttagaaagggttaagaggccgggcgtggtggctcacacctgtaatctcagcactttgggaggccgaggcaggtggatcacctgaggtcaagagttttgagaccagcctaaccaatatggtgaaaccctgtctctactaaaaatacaaaaattagccgggcgtggtggcatgcgcctgtagtcccagctactcgggaggctgagacaggagaattgcttgaacccaggaggcagaagttgcaatgagctgagatcccaccactgcactctggcctgagtgacagagcgagacttcatctcaaaaaaaaaaaaaaaaaaaaaggttaagaatgcattgccatggctcatgttttaaaactatgttcattaagcaataaacactctaattttttaatgttaaaacctgttgaactcagatcttactatctgtgctttcctagctcttcttgttcaaaatatcttctgttccatttgcattttcaagtttttaatatcaattggtttactgatttttttaaaatgccatttctgctttcttttcatcattgctgctttcactctgtctttcttttgtttgtatattgtaagtattatgaggtaggtataatacaatcttagtttgaaagaaatattattaagtgaaaaaggattgggttgacgtatctcataataatcatttgatggcaactactttatttacaattcaaagtgaaaaagaaaaatttatgccttctgtgaggatatagttctggagttagctctaaatactttttttttttccaagaaaaagatgctgaaatcacagagtatgggtctttttgataatgatggtgtttgtagccacttttgtaatagaaaaaatagactctgccaaaaagcccaaagtggatgaaatgaagccattggcctggaggctcagcggaatgctgaagccaggagctagatggcatcagctgggaaaggagaccaggacagacatagatcccttttcctcattgttttcagggaaacaaacaagctaacattgtttatttttattttttgttttgccatttagaatgaaatttaattttgactgaacttttatcagttccatttataaataaacttacaatattttacttttaaaaacatattttatgtagatttatggacatgtagagaacagttatgaaaacagcctatttcaaaacaaaaacttgagcgaaaaaatacccgagtgttccttttattagaataattatgtagcctttttagaatagatcatagtttagaaacatataatatgaagtgttattactttgtcaagtgatacccatttaggatgttttaagttgtaaatacctttgccaagttttttaagtaatggttttggattgcactgctttttggattcataataaccattttgggagaaaatagatttgatgttaaatatagccttaaagtattgttattaatgagttacaatgtatatatcaaaatttaaaaatttaacacatttccttgactataatgtaaatggccgcttctaaaaggaatgatacaagggactataacactcctttttttaaaaaaaaattgttgttattgcttgttagcattctttttgtattgttttatggatgttgtaaacattagagaatagctttcttttcctgtacactttggagagtttaatggttgtatgagttacacctattcaagtgccttatattttaaagtaatacaccatttattatgacacagtctaaaagtgaagattagactatctcaattcttatttaaagtgaaatgcagcttataaaacctagagattcaaaacagtggtggcttttatattaatagctatggaggttgtataaagcatcaatgaggtagtttctataggataagcaatattagcagcaatcatttttgaggtaaatttaaggaacttgtggcaatgttataagatctttccaagaaagtaaatgatagaatcttgaaagtgaggatatgatgtttgggtttttcttttccagtgtttactttgtaaactactgacctagaaacttccatcagttttctttgaagtcatcaaaaaccctttaaaagaataatttgcttggcaactttattgtgcaaataataataaataaaagaataacagtttactcatattctaaccaaagtatctgaaattgagtattttaaaatcttctgtccttcaaaaaaattgagtcagtttgcctactggtatttcatttgaggtcaaacactgcacagcccacatctcagaatctgtcagagatttgcaacaactgtagctgacaaccattataaaagctaacacagttacttttgcttctacataactgctttctaggagcaggaggcaccaagagtcaagcatcttctaatcagtaaatatattttaaaagaaggaaggaaggaaaacccagtgcctttctctacccttgtttttttctttctaatattctgtagcaatttctaggttgaatactcattcacctttcatgtaaagtgtctgaccgttccacacatcttacttggttaggattatctcagacctgccaggtagttaaaaacatactttcatttctcatgatttaaaaatgtaattatatttggatctactttagatcactttttgtaacactcccagaattattttctgttactggttttgaaaaattctgtgccatttttccttcttggccttctgaaactccaattacatttctattagaccttttcattatgctcccgtaagtctcttgtgttcttttctaggaacattttttagccatctattttgccatgtttcatttagtctgaacattttctgggaccttggccttaaagtcctgtttgctttgctagctctacagtgccttcaaaaaatatttttagtattttctataatctttctagttgttctctgtcaaagaatggtcttctataggctagtcagtcatggccagaagcagaaacctaagaattattttgtaaagatcaaatttgatcacatctcttaggcaaaacctttcaaggcctcactgcccaccccattatgcagaataaacactcagctgcatcacatgactcccaaggatcattattattatcatcatatttttatttttttagagagagtctcacgcctatgcccagtctagtctcaaactcctgacctcaagcaattctcctgccgtggcctcccaaagtgctgagattataggcatgagccaccatgcccagccttccaaggctcattatttactactgacctttcttccagtcaccaggtctctcttcagctgtatctaatctgctgttagaacatctatgttttcttaattatatttttaattccagaatttccattttattcttttttataaattctaattctcaaatgaaattatcttcttgtaatctgttttcttgaacatcttaatccaccccttttgtgcccttccctggtcttacccttcaggaacactgatcttttccccgaccataagcttgagtactgtcatattacagtgtagtaaccttcagttattccatttctaggctgtagagatcttaaaagtgttggaaaaaaaggacaatagagtgaaaagtgcagctgcaaccaatctctcagccctgtattatatggtaagtttttttactactaagagttaatcatatgctatttttatattgctaaatttctgcccaaggatcatgcctagggagaggtccaaagaatattggtggagaatggtaagtggactgaggagtatagaggatctgatcctgacaagtgccaggccaggggctgagttggcagacatgagtgagaacaccatctctgaaggagaagggaggaagaaaaattgtagtgataagcatcgcatcatagattatgcaacatacagctggaagagctagagatgtatttcaactcctttgtgttattggtaaagaaagtgacatcttaggttaaaagatttatgtaaggttacagagtatcaactctaacaagcatttatggagcatctcactggatgccagtcatgggaataccaaaagtctaaaagctccctaaaggggagcgttcttgtctttggaacaaaggaggtagactaggaaggaaggtttaaagtagagaacaataaacgaatgcagataataagtgcttcagaaattcagaggaggcaaataacattttaatttaggactttcaggaaagatttcatagagagttggatctttcaggtcagaatatagaaaggggcatttgtagggagaaggggacgaaacagaagtacagaggcaaggaactgctgggagggaagtgtgtataagagtcatttcttttcaccagaaaatacagaatttctggtaggctttttctgaatattgaaaattgattataggtaggtgtggtgcctcaagcctataatcccagcactttgggaggctgaggtgtgtgaatcacttgagcccaggagtttgagaccagcctgggcaacacagtgcctgtctctacaaaaagttcaaaaaattagctgggcatgatggtgcatgcctatagtcccagctactcggaaggctgaggtgggaggatcacctgagctggggaggtcaaggctgttgtgagccattatcgtgccattgtactcctgtttggtgacagataccttgtctccaaaaaaaaaaaaaaaaaattgtagattttcatttgccactttgagaacccatacgattttaagggctggaagttagaaacaactgatctgtgtgatttttcagtatccttttcaattctgtcattctatgattcttagaggaaatgatccgagatttaattctgtcctgcatgtagaagaagcctataagagctttccttaggaataactgttcatgctgaggttgcagggccaaggaagggcccagatgaaggcatggaacccagacctcaccatctaccagggtggtaaactattataaggctaccacaactccttaactctgccttagccactaactcgaatttccagcgtcttgggttttgcttacgttttgctcagaataatggcgtgggaatggtctttaacagatttccaagaactgcccttattgtaagaatattgcattatccaaccccttgtttaaatttactgtcctgacccaactgaaatatgaagccttcctgactctccttggcagatagtctcaccttcctttgtgctcctagaatattttgtttgtacttacagcattgtattttaatggtttatatgtgattcttcttcattagaccatcagcttcagctttgtattgtgcacagtgccctgttgatgacaggtgcttattaaacacttctttactaacaaatgagaaaaaaagtcatattattttgttaaaccaagtttctagtccctcttagagcttctgatctgtgcaccattgagaagcactgctgtgctgaattgctgttgctagtggaaaggtatcatatccctcatatatgtaaagatgaagaaagagatccaaacccctggttgaagaatgactccagtgcttcaatctactggtaggagagtggtaccagttagttgcatgtctagaggagggtgctgattgggggaaaagatgttgtgtttctttttaaatatatttaaacattttttgtaatgatggaagcaagtagacagaaggtgtattagtccgttctcacactgctataaagaaataaccgagactgggtaatttatcaaggaaagaggtttaattgactcacatttttgtatggctagggaaacctcaggaaacttataatcatagcagaaggtgaaggagaagcaagcaccttcttcacaaggaggcaggaaaagagagagggtgggcctttgtacccccaccccagccagccattggatgtggcctgcctcccaaaaaagggtcacctctaggaagggggacaaggtgcctctgtcttccacccagtttccagagagggctgcctgctgaggctggtggccagtagcacctccagcacctctgacgggcaagtccatggcgtgaagcatggtgtctatcatggccattaaattttgaatttagaaaatcactaatgaattttttgacccaattcgtcaccaaatctttataccaagtttgacgactgtgcaggaggagaccaatagaaaatttaaagaagcaaagagaattgttagatttaatcaaccaagcagagctattagagcatctcatcagcaatttcttatacttggttctgaagaaaatggttgtaatcaagaatgttttgaggccaagtgatgagtctgctatgtagttttatatgatatgtagttgaaaatatattgctggtatccggcatatagttgtatctgttttctcttgctgtgtaatgaactgccccaaaccgtagtggcttgaaatcaccaggtatatgcttacattctacccagtgagctgggttcacctggatgcttcttttactgggcttgcctggccttactcatgcagctgacatcctctgaggcatgactgagactggatgttccaaattcctacctcatgcctgtcacttagctgaactgttgtccagggcaactcagtcttccctcagagcatccccagcaggggatcccagccttctcaggtgggactgggttccatgagagcaaaccccagtacacaggtgagtattaggttcttgtgcgcattgagtttgttattattttattgaacaaaacaaacatgagagagaatcatacctgaatgagtcgtacgtgaatcctgggaggtgtgatccactggagtcattattgtaataatctaccactgcctgcactgagaccccagttattcatatccctcccaagactctgagtctcattccaccacagcatcaggctcaaaggccaggatctacatcaggtctggatagaaatggggctttctagctgggtatggtggctcatgcctgtaatcccagcactttgggaggctgaggcaggtggatcacttgaggccaggagttcaagcctagccaacatggtgaaacctcgtctctactaaacatggtgaaaccccgtctctaccaaaaatataaaaaattagccaggcatggtggtgcatacctgtagtcccagctactcgggaggctgaggcatgagaattgcttgaacttgggagggcagaggttgcagtgagccaagatcgtgccactgcattccagcctgggcgacagaacgagactccatctcaaacaaacaaaaaaaaaaaaagaagaaatggagctttctcaggaacaatttcttcttgatccaaagatttctttattttttttttttatactttaagttttagggtacatgtgtacaacgtgcaggtttgttacatatgtatacatgtgccatgttggtgtgctgcacctgttaactcttcatttaacattaggtatatgtcctaatgctatccctcccccctccccccaccccacaacaggccccggtgtgtgatgttcgccttcctgtgtccatgtgttctcattgttcaattcccacctatgagtgagaacatgcagtgtttggttttttgtcctggcaatagtttgctgagaatgatggtttccagcttcatccatgtccctacaaaggacatgaattcatcattttttatggctgcatagtattccatggtgtgtatgtgccacattttcttaatccattctatcattgttggacatttgttccaaaggattataaaacatgctgcaaaagacacatgcacacatatgtttattgtggcactattcacaatagcaaggacttggatccaaaaatttctgaatgaaaagacatggcacctgtcccatcatacatgcaacataccatggagatnnnnnnnnnnnnnnnnnnnnagaaaaaggattaaagggagtcagaaaaaaaaaaaatataaatgactataatatcatatgtaaagaatatagtttagacgttttgttatcttatcgtttctcttactacttcagttttgaatgttatatatcagattatctatattttatcatgtagtaatttttaataaagaaggaaatgaggtcgatcaaatatatagatcaaatttatcttccattactattagtactttattgtatttattatgaattaaattttaaattattctaggaaagtgtaatatagtatataaattcaatgaaagcaataatacaaatcgctcaaatgtaatactgaataataaaactgtataatactatgtatttatgatagagtgatagattactttaaatatatttatatagtaattataaattaaagtaaatataaaatagtctttttttaaataatattaattatatagaataaaaaataacctcccccctccccccaccccacaacaggccccggtgtgtgatgttcgccttcctgtgtccatgtgttctcattgttcaattcccacctatgagtgagaacatgcagtgtttggttttttgtcctggcaatagtttgctgcacaatgatggtttccagcttcatccatgtccctacaaaggacatgaattcatcattttttatggctgcatagtattccatggtgtgtatgtgccacattttcttaatccattctatcattgttggacatttgttccaaaggattataaaacatgctgcaaaagacacatgcacacatatgtttattgtggcactattcacaatagcaaggacttggatccaaaaatttctgaatgaaaagacatggcacctgtcccatcatacatgcaacataccatggagatataaagacaggataactgtaagacactcatccccaaggggagggatggaggcacatcacagtcactatccttaatgattctgaaacctagcaaagcaggtgtggccagtgctccctagtctgagaaaaacgaatattccttgattagggcccagctctgctccctcggagtggccccctaattctttgtcctctgtggctcttggctcggccttctgagagcatcttccttttgtataagaaatagcctatgtttcaggaacagaaaaccaaacaccgcatgttctcattcataagtgagagttgaacaatgagaacacatggacacagggaggagagcatcatacaccggggcctgtcggggagtggaaggcaagggaagggggagcattaggaccaatacctaatgcatacagggcttaaaacctagatgacaggttgataggtccagcaaaccaccatgggacgtgtatacctatgtaacaaacctgcacattctgcacatgtatcccatgtttgtttttaacctaaagtaaaaaataaaaaaaaaaggaaagaaatagcctgtgtttgcagctgattaactttctcagcctgtgttctgccctgagacatttggggcatagagggcttttttcattttggactatatctgtccctttaatccaaactagcaacagtcagcacaactcccctaaaaacttggagggttttctctaaatcttgttgggctttcccacatgtctcaacagctgcatccataattcttttcaggacagaccccttcccactaggtgtgtaggctgctatggaacagagccttgaagtgtcttagaagcccacttcgctacctgggagagaaggtctgctaggtatgaccttaaatctttgtgagatgtttacaaaaggtgttacagccacacctttgaattgttccctaacctgccaccatctgagaatcttgtgccaccacaagaaactggagacatgaagtaattttattttctaccttagcaagtcctggttcttctatattttctctaaattctacctgcaaactaaacagttctctccttagctcatttttctcttcctatacctgatcaatcatacccagttaaaataagttcattggcccttcagcatcctacctagaaatccccttggccacatgttgcatatttatgaggtgcacttcctatcctccatcccactctgtgggtgccacttgtgtcagtgcttcatggtgacagtgtggtttgcactttatccagcctctgatgattccttctgcctttgcaggctcactcatgcttcaccatctctccagtccccaacacaggccctcacagcttttctcagttttgcctgctacgtagtccaaaagacaatgttacatgttttagtttttaaacagcagcacctcacttgtcggtaccaatttttgtttcagagttcacataaaaacttgcacatgaatgttcatggcagcattattcatagtaaccataaaggtgcctggaagcaacccaagtgtccatcaacaatgaatggataaatgaaatgtggtctacccatacagcgggacattattcagcctttaaaaggattgcagcacagatgcatgctaaaacatggacgaaccttaaaaatattatgctaagtgaaagaagtcagacacaaaagactgcatattttatgattctatttatattcagtgtccagaataggcaaggagacagaaaacagattagtggttgccaggggctgggggaagaggaggatgggaagtgactattgatgggtacagggtttcttttgagggtggaagtagatattggcaatggttgcacaactttgtgaacctactaaatgccacagaattctacattttaaaggggtcaggtttattatatataagttatatctaaactttttaaaaagtttaacgagggacggtcactgtgagtgttatgggaaaaggggcatgggaatttaatgttatacagttgtgaaggagccatggcggtgaaggtgcagaaggggagctggagatctgaggaggagtaaccatcagtcagtgagtggccacacatatctagctgccacagtagaacccagagggccttcatggggagttctgtgggaagcagatgcctctgtgcagctgcctcctctggggaccacagccaaaccctatcttggagcagggacagcatagtcaggaagaagagctgcccttggagtggagtaagtgaggagaagctggtacccatggacacttctgtgtcagacctgcatctgatgacaagaaaaaggctttctgagactaaaggccactgcttcaggtctgcattccagatgtcacacaagttcctcttttggccaagtctagacaagaggctaatagtgaaggagcttcttggaaatgtagttcctggcttaaccaagctgacctggcacagatggtcacaatatttaagaacagagaggttcctgtagctcacgtgaatgatggcaaggccctgaccgagcatttggcatggagacggaaaaaaacaatggattgctagaagtgcagagacctagtaggtgacgcagccagtgtgctaggggcaagaagggtagtgcttttgtgacagctatttcagggcttcaagtgggagggggagtgctgcagcaaatgatgacatgcaatttgggcgttgagtatggaaccacctacatataaatagtgttgttattctaaccatgagactgtggagaagtcaatcacaagaaacttgggtggttcagcctgataagtaaaactctatgtagaatcagactatcaagaccaagatatgtaaaatatttttgttcattacatttataatctcagaaagtctatttattatgtctgtaatctcagaacagtcagaaaaggtatttcatgaaattcaaataatttgtatatgtattttacttagggaaaggattttgcacaagccagcagctatgcagatatagctgtgaactctgatagatataatccagcagctcttactaataaagggaatacagtttttgcaaatggtgattatgagaaggccgctgaattctataaagaggctctaagaaatgattcttcttgtactgaagcactttataatattggtaagtgaaacaaggggaaattgctttttaaattatttatttgctttgtatttgtttttgttttgttttgcttaaagagctctaacacattaggaggaggagttgacttccttctaacggaaaattgaagactactgcctctcagattatagattattttaaatggaattaatgattcagaagctatgcacatgcaaaatttggatcaggcttgccatactgccctccaaaaaggcttttccatcacagtgtataatactaatttcccaaatttctgctaatactggatattatcattctttttaacttttgccaagttcatagatgggaaaaaatcccatttgctttctttttaattatgaacaatttcaaacatgcacaaaagtacacacaagaaataagtacccatgtacctatcaccccagtttgacacattttcacattttgccatctttacttcagattttgtttttaataagccaaatactacaagccatgaagtctcaccaccatcacattctcttccctgcctttcagcggttgcctgaaatgggcatcatcacccctgggcatgaattttcagtattgcaaacacatgtccatgcagtactgggtcttgtctcttggattattaataacttttcttctgaagttttcttctccctgcctaggtattttttgctttctttggtttgcttattttattctcttttccatgttatggactttacttagatgtctaatgattttgggctgtctcctggtattcaggagtttgtggctaaaaactgagtggagtctctaagtccatgagagagattgatgggttggcactctgctatagggcatctgtctggtctggtctgtttagttggagacctgtccataagtcaattggatctttcctcccagaaaagactctttaatctcctgcctgaaggaggagggaaggcctactgccaaccttgaagaataggggaggcaagaaggaattagccattttaggtggagtctgggagagcctcattgagaatgtatgtttcaagtcatagaaggaagggaggctatgaccacttgggtatctgggaagagagcattgaagagaggcacaaaggtcttcatgcaggagcttgcttcctagatatatccttatttatttgttttgtaactattaaatatttctcctttcccaattgcttctattttaactttgtttctaatttcttttatcagagaattgttttattattgatatagtaaaatttgtcttttttttttttttttttttgagactgagtcttgctctgtcgtctaggctggtgtgcagtggcatgatctcagctcactgcaacctccaccttccaggttcaagtgattctcctgccgtagccttccaagtagctggaaccacaggtgcgctccactacgcccgtctaattttttgcatttttagtagagatggggtttcaccatgttgaccaggctggtctggaactcctgacctcaagtgatccacctgcctcagcctcccaaagtgatgggattacaggcatgggccaccacgcctggccaaatttgtctttttaaataattgtggttattgctttattcatttgtttattgctttatgaagcccttcttaactcaagattataaatcatttttctgtattttcttttcatactcttcttatagctttgttttttctgttgagtttcaaaattttgagttcattttttatgaaataagaatctacatttaaaaaaattaatggccaggtgtggtggctcatgcctgtaatcccagcactttgggagggccaaggcaggcggatcatgaggtcaggagatcgagaccatcctggctaacacagtgaaaccccgtctctactaaaaatataaaaaattagccaggcgtgatggcgggcgcctgtagtcccagctactcaggaggctgaggcaggagaatggcatgaacccaggaggcggagcttgcagtgagccgagattgtgccactgcactccagcctgggcgacagagcgactccgtctcaaaataaataaataaataaataaataaataaataaataaatacaaattaatgtatagtcagttgttctggcaccacttattactagcactttcctccccactgattttaaatgtctttaactaaactctatagttgagtgcatttctgaactgtttattctgttctattggtctgtttgtctattcctgccccctaccacacttttaaaatcactgaagctttgtagcatcttttggtgtctgccagtggagaatccccaccctaacattattctttaaaaaaatcctcagttggccgggtgtggtggctcatacctgtaatcccagtactttgggaggctgaggcaggtggatcgcttgaggccaggagttccagaccagcctgagcaacatggcaaaatcccgtctctactaaaaatacaaaaaattagctgggcgtggtagcacgtgcatataatcctagctacttgagaggctgaggtgggagaatcacctgagcctgggaggtcgaggctgctgtgagccatgtttgtgccactacactccagtgtgggcagcaggagtgagaccctgtatcaaaaaacaaaaacctgagttcatcttcattttctcttctggataaatattttcatatattttgagatttattctgttatgttaaataaattaataccaataatgatacttatagattttcttttttttcttctttttttaaggccttacctatgagaaactaaatcggctagatgaggctttggactgtttcctgaaacttcacgcaatcctacgaaacagtgccgaagttctttaccagatagcaaatatgtatcttatttgaaaaccttagggacagttattaattctctcaattggtgattgaagatcaattattaaataagtttaactaatgaagtaattgatgaggataatatttgaagtaagtgatgaggataatctggcagattattgtgtgataaatatcatttgagtaatcctattttaagatgtagtttgcatcgaaagaggaattaatggttaaaactattatttattaaattttgaaaataactgaagtaattaggacattttcggtacatataagccattcattgaaagtcaatttggtgctttagaacgttgtattaattctgaagcttgtagggtatcattgaagcactaacttactaaataaaatactgtttattactgattactattgattgaatttggataatttttcttacttttttagctggcctgtagatataatgaggtctccaaagactgttaccctctaaaattatgtaattcttcatatgaactcattcattctgttcatttaatagtcatttattgaatgtatactatgtgtatcagtattatgtttcaaactcaggggaatgtagaactacaaaatgttgcgctaatatcagtttcttccacaacacttagctttcttaataagccctgctcttggttagaaaagcagaaatgtgttaatgtttttaatgcttttcatgctatttgaaaagcacttttaatttctctccttattttggtaagctttggccacaacattgggaagagttaaacatcttaggtagattttcaacttactgttatcttggtttaaattttatacaaatatgtttagaaaattttatatgttgtgaggtgtaccattaataattttaagtactatctgctgtacttttgataaagaattttattgaaaaattttagttttaggccaggcacagtagctcacacctgtaatcccagcactttgggaggccaaggcaggcggatcatttgaagtcaggagttcgagaccagcctggccatcatggtgaaaccccatctctactaaaaatacaaaaattagccgggtgttgtggcaggcacctgtaatcccagttactcccgaggctgaggcaggagaatcacttgaacctgggaggcagaggttgcagtgagccaagatagtgccactgtactccagcctaggtgcagagctagactatctcaaaaaaaaattagttttagagcagatagcatcatagttactcctgttagtctttttgttctgttttgttcatttaatttctctgaaactgccagtgtcattatcttttaccacccagttcatgatcagcttggatccagtcaagcaactgatgtatttgagactgtttgagtacattttcttatttttttttcttgtggtatcacacttgtcatcgttaaaaacagtagatcttctggtgtcactcttgtcaccattgaaaacaatgcttctttttcaataaactttgaattggaatattttcatttcactgagatatctaatatgtataaaataaatagtaattaatcaaaaagtactgatatgaataaattatttgtatatacaccgaagacttagtaggtactaaaaggaagctacaaaaaaaaaaaaaacaacactgtccttgggtttataatctaattagggaaaactcacaggaaaaacacatggaaataatttccttaatatgctgaacatgttaagaaaaagaataactggatgcaacattcaggacatttttattaaggacaatttttggacaatactttgaataattctaccagaaatttgggagttgatcttagtggatagtaatggaggaaaagggaaagcaggctatatacatagggagcaagagtgttacctccacagtactgctgcattccatctccacccctgagatatccagaggaaacagtatacaatagcacattactgtaggctaagaaatattgttactgtaatgttttttaagtttgcttattgcttaatgaatttagaaaacatgttttccttaactgacattgcataagatatgaattaatggaaaatcccagtcaagctattgaatggctaatgcaggtggtcagtgttattccaaccgatcctcaagttttatctaagctaggagaattatatgatcgtgaaggagataaatctcaagcatttcaatattactatgaggtaggtgtgttatcttaatttccttctgtgttttagcattttatgaattgttataaagaaggcagcaaggctttaaaattttagaagatcttaccagttttaaaatgatttatttaaaataaagcattcttggaaaatgaagttagtttttgttttgttttgttttgagatagagtcttgctctgtcgcccaggctgctgcacagtggtgcagtctcggctcactgcagcctcctcctcctgggtttaagcaattctcttgcctcagccttccgagtagctgggattacaggcgcctgccaccacgtgcagctaatttttgtatttttagtagaggggtgttttgccatcttggccaggccagtctcgaactcctgacctcaggtgatctgcctgcctcagcctcccaaagtgctgggattactaccacgccaggcctgaagttagttttttacttgttttaatgaaaaaatgaaatagggctgggcatggtggctcacgtctataatcccagcactttgggagaccagagtgagaggattgcttaagaccaagagatgaagaacagcctaggcaacataacaagaccccatctctacaaataataataaaaggacagtcctggtggcccatacctttaatcccagcactttgggaggccaaggaaggcagattacttgaggccaggagtatgtgaccagcctggccaacatgaggaaaccccctctctactaaaaacacaaaaattagccaaatgtggttgtggcatgcctgtaatcctagctacttaggagactaaggcacgagaattgcctgaacctgggaggcagaggttgtagtgagccaagatcgcatttactacactccaggctgggtgacagagcgagactgtcttaaaataataataattaataatattaataataaaaagaagtaccagttcatttttctcttgaggcacgatttgcatctcttttttattcttttaaatatttaaattggactcagctcatatattgttatatcaaaagtatagataattgaaaagtgtgtcaagcaaagcttaggttttctaaatattatatagtttcagaatttacaaagtacttaggacagttcatactcctttattaagaaattccatattggataaatttattcaataggtaaagtattcaagaagtaaattatatgttgccattgaagttgtattgttacattccatatttgttttacagtcatataggtattttccttgtaatattgaagtcattgagtggcttggagcctattacattgacacccaattttgggaaaaagctattcagtactttgaaagagcttctcttatacagtaagtaatcattaggattttatgtttagttaatgtcatgtcttgagtttttttaatccctagaattagtatctgatagacctagtaaattcaagaacagatgttgatggacattcataaattatttttgtttgtttgttgtttgtttgagacggagtttcgctcttgttgcccaggttgaagtgcaatggcgtgatctcggctcactgcaacctccgcctcccaggttcaagcgattctcctgcctcagcctcctgagtagctgggattacagtcacgcaccaccatgcctggctaattttttgtatttaagtaaagacagggttacaccatgttggccaggctggtctcgaactcctgacctcaggtgatccacctgcctcagcctcccaaagtgctgggattacaggcatgagccaccgcgcccagccaaattatttttattttcttatattttattccattttacttggtctttattgtgataaatatatttccctttgcatagaattttttaaatatcctctttaagatacttttctttatgtatttttcttacacctcagcaaacaattattgttcctttatcaatcagaaaatgacttatctcagtcctaggacaaagtttcatctctaaaagagtcttaatacaagacagttttgttggtttcaatttataattaatatatatgaaaaattaaaatgttttcagtgtctttaagttcgtatcagaatgtgttatacatatctgattcaaaacaattcaaaaataattggaatacatcatcttctgctttgtatttggccatattgaattttaagaacaaatgccccttagaataatttgaatgataaagaaatgcttaataagtgaaatgatttctgtttggaatttctattaggcaattcattttgtgatatttatttcacataaatttcttttgagaattataaaattaattaccaaggatgaggagatagttttagtttaattatatctttaagattaaagctatttcagtaatacactgtaagctttttaattacacttaatactactctaacattagccattagctcatgcaacactcttccttctttgaggctcagtccgccactgttccatttttaactcctatttgtaaatgtcagatgttgattaacagtcagtcccttaccttacctagtctagcttatattcttccttttctttccatcactattctagtcccacaagttttgacctccctaactccattgatctttaccctctctgtagttcagtcacctgactcatctgattgtgattatcactaacacatttacaccaataaaatctttttttttttttttttgagacagaggacggagtcttgctttgtcgcccaggctggagtgcagtggcgtgatcccggctcactgcaacctctgcttcccaggtttaagcgattctcctgcctcagcctccagagtagctgggattacaggcacatgccactgcacccggctaatttttgtttttgtttttgttttagtagaaacggagtttcaccatgttggtgaggctggtcttgaactcctgacctcaagtgatccattcgcctcagcctcccaaagtgctgggattacaggcgtgagacaccacgcccagcctacaccaataaaatcttaagttacaatgtccagctgtctgaacataacctcttacctttccaacttccatactccctattttccagtgcatttttctttggtgatattgagacctcccctcttgaccttccccttatcttgcagtctcagcctccttctgactttaattctgagcttatccatactagattgcttaattggtcacatcttttccctttcttgctaacattcctgtttttttttttctctctctctcttgctttactaccccatttattccaagagatttcagttcttaggttattccagccattgattccattcctttacacaggctgtgaaatactgtcaaaggtaaattatgtaaccaggtgaattgatgctacacaaatctgtgtgatatgagcactgctcatcagtcttaagtatttctctccctcctgtttctctgatctcttcaattcccctatgtattttatgcctcggtttcccagaatatagaagccttttttagaaaccttcctaacatttctctctacttttctataaacttacttccacttgcacctgctgttatctccttctcagtgacagaaacttattcaatatacattcattatattacatctcttttgagcatttgttttctataccatatatcttaatttttcacattttctcttttttacatgctaagctttgatttgttctgtaagttctacctctacaataaaaatgtaggctttttgagaagtgagagtattagttcttatgtcacatagttctttacatattctttaaatattctttacatgtcaacttggcatatagttgaattaaattaaatttctttaccatagaaactccttgccttgctgtatctcttagatttttatggtttttaataatatgatgttttggcaattggtttaagcataaactgttgttttattttctttacattcataaatcatgtcttaaaatatcaagaaatcctagttctgactggtccacttaatgtaattccattcttcagcagcattaggtaatgttctttaatattgattgtgatgatggttattataagacaccatcaagtggaccaatatatgcattatgggaattccaaaaggggaagagagaggaaaagggaggagagagactatttgaagaaattattgccatacttcccaaatttgaggaaagacatgaatccagaagtctgcacaggccagtgaattctatgtaggaaaaacactaaaagatccacaatgagacacattatgatcaaactgtccaaaaacaaagagagaatctcgacagcaacaagagaaaagtggcttatcacatacagggaccctcagtaagattattagtagatttctcaccagaaaccttggaggccagaaagcaatggaatgatgtaaagtcctgaaatttaaaagcaaacaaacaaacaaacaaaacacaaactgtcaaccaaggattctgtatcctggccaagcgtgatggcttatacctgtaatcccagcactttggaggcccaggcaggcagatcacctgaggtcaggagttcaagaccagcctgtccatcatggccaagctctgtctctactgaaaatacaaaaattagctgggtgtggtggcaggtgcctatagtcccagctactcaggaggctgaggcatgagaatcgcttgaacccgggaggcggaggttgcagtgagcagagatcgcaccactgcactccagcctgggtgacagagcgagactccatctcaataagtaaataaataaataaaataagtttgtattgttcaagtgagattgttataagtttcagatgttaattataatacccaaggtaatcattaggaaaataactaagaaatcaaatagtacactataaaaaagtattaggaaaataactaaaaatcgaaatagtacactaaaaaaaatcaacaaaataccaaaaaagagtagtaatggaagaattgaggaagaaaaaacatataacacatgcagaaaacaaatagcagaagcaaatccttctgtgtcaataatcacattaaatataaatttattaaactttcccattaaaagaaaaacttagcagattgaataagaaaatcagggtctatttatatactgtctacaagagatgcactttagatacaaggacacaaaagaggttgaaagcaaaaggattgaaaaagatattccaaacaaatattaatggtaaccagaagagagttgggaggctttattattgtcagacaaaacaggctttaagtcacaaaaggttacaagagccaaagaatgatgctatatattggtaaaaggttcgttactgcaagaatgtacaacacttaaaaacccaacagaggagccccaaaatatatgaagcaaaaattgatataattaaagggtgaaatagacctcatattagtttgagacttaatacttttaaaaatgtgtgttaccgtctgtgaacctcacacggaagataaataagaaaattaagacttaagcaatgtataaaccaggtagacctaacagtcatacacaagacactgaacccaacaacaggagattgtacattcttaagtgtacatggaacgttctccaggataaaccataggttaggccacaacttaataaattgaaaagattgaactcatacaaattatctttttctgtcataatgtaatgaaactagaaattaataacagaaggaaaactggaaaattcacaagtatgtggaattaaagaacacactcttaactagtggatcaaatatgaaatcaccagggaagttagaaagtaactgagacaagtgaaaatgaaacacaatgtactaaaacttacaagatgctgcaaaagcatccctaagagggaaatttatatctgtaagtacattaaagaagaagaaagatcccaagttagtaacctaactaaacaccttaaggaattagaaaaggaagagcactttaaacccaaagatagcagcaggaaggaaataataaaggttagagcagagataaataaaatagagaatagaaaagctgtagagaaaatcaacaaaaccaaaaattgattctttgaaaagctcaacaaaattgacaaatctctagctagaaggactaacaaaaaaaagaggacttaattactaagattagaaatgcaagtagaggcctcactaccaattttacgtaaataaaaagttataagaaaacaaccttgcctcaacaaattagataacctagataaaatggtcaaatttgtagaaacacaatcaaccaaacccaactcaagaagaaataaaaatctgcatagacctataaccagtaaggaaattaaatcagtaataaaaaatattccaagaaagaaaagccatgggctacatggattcactggtgaattctgccagacatttcaagaaaaattcacaccattttttttcaaactctcctaaatattgaagagaaggtaaacacttcctaactcagtcagtgaggccagcattatccttatcctaaaggtaaacaaagacactacaagaaaactacagaccaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagtttgaaaaaaaatggtgtgaatttttcttgaaatgtctggcagaattcaccagtgaatccatgtagcccatggcttttctttcttggaatattttttattactgatttaatttccttactggttataggtctatgcagatttttatttcttcttgagttgggtttggttgattgtgtttctacaaatttgaccattttatctaggttatctaatttgttgaggcaaggttgttttcttataactttttatttacgtaaaattggtagtgaggcctctacttgcatttctaatcttagtaattaagtcctcttttttttgttagtccttctagctagagatttgtcaattttgttgagcttttcaaagaatcaatttttggttgtgttgattttccctcagctttcagtttatgatagtcaaaagtagcctcagcattatttatagtagcgaaaaggtagaaacaacctaggtgtccatcaacaatgaataaacaaaacatggtacagtagtccacctttatacaatgttttgctgtccacggtttcagttaccctcagtaaagtacaataagacattttgagagagacagaccgcatctacataattctattatagtatattgctttattttattagttattattattaacctcttaccatgcctaaggtataaattgaactttatcataggtatgtttgtataggaaaaaaaatagtatatatagggttcagtagtatttgtagtttcaggtatccactggtgatcttggaacatactcaccacagataaggggggaccacagtatataaataaaatggaatattattccactatacaaaggaagttctgttacatgctacaacatggaaggactttaaaaacattagctaagtgaaagaagccagacacaaaagaacaaatactccacttacatgaagtgtctaaaatgggcaaatttgtagagatagaaagtagatcagaagttattggggattgtggggaagggaattaagagttactgtttaatggttgcagagtgtttctgtttggtgtcataaaatgttttggagatcgtggtgatggttgcacaacattgtgaatgtgataaatgccactgaattgtacacccaagaatggtaaattttggcaaatgttatgttgtatatattttatcataattttaaagaattaatacactaaaaccattgtattgtgtcctttaagtaggtaaattgtatggtatatgaagactatctcagtaattcagctcttaataaaaggatacatactgccaggtgcagtggctcatgcctgtaattccagcactttgggaggatgagacaggcggatcgcttgacctcaagagtttgaaactagcctgggcaacatggcaaaactctctttaaaaaaaaataaaaactagcctgccatggcagtgtgtgccagtggtcccagctacttgggaggctgagcccgggaaggggaggttacagtgagctgagatcatgccactgcacttcaatctgggtgacagactgggaccctgtctgaaaaaaaaaaaaagttacatactatatgattgtattcatttaaagttcaaaaacaggctagattgacagtattagaagtcattatacttacctttatagaggaaggaaggtaatgtattcagaaacataaataataataccacatggtaaatgcaacactaagtgattctagggtgttaggagagcatatggaacagtctatccatgtggcattagcagagagtaaagaggttggaatgcgcctctaagcagacatggtggtgtatacaaaagccagaagtctagcaaatgcaggggatacagggaagtccgtgctcctgtgtgaatttgctgtaacatgaaatgttaagcaaggcacggtgggagatgagttggagaagcagaaaagatctagaaagtagataaactgggttagaatcttggatttagcatgtaggtggaagggaggtaacaggttttaaggagggaagtaatgtggttagatgtgtattttatttagatcacagtgggtggccgtgtaggcaatggatttgaagttaagtaacttgccccagtagcagggctgtgatttaaagccagatctatctgattccagtaggtaggtttgccatcaaatcgagtaggaactgaggttttctttgaagccatcaggcttctacttagaaaggagattcaaaaaaatgagacgagcataaattgttccctaggtgtttcttccttcatatcttgccatcctgagatatttttaatagaagtatttagaaatcctggttttggttatttattttagaaaagaatttgatttctttttaatggacaaaaagggattagtagaattttttttactctctgtttagtcgaagcctgattcttcaaacactagatcaaaaatcgcttctcagatactaaatttgcaagcaagtgtaagtattatgataaaagattatagcaaaagtaatgatcctttaagtttaaagtagaatgcagtgggttttaaccaaacaggttaagtggttctcatatgaatatctaaataaaggtatgaactagaggaactttgaagaacacttaaatttatatgtcctgatataaatatgacaagcaatactgagggaaattatatatctgctgttctcaataataaaaattatctaacaaaaggtcaaaaagtaattgtaaaatagtagatacatagctttataaaactgagcatcacagatttttttatctctaatttcatctcatttatttattttataggcctacacaagtgaaatggcagctgatggtagctagttgtttcagaagaagtggtaaatgctttagttttattcattttatagatattttgcttctttccttttaggtaattatgcatataaatgtgatccagttgcatatctgtttattaaaatactaactttttataactgtacataattcaaagcattgtatgaaaaacacaataattactacatacaaaaaagttatgcttacaaaatgggtattaatcatgtattccaatacttgtcttaaaaacagatttgttatttctcaaagttaacatgtaatcattttcacaagttagccacagaaaaaaataggcatactgtatacattatatttccattttctactcagttaattctaaatgtcctgtgtgctcggccaaatttatgacacttgagaagcctgagaaaagctcacactgagacaagtgtgactatatgttttttataccaaagatcactggctatcttggtttgtgtttttgttactgcttttattaaattcttgctgatgacacatatcctgaaggatagagatgctattagttttaggctaactgtgaagtgaataatatgcataaaatatcaaagatcaagctgggagagaaatgtgaacaaatttataatccctcttgtagagcataaaaatgacccaggaaaagaaagtattcaatctaagggaagagggaagcacaagttttgaaagtgttggcagtttgttctcacccagtttcgggggaggtttccttctttatctctgtgagcaccttcagaatggcatcagaaatgttttaatacataactcagtgtattcctcaaatcattttaggggggatctgtaattcctattgaatgtacaacatgactatactatatacattcaatttatatcaacatgagttctcaattgcctatgttcatttcaacgtcagtcatatagaaagtatatatatacatatgaactattctaaatgatttaaagacatagcctgcttcagttatggaagtacaggatagaagcagcagctagcattgagaactggctttgggtcagatgcttcctgtctctatttcatccctcttgtagagagaggcccagagagatttataactcatttgctaagattttaggaaagatctttgacccaaattcgtttttcctattttggctgctacatgaagctaaattattttgttataaaataaattgctttctataaactttctaatgtttaaaaaactgtaaaggccggacacagtggctcacgcctgtaattccagcactttgggaggctgaggctggcagatcacgaggtcaagagatcgagaccatcctggccaacatggtgaaaccccatctctactaataatacaaaaattagctgggcttggtggtgcacgcctgtagtcccatctactcgggaggctgaggcaggagaatcacgtgaagccaggaggcgaaggttggaggttgcagtgagccgagattgcgccactgcactcactccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgttgcccaggctggtctcaaactcctggcctcaagtggtccacccacctcagcctcccaaaatgctgggattaaaggagtgagccaccacgcccagcccaaaaaaactataaaaacatcttaaatattttccaactaaatgaatgacattgacattactgtaagtatataacttagattatttttaaatttgtcagttcatctggaataatcttttttagaaaattgaatggatcttaatttttgccactaaaatatttaaagtgaaccaggctcagcaatgtgcgtctatagtcccagctactctggaggctaagacacgaggattgtttcagctcaggagtttataggctgtagtacttaatggttgtgcctgtgaatagccactgtactccagcctgggcaacagagtgagacctcgtctctttaaaaaaaaaaaaaaaaaaaaaaagggaagaagctaaatttcagctatcacccatttacttctgctttcagccttatttcaaatttattttatctatacattttcttctaaaagttatattaagtggtatataaaacatgaaacctttctattaaaccattaaatagccagtatatcagttaaaattaatatttttctgaatcctgttagtttctataatttgctaatatatttttctcttgtttgtttataggtaactaccaaaaagcattagatacttacaaagatactcacagaaaatttccagaaaatgtcgaatgtaagtggcattacataatgtaactttgaagtgataagttctcatattttatgttctaatatataattacctttgctacagtaattgtatacgtaaataccaacctataatttgtgatacatattttaaatatttttatagcatcagaaaatttgactatgcaagtacatatttttatgtaactaattgttgatggatttaaatataccacagaattttctttaatactaaaaaaatacatatttcagagttctatagaattttaagaaagcattttggcctatggttgatttttcaaagtttgtaaacctgtggtattttataggaaagacatttttaactgtccattttagtaaacaacttctaaaggttgagaaaataattttagggtttataaaaattgaacattaataatcttgctgatacaatagcaaataatttttttttagacagagtcttgctctgttgcccaggctagagtgcagtggtgtgatctcagctcaccacaacctccacctcctgagttcaagtgattctcctgcctcagcctccctagtagctgggactctaggcgcgcaccaccgtgcctggctaatttttgtatttttagtagagacgggttttactatgttggccaggctgttctcaaactcctgacgttgtgatccgcctaccttggcttcccaaagtgctgggattacaggcgtgagccactgctcctggcggcaaataatttttaatgttacttcaattttaaaacattatgttaatatgctgcgtactcagttgtaaagttatctttgtagaagatattcatttatttactatcttgttgcacagtggattgatgcaacttacagtaataatgtgaagtattatggcagtaacaacaaaatcaagaaaaacataaagtaagcacagtcatatgccacatgttctcactaaactataaatttgtccctgaatagccttgcagccaaaggaaagagaaaagttacaagcagttgtacaatttttactgttttatgtggaaatataaagcaatttattgggaagaagaagtatctcttcaactcttaattcacttctgtttagacattgagagatacagtagataaaatcattgaaagacacagtagatactttcttaaataacatccctatagcaaataaaataatatgctggaaacgaccatgttaaaatttgttcttcaaggctgggcacagtggctcacgcctgtaatcccagcactttgggaggctgaggtgggcagatcacctgaggtcaggagttgaagaccagcctggccaatagagcgagattctgtctcaaaataaataaataaataaataaataaataaataaatttgttcttcaatgacaatgaacacaaaagaatgcattacaatttagtaaaaacaaatcttttctgagccaagttttctaatggccaaggattagatgtactacgtgtttcttcattaatatatttctccatttggctttctaaaaaagctcaacagcagttagctcagttatggtctttggtaggagtgtaggagcagggtgttctccaatgctgattagaagtagactcattaacttaacagcagtagttttcacaaataccagtcaggaaataggctacatgggaattaattctagaatttttttttttttttgagatggagttttcttcttgtctcctaggctggagtgcggtggcgccatcttggctcactgcaacctctgcctcctgggttgaagagattctcctgcttcagtgtccctagtagttgggattacaggcacatgccaccaatgcccagctaatttttgtttttagtagagacgggggctctactaaaaacaaaatcactcttcaagcgattctcttgcttcagcctcccaaattgctaggattgcaggtgtgagccaccatgcccggcctagaacttttttaaagtacaaatttctagccctacctagaaagattttcatttagatttacagtggatgcaggcgtctgttttttcctatttctgtttaaagaactttctatgtgattcttaatctcagtcacattagagaactagtgctttagagattaaatgagagatagcagtaataacttttcttgaaagtggaacaacccaaaagtctgctaggcaagagtttctcggccttggcacctttgacatttgggattgtgcaattccacattgtgggaggccatccaggggattatggaatgtttggtaaaatccctggcctctgtccaatagattagctagtagctctctcacccctagatatgaaaaccagaaatgtctctagacattgccagtgtcccttgggggtgcaaaattgatgccagttgagaactcttgaagtaaccatagcacctctgcactggaccggaaaagcgaatgtcttcaaggaaggccaggtttttttctttagagtatgagtcactctaagaatcaaatgaatgattgtctatgccatagagggtgtctaagataactttggcctatttaattttcaaaacaaatgtaatcaatagtctaccttaactgtagttgtagaaaaaacatttacacccatggaatgtgctgttttaagaagactagttttctggataaaactagcaggataatttagttttaaaacatattcttcaccaaaaattgacctgctttacagagttacagatgatgtactaaatttcagagaacatccaccaaaaataatgatttttactttacattaagtgtttctggctgtgcgtgatggctcatgtctgtaatctccacactttgggacaccaaggccggaggattgcttgagcccaggaattcaagaacagcctgggaaacatggcaagacctcaactcttctaaatatgaaaaaaatatcagggcatggtggtgtgcatctatagttccacctgctcgggaggctgagacggaaggatcgcttgaacccaggagttccaaactgcagtgagctgtgattgtgccagtgcactccagcctgggcatctctaaatctcttaaaaaaaaaaaattcctaagccaatctttatttgcagaaagtacaaattaccttcttattctgaattattaatataaatgtatatgcaaatgcaatttttatagtaatgtgtgacattttaagttactttatactattaacttttacaatactttatggtcttttttttttttgagacacagtctcactctgtcacccaggctagagtgcagtggtgcgatctcggctcactgcaacctctgctgtccaggttcaagtgattctcctgcctcagcctcccaagtagctgggattacaggtgcctgccaccatgcccagctaatttttgtagttttagtagggatggggtttcaccatcttggccaggctggtcttgaactcctgacctcatgatctgcccgcctcagcctcccaaagtgctgggattacaggcgtgagccaccgcgcctggtctactttaatggtcttaaattgctggtatatttacaaattattgtggagtggagtgactattctgttccagacgttgttctagcactgtggatgtagcagaaaacaaaagagaccaaaatccttgatgtcgtggaacttgtttctagtgggaaaagacaataaacaaataatgtcagtagttataagtgctatgaaggcaaaacaggtaaggagctagagaatgtgggaggggctggtatttgagacagggttgtcatggaacggctttctgttaaattagcatttgagcagagacctgaaagaatagacagaagcaagccatgacgatatggaggtcaatgtggttgaagcacagtggacgatgtgatggggagagagaggcagagtgggtgggccaggacctgtggatcctcacaggccttaggtcagggcttcaaattatatttctggggagatgatgagccattggaggattttgtgtggaagaataatacaatttgacatatgttttcaaaaggttctaaagtgtgattaactcaagcttctgtacctgaggtccaaatcaaaagattgttttggctgctgtatggagaataagctggagtgggcagtaccgaaatgcaaaatcacagtattcacttggactaatgatttagcagtggaggtgggcaggatggattctgaatatgtatcaaaggtatcagtgccagcacttgctggccatttagatgtgagacttgagggagagagtgtcaagggtaattgcacaaatatagctctgggagctggaaggatgccatccactgagatgtaggaaactggggaagaagcagcttttggagggaaaaatcaaaacctttttttagatatgttgtgtttgagctaccttttcgatgtccaagaggatgtattaaataggcacttagggagaagttgggggccatcttcatataaatttatttcagtatatttagcacatatttttgtgctctgttattatatatattatcagtaatacttttgaaaaaatggagtgttcactagctttaagactttcctgtttctttatccattcatttgttccccagaacttttaccaactattttttatgtgctggggatacaacagatatatcaacttgatttctgcctcctaggactcacaaatagttaactgatataggttaataaatgagataactgaaaaatgtgcaaagtgctgtcaaaatacagaggatctcttaactctgcccaaactaggggacgattgacataattaggttttacagaggaagtaacatttgaagtggccttgaagggtacggagggttttaccaggaaggaaaggcaggaacaggcactgcaggtagacagtagcattagtaagggcagagttagagggatgcagagtctatttcaaaaggtagtctattgtggaaaatgtagcagattgaagatgtgttttcttatactacaaaccaaaaaaagacagtttataaaaactataaatgcggctgggtgcggtggcacacgcctgtaatcccagcactttgggaggccaagacgggcgaatcacgagccaggagttcaagaccagcctgaccaacatgaggaaacccttgtctctactaaaaatacaaaaaattagctgggcatagtggtgggcacctgtgatcccagctactcaggaggctgaggcaggagaattgcttgaacccaggaggcagaggttgcagtgagctgatattgcgccagtgcactccagcccaggtgacagagcaagactccatcttaaaaaaaaaaaaaaattataaatgtacaagaacaaagagataattaaattttaggaatgttttctgcttagcagattagaagaactgcagaggtatgtaggtagtggagacgtcagcagaagcaaaacaattcttgacatagaaccccaggaaatcccgggaattggaggcatcagaaaatgggaggggtgctggctgcttctgaaaacaggagggttggctgcaagtctggatgtgatacagctagattttcaaatgccctacctaaatcgtacagcaggaatttaggcagaatgcaatgatgttgttggtggatgatgtcgggagatgtatttgaaagatatttaatagagccaaaatgattaattctgggacgaagcttccagaagaaggatcaggcagcaatatttgctgttctgcagcctctgctggtgatacccaggcaaacaggttctggagtagacctccagcaaactctaacagacctgcagctgaggggcttgtctgttagaaggaagactaaaaaacagaaaggaatagcatcaacatcaacaaaaaggatacccacaaaaaaaaaaggcctaccgaccaaaaaaagtccaggaccagacagattcacagccaaattctaccagaggtgcaaagaggagctggtaccattccttctgaaactattccagtcaatagaaaaagagggaatactccctaactcattttatgaggccagcatcatcctgataccaaagccacacagagacacaacaaaaaaagagaattttagaccaatatccctgatgaacatctatgtctctggaaggatgagtaatgagtaacttttattttttgttttttacctttgtatgttttacaaattctctataatgacctgcattgcagttgtattgaaggaaaatattatttttaaatgagataataaaaatattttaaagtaatttagaccacaaatggcaaaggccattcttacaaatgtaaagacaaaattattgtgttttttagcatctattgcatgtttttaaaatgttgctaattttagaaacacaagcttgaatgaaaaagcaaattccaggagactgtatacagaacaataccatttttataagacccaatagcaagcagaactaaacaatatgtcatctggtgatatgtataaagtgatcgaagattttgttgttgttattgtatacaagacatgattaacacaaaactttttattgtgattattttgtatatatttgatgtcaactgtaagaccagccactgtaaaatacatcttttttatcttcctagtgctttgcacagtgtgaataatacttactttaaaaatgaatttactgacagtaataacattagtaatgattattatatgtataaactgtctacactttttagcctagtctctcttatagctctttatatgtatttatgaaactgctatagaacattaacaaatgttacatttgccttctaagttctctgccagcagtgtcctgtgccatgttccttctaggttctggcagcgtgaggacaggacacatggagagagaccctttaaacctccttccaaggaagtcagttctccctggtccagagattgcaaagtgtaattatttttcaggagaaaaatactatttgtaagcatcattcctacctgtatcccaaaagactgagttcactgatttattgagcttttaacaaatatactgtgcctatattctttcctaaatgtatattttacaatttaggtctgcgtttcttagttcgtctctgcacagatcttggattaaaagatgctcaagaatatgccagaaaactgaagaggttggaaaaaatgaaagaaataagggaacaggtatctcatatgggccccaaactgcagtctgttaatttttagaatgtcagccttctatagctcaaatgtgtgatgttaggagcttctataagaaaacagagttgaaatttttttctgctctgacataataggaggaataactaaaactctagtttgaggataaaattctggcaaaagtggattcccagggagaggaagtgcaatagatttcatattatcttagtggatagctactaacagacaaataattataattttccacaacatgaaatagcttacaggttaatttgaagacataattttaattggaaagtcctgtggaccatgagagacagttacttctctgcaacaatggaatctgtgagtgtgtgctttaacaagttttctaggtgatttttattgtcgccaaagtttgagaagcactcaggctttatgctccttgaagggttaccttgatcaaataccaactcaggatatagaagctaatttaagaggtgaaaaagtagacataaaatatatcaggcagtggattttcttaaattgttttaaaatggaaaaagatttgtataaacttaagagaggaacataaaccaattcaggtttatgtgggtcagggtaatttctcttgctgattccctaactcctgttttaaaatgttaaaactagaagttttatctaaaatgatttttcagagaaactagtcctctttctggaactattatggaaaggaagactgttctcttttttgtgcttgggggaatccacatttttgggtaagaagaaaacattgtacattgtacattgtacattcattagtgccagcaagaagcaattgtggcactgggttgttggccaggcaagacagactcactctcagccctccattcctgaacactgtgagccccataatggtgtggaccagcccctggaaactgtaagccatgtagcagtgctgttttttaaaagatgttttgcttttctgcttcactgaacatgaaaaacattagcagacaaacaaagaggtctgtcaaagcaagagtgtatgtttggaatagagcaaaatgggaagagcagggcttgaggaatgaatattttaaatatgaaaaaggaagagaaaaacagccaaaacaccaaaaaggttggagaataaaggtaaactattaagaagaaaaagaaaataaagaaataatagagactgggcacggtggctcacgcctataatcccagcactttgggaggccaaggtgggcagatcacgaggtcaggagatcgagaccatcctggctaacacactgaaactctgtctctactaaaaatacaaaaaattagccaggcgtggtggagggcacctgtagtcccagctacttgggaggctgaggcaggagaatggcatgaacctgggaggcggagcttgcagtgagctgagatcctgccactgcactccagcctgggcaacagagcgacactccgtctcaaaaaaaaaaaaagacaaaaatgcagaatattttcattgctagtctaaagataaaaatatattcaatttttaaatcaaatttctaaattttcagactattcaaatacagaaatgctgtttcaatatttgccagttttcccccaaagtaatcaggaaacaatgccaagaaatgctttcttttggccagattgacaaaatagcatgtgacattcaaaattaatatatcattggtacatatacccaaatttccagttattaccaaaatgcaatgaaaataaatgtatagtcaagttgagcagaaacccttttggttatatttcttaaaaggagagagatccagtattaagatcccatatttagctttaaaattaaccaaactaaaaaatgcaatttttaaaaaattctatatgtgtaataatggctttaagaatgtcttgtacaatttatatattattgacaaaagtcaacaaaactactgaacagaatatatccttagtacaaaactgatggtgatttgcatgttgattacattttctaggttaagatcaccagtcatttctttaaggccattgatttcagatactctcatgcattgccctgtgttagcctctctgttgtttcgctcagaaaacattgattatgatctgccgtgcatatggaggacacagtgagggacaagagttggccctggtgcctgaggcactctaggcagagctgtgggaccgagaggggaaggtctttgctccgagaggaggtactcagaggcagttcccagacgggcttgtgtttggagtgggcatgattggacacttggagtttggggtggagagaaaaaaatgtgggcagaggtctgaggacaggaagttaaggccacgtttatgggtcctttggaattgaagccactaaggaatgtttttaattttgttttctcttgaatttacggtcagccagtcttcttaagaacccttaactacgtaacaagtaactgctccttgttccatagaaccgaaacccaattcttaggaagtaaatgcgtagtatggtggacagaaccccgtacttttttcctgacatgaccattggtcaaccgtgtgatctggaatggatgtttacctttctggacttcattcttatcagctgtaaaatgaggatagcgttctagctttgaacttctcaaactatctgtggtgaaattattttttgccagtctgtcactgacattactagaaaaatgatcctgcacttggatgtcagcagggtccgacatccagcaacattttgatgctgtgcaagtttgtaagcacttgccctctgttcatctcattgaggacaggtggcagtttgtgggccatcagtggtttccagaccccactctgggtggcccatcctggataacccataggacccaccagctcataatggttcttccagtccccggaagagtagcatgcgagtttatggtcacagattcataataaagagtaggtttaaagggaaaaaatgtttattttctctcttccagcatttattcacttaatttgttcacttattttatttgtggctactttgctcctctattctgtgccttctctcattttttttccagagtgggaatgacataatattttttccaggttaggaatcccatcttttttccctattatgaaaacaataaatgttcttttaaaaatgcaggaaaattgcttttgtaaataatttttaatccaaataaaaatatataaagaaaaaagtgaaaatcacctatcccaccacttagacatcactgttatcattcccctttcccaggcatttttacaaatatatacaaacatatatcaacacatatatttttaaatgggactttttttaaaacacaaatgagatttttacaaaaaatactgttttataacctctcccacccacttcgcaaaataacatggaccacttcccatgtcagtaaatacagatttccgtcactttgtgctccatattttgttacatggctgtttcctgcacatcttagcgttgaagtgataagaatcatttatgtcaatcattgtttaaatgcttcctctcttacctaccatgaggccttatctcacatccactccaaagtgataagaatttctgtgaactttatgaagtgttaaaactctggaaggatgaggggaataattctgaaaagtgtgtctcctacttgagccctcatataccatatgatgagaatgtcgtcttcactatgtttacaagtgtttactgtgctcctaaaatgtacccatgcctgtgctagatctgaggtgggttgcatgtcagatgagtctgtgtgagacaggaccctcgggcccctgagagtgtgggcaggaattccctgcccagtgtccctgaggagcagcagtgcccacagcccagggtgttccccgtggagttggggagcttaagctgcaggccctcatttgcattgcctctaataaatttttatttttgcattcatttcattttcacagttttttgtttttgttttcttttttgtatttttttttttttagtagaggcagggtttcaccatgttggtcaggctggtcttgaactcctgaccttgtgatccgcccacctcggcctcccaaagtgctgggattacaggtgtgagccaccgcgcccagcccattttcacagttttatatcctctttctcagaaagtttcccccaagctgtataagcttctggccccacacattctggatctgccccactgtcaccattctttatccttccagccaaagaacagtgtgctttatctatacttgatctttattttctcacttcccaggtgctcttcaaatcagtctaaccttgactgcttccattcacacagctaaaactaccctcactaagattagtcacttacatagcagtcaatatgatggacactcttaactttccgtctgcctgacttagcagcagctctgtatatgtggcgtttgtgacacacccctcctggcttccttcagttcctttgcactgcactgaggccactttacctccatcacactcttaaagggcaaggtcagctgctgggccagccctggaatacccggtggggcatcacagagtctgtcctgttgcctggtgggattgctgtctgcagcagctctgtctcttgggtgtttactttgcatctccgaaggaagcacttagatcatgcctgaaaacactactgagcagagctctgttgtgtgaatggtatgagagatgtgcagttaactgagtcttgacagttgagatttcttttttttttcttacataataggcacattcttagagagttctttgaacttagaactttatcaaactaaggttttgataaatgttttggttttacttttgaagttgccttctctgtaacttccacaagaaatccttgctacagctattacaatggtacagctattacaatggttagtacacaagactccttatggtggagttcactgattctcaactgcaaataggcattcagttggaaaaaaacaccacattctctgtgcacaggaggatgatgaaggagaaagacaaaccggtagagtcggaccctgagcataatgagagcacatggagccagtcccgaccaggggacacacagggggtctcctgaggagatgagggaggaggaaatagctgaaaagatgagggagggcaggcagacagggattagcggacccatccatgcagggtccatgccagctggcatatccaaggagatgctgttttccttttattctctaagcaggcaggacagtcagttccaaaagtgatgaggacaaaaagtggtgtctacgagaagtgagatggcctgcatggggcacacgggaggatctaagtgagcagtggggagccctgaggcttgcctggtttttgtactgatggagctgtttccccagcacagtgtcctgggagtaggagaggaaaaagggaaggcactgaaccaaccgaggcttaggtttctcttgatgagtgaagcagaaagacaagaaggaggcaaggaccatagttccaatgtggcgtcatggcacgtggtaggccttgattctaggctggacagaaagtaggaatttaaagagtttaaaaagagaagagtgatgagagccagaggactggaaaattctagatgagtgcagggaacaggtgtcaggcaataaagagtgtagtgattatggaagtgcttacttaccttcgcatatcctgttctgaacctctagtcacttaaacaggatacaagttttcacatgtggttttaaaaactgtcaagctatgtggacatttgtcttgatgaatttattttcagcatttttttttttttttgagacggagtccctctctctgtcgcccaggctggcatacaatggtgtgatctcggctcactgcaacccccacctcccaggttcaagcgattcttctgcctcagcctccagagtagctgagattacaggcgcctgccaccacacccggctaatttttatatttttagtagagacggggttttgccatgttgaccaggctggtcttgaactcctgacctcaggtaatccacccgcctcggcctcccaaagtgctaggattacaggcgtgagccaccacaccgggcctattttcagcatttagaggtctttttggtatgctggagatgatccatctgtggttggatgaaaatcaagttttgaaataaagtcagattatggatgtttaaattcttactttgctacatctttttaagattttctttcatctatgaaggcaaggagaaagttgatatttcaagggaagtgcttttccttttaatggaaaaaaaattggatatgtttatgaaacatttggaagtcctgagttttaagagagtatttcatcttacagaaatgagttaattattgaaaagaatttctttcttcctagcaaaccacagacaataactttatccatgacctgacaatttataaatatttgggaagttgtcagggttaaggagttaaataatttgtcttttgaattaaatatgaaattatgtttatgtcttatgtttatattattaaagatctaaataaaatatccacccatgttaagaagtttaattcaattataaacataaaaagccatctgtctctgttcactaatcatcctgtagctgtgtaaatgaaccattatacatatgaaaatttgatagtgtgacttgaggcagattcaatgttaatacaaaaattctaatacttaggcaaaacagaaccataaaatgtagaaagaaacctaacaatgccacagtgtggagatacttcttaggctttgaaggcgagtctgtatctaagaaagtagactgttggacagatcttaggtcttttgtgaggttttaatcatacttttattttataaattgaatttcaaaactcagcttacctttttttttttttttttttttttaccctcaaatagttcaggtccaaccattgtatatgaggactaatggcaagaaatggcccttttgtagattcttatcccctcctcacccatccctcccttaaactaaagatcatgtttaagccctgaatgttcacatcaagaaaatactgtttagttttgagttgtttgtgtaagccaaggttacgctgcacttttgaattaaagtgctatacgagttttctcaagagccttagaggggaaggcttgaaccctccacttacaaaacaactcaggctttttttttttttctatagaatcaactctcaggtatgatgggttagtcctaagggtaatgtagtaatgttaattttaaaatccacctttatctatattcaactttgaaggaatagcacttattcttttaaacttgtcttctctttgctctagcgcataaagtcaggcagagatggcagtgggggctcccgtggcaaaagagaaggaagtgctagcggtggtaagtattttctctttccctgaaaaacttggtttccacatttctagtatgtgggcttctggaaacatcttgcaataatctaaagtgttcttatgtgtctgtcggtttgttctatacacagtgaaacttcacattaattaatttggtaagcagtcagtctgatatgtaaatgagtatttgtaaatgctaacagattttcttaaataaccatgcttgtttttgctagttgattaataaacaagtttttcatttattaatctctcaggttggacagattatcatagatgggtgtacttatgaggttttgctgtgttacatttttaaaatttccatttgaaggaagtgccacgagaaggaggatggtcctatggaatgctgacagccctaaatctttagtctgacttttagtgtagaattagtgacaagctaggaattaggagacatagtgtgagtcccagtcttgatcgtgacgatgtatatatgtctttggaccaaccacataaatgctataggcttttggtgatttctgaagttctttgcatctctaaaattcttttactccttgtgacatcattacataataagacattttattgagttttccaccccttcttcccatcaacaatctaccttctttctctacttcaggcaggcagtgtaagttaaacttagtacaaatttggtgattttaaagaagctaattttaaaaataaatgtcgaattggggtctataaatatacctacattctctcctatccatactcagcactctcatgcatatatgacctagctccatgtaactatccagctgcattctgtcatatctgtttgtgatgtaggagtcaggacaaagacaaatgtagctcttagttaggcaggcctttcatccattcacagtgtttattggatgcatactgtgtgccaaacactgtgctaagagccaaggacatgggaacaaataagacgtggtccccatgctcaaagaagttagaatctagttggaaagacacacagcttctaatggtgctgtggatgctgccatggtagagaaatgtacatgagttttcaaactttcctagggatagaaactgcagctgggacaaagactccttgaattcagagctgtgctttgaaattcaaggagtcttcgtcccaattgcagtcaaattcaatttataacttagtaggcagttacagccatcagtggcatcgggttctagccaggccacttgattccccaagagtcagtccagcgtctccagctaaacctcatggtgctggcctgtttatcttcaggagccattacccagagctggagaaatcagtaaaagcagcattgagcccaagcctcaagagtaccaaaggcagtctgtcacatcaaagagtagccacttccatctcttcagccaccatggtcctgatggctactcctgtctccttgctcttccctagccccagatatctcacacactccactttaatggatccgtgtgactatctggggttggatttagtcagagagatctggcccagcagttcttaagccagaggcagccataagcccacagctccttacccaaaacccctggggccaggtgtgttgtggaattcagaaccttttggagtttagaaagcaagatgtattagccatgtatcacatactacccaaggagagcacctcagacatattaattcagtgaaacatgaatattcacactaaggataaataaagactatgaatagcctcaaatcaagtcaagttctatacccaagaagtttatatattgccacctgaagagttggctttcagagctctttggaatttggaattgtagatggagggtcatggatgtgtaccaaaaatgttcttaacagccaagaagtccacagactaggcattgtgcaacagtcaaaagcaactctagacagctccccagaccagcacagtgctgcttgttcatccttgctcctaggaagcaggaagtatgtgatatcagctctcttggaaataactgtccctttaaggagtaattgtcttgagtaacccctaaggaagtattaagtattaaaattctagggccggattcaccatcccctaaggattctgcatttctctctgaaaatcttaagttcagaataaccaaccagttccttctaaacatcaacaaccttatgttaagttctctgacccttccctggtaattcgtaagtttataaaatctctccccttaacttaagccttagtttcccagatgccatcactttgaaaatctgcctcagaaacatcagtacctcctaatgggatgtgatagaacacccgaaaaactgctgaatggtgtggtgcttccccagagcccaggggacagtgtctggggtcccacccctgagaaagtaaccccaggaagactgacagctgcctctcggaaacagattgatcagtgtgcctcaggccaccgcaggttcagatcctttgacatgaagaattgcccagcctccctggtgacctttcccatagccctctttcagtcatgctggcattagagcacagagagggcttcactcggccagggacctcctccacggtcagggaagaagggactgacaatgaagagaggtagggccaccccagatctgatacctgtgtgctataaaagagaggccttcctcttgaagagttcccttctggtcctggcctcccactgctgctttttcttttttaatctattttcctttctttcttccagtccatttcagtccaacacaaatagtcagttctagtgcacaaataagctttattctcacatgagagacttttggcatacaaactctgtgctctcaaggcattttacaagcagggttgcgtgttactaggttcttctggcacaaatttaaagcactcatcagtcccttcctagggtgctttcccccatcatttgccttttcgttccttattttctgacatctcgagttatgcatcatcccagactttttcatttcatcctggagcccagtttgaatgctgctttctgtggctgagctggttccacgctgacacttttgcaggaatcgtgttttctgtcccccttctccagttctcagcacaggccacactccaaggctggccctggctgtgaagtcggaacaaacccaggctgtgaggcttctctccctttctccttccttttgatttcaaagtcttaatagttaacagtatttatattctctgcagataaactgatgaggggaataactatattctgtccattgttttggttgaattttgttaaaggttgagaaattgacagaacacatctgcttctcatgtgtagctgtcctcaagacacaagaattccttcttagatggcattttctatttttgcatgatagtggcattttgtgacttattttgagtatggtgttattaagctttcatttttaaagtgctttttggtttaccctgtgtgatttttaatggctttctgcattttttagtttgatttttatgtcttggatataaacttttccaatgaaaatggatcaattttagactgaaaataattttataatgaaaatcaggataagattcagtgaacagaaattcactttatggtatcttttataaagcacattgtaaacatattttatttaaaaaaactgaagttttatatatatatatatatatatatttttttttttttttttttttgagacagagtcttgctggagtgcagtggcgtgatctctgctcactgcaagctccacctcccgggttcacaccattctcctccctcagcctcccaagtagctgggactacaggcacccaccaccacgcccggctaattttgggtatttttagtagagatggggtttcaccatgttagccgggatggtctcgatctcctgacctcgtgatccacccgcctcagcctcccaaagtgctgggattacaggcttgagccaccgcgcctggccagttatattttaatattctagtccaagtttgagcatggctaattaacacctttccacagttttgctggggcctgatggtgtcacaagcagagaatgaacaagtcatgctcagtgcccacaagggaggacgagacaaggagtgtacgctctgaggaggtgcataggcctaaatgtagaggacaggccgacacaagtcagccaattacagaaggaattgctggacatctatgtggggagggagtcttgagaggccggggggcgggtgctgtcacttctctaaggatcatgcctgtcagcctcagtcccaacttgcatgtccctttaccccataaatctagaccacagttttgcaggatacccgagtatccagcccactttgtatacggtatgtatcacaaaggaatcttgatgaataataagtattagaagatagtgaacagcaccagagcaccaaagtagtctcagtgttacagttccagaaaaagtttgcctatgccagtatacccagctggtgtaacctgccaatgtgtcgtctgtgttctgatacagtaattctcagtaatttggggtgtgcagactttttctgtaaagggccaggtagtaaatagtttaggcttgcaggccaagtctcatctaccgagaatattccactctgctgttgtgtattgaaagcagctgtacacagcgtgtaagtgaataaatgtgatagtgttctataaaacttaattcttggacactgaagttagaatgttatatgagttttatatgtcacaaaatattattattgtttgcttttcttcctaaccattttaaaatgtacaaatcattagcttgctggatagacaaaaatagggtgggccagatttggcccacacactgtagtttgctaatccctgctctaagccaaagtctccatgaatacttttggtaatgacaggtggggcctgggaattatccttttgatcaaagcactgcttgaagccatttcatcctggtatacagcttgaacagtaaaagtctgtatcagtgaacttctcttaaaaccaccttagttgtttacaactcacccacctcactaagtcaacacacatcacagagcatatgatgagattttgtatcttcaacagaacatgctccttaactctcgcccttagcctgttgccctgagttttcagtccttgtcataatcccattcctggcattcattcaacatccatggaccaccttcctgaactcatcacatcttatgtgaacaagttacttaaatctctttgtcacagtttcctcatcagtaaaatgagactgaaaacagtaccttcctgatagggttgctgaggaggaaatgggctcatgtggaaagctcttagagaaactcctgataagggcaagcatgtgcaagggtgagcatggctactgtgactcccgcctgacaaagggagtgcatgggcagggcctggaataccagtgtccactgcactgccagcgcccatgttctcaccactgccagtgtgtgacctctgagtgtgagagcctcagtttctccctaacacaagagggtcatgtttatccatgcagtgtaaccaagtgtacccctgtctcactgttgagttgaattttgtttttttaaacaagaattactagtgcttataaataaaaataaatgttggttcttgaagttaccaatttggaaagctgaatatttacttcagtaatgctgctgttaatcaaaacatttgtgaaactccttttttataattgcctgcagaggcaagttacaaaaagcacaggaaatttaatccaaaacttttacaaaatacatatgcacatacatacatatatatgcatacacacatatatatgcatgcatatatcctatctgtaaaatatatacacatgtattttatatatacgtgtgtgctcatacatacaaacacacattttatgagtttttaccctctttcccttcctacctttctgctgttttatctacagataagcattttctcacgttttctagccataataagtactcagtaaataccaacattcttccagcttcatctctcatatcctctttatatgctaggtattaagtatttaagtttgccacataacaaatatataatgttacctcctttgttctcttcactgagtccctccagagtctccctctcctcacttgagtattgcctatacagtagctatcggcgttcatttttacaattttaatatattcctgttaggttttgttgggtaataatgtaatgggatcaatagaagtagggggtgagggttgaaatcaaactgagaattgcagctgtaacaatgtaagaatgagctgaaattctcagagtaaggctaggtccaagcaatggtccttgtaaaattatcagagtattatgtcatctgagctgataaggtcattactttcttggactgttggttgggaaagtactttggatccctagctgtggtgcgctgcctcttaactttggaaagggacaggagcaaaggaagatcagcttcctggtaataagaggataggccatttgcaagtcagattacagagcacctagaagtaaattggtcagtaaaggcctcctaaaggtcccaaagttattgtctgatgctcttcagtgtttctagatataaacaaatacttcctcatacttaaggagtgagaatagatcttaattattgcatcttaatagaggctaaattgaatatcatcttcttaaaaatagaagagagagacagaccaaaaagcttttacaaagtgtctaatggataatgaaatcaatttatagctcaccaaaagagagttatttaagaagagatttgaaaaagtaagaaccactatattcataacacattcaaaggaatgggcagaattttttagaaagtttcattttagatagtactttcaaaaaataagaaactaataggggcagttgatagacttcctagcttaagggaaggggaatgttgaaaaatgattatatacgtattataattgggccttgaagactacagagggccattagatttttcaactaagatagttttgatagccttaaagaaagcagtctcagtgtactgttagaggcaaaagtcagattctaatgatttaagaagtgaatgagttgcagggaggtagagaagaggatataaactattctctcacacatggtggtgaaatatacagcctcaccaataactaaaacaatgcaaacttgccaagaccagctcagttatggagaccctaacccagcagtgctagaggaattaaagacacagacacagaaatagggtgcagagtgggaccagggggctgacagccatcagagctgagagccatgaacagagtctgacccacatattattgacagtaagccagtgctaagcattgcttctatagattatagattagctagaagcattccttataggaaacaaagcatttttagcaaggagcagagaaacaggccctggctgattatctgcagcaaaagcatgttgttaaggcacaggctgctcctgctattgtttgtggcttgagcagttttccgctccggaggggccaggttttccttgccctgctccagtaaaccaacaacttctagcagtgtgaaccaacaacttctagcagtgtgtgtgatagccatcacgagcatgtcacattgctgcagaaatcctgtttatgaccagtttctttaaggcctgtttatgacaggcttagggcttgctaccagcatgtctcccttttcgtttttgcaaagcgataaagacaaaggcagctttgtcacggtgggctacttctcgcaagatttgggatctgcatcggcagactacacaaagacagacaacacagattaaaagcacaatcatcattgaaatcacagagcctccaagtgtcttgatccactttaatgggttaatagctgctaatccatctgcagctccttcaagcacttcagttcctggcattagcgtcagatgtgcctgagaggcttgaaatacttgtttcttcagttttacaatatctaaagataaatttccagtatgaccctttaaatgtctcctaactctttcccactcgtgctctgtttcattatacagatgaggagtaatgcaaaaatcagaagtattccaatcacattgtaactgcattctgtattttagactaactactcaatctcctagccacattacagtttgtcggagatcattgatttgattagctagtttctggtctatattagtttgggaattccacagcagagtagaatttttctgccaattatttacatagtctgctgtttgtactgtggaatgcagagcaactccagctaccacggcagtagctgtgacagcagtcaatcccgtaatgattaaaattaaagtggcaattaaacgccgagagtgcctcaaaatctatcgaagaatttcagtaataatatgcgcagaaggagaggcttcccaaggatgggaaagctttacaggtatccatacgccttctcgggctcttactactaaaatagaatgatcagtattatacaaggaagaattcacacaagaaaacaatctatattcttgacaagtcatacgatgattagggagatcaagttttaaatcacccactacaaacaggaaaggcggacagacacaactatgtatccagactgaactgttgtgagccaattctaacatgtaattaggattatattgggttggcttagtatattttccttcccaaatctttatctttttcagtgccattaatattttccataactccttatgtttagctcttacatcaggtcatatcatttggggttgaggtaccactataccaccatatgcccaaataataggaactcttgctgtacttcttatagtgtccaccatctgattattttgtttatatgcagggtgaccattagctacagattgagaggtgagcctcataaatgcccctttaggggaccaatcaataatgactccatatgaatcattacacaacacctctgcctgccttgcgacacaatcttcccaagcaaataccttcatttttgctgaccatgtccaatccagtttacagataggtttttgagggtggtaaacttcggttacaggagcataataattgtgataaatactaagaccagaaagcatatgtaattgtgtcatggagatgttacattcaggcactatcgccagccaggattgatgactgggagctaaacacctattggcttttcccaaacaaataggtaaatcctcaaatcccaacaagatattcataatagttccttcctcttagggcttagacgggcctctatcatctatagaactaggcatctaaaaactttcgttagtgtatacctccactggggggtctaaccatgtttctggctgtagaagtggtggaaaaggaatatatgcccaataagtataattgtcttttgtttcagcagtcactgggggaatactcatggcgatggtgagcacagccatcatagctaccattagattactcattgtaactggttgtcccgccttcttcagattttcttccgccatctgtgtcaacttcttgatctggccccaggggggtggctgtgcccgaccagtgttgctcgccagcacttgtgtcttccttattgtcagtctcaacatggctgcaaccggggggtcctcgggttcctcccaaaatctcttccttggcatctggctgatgataagttttcaggtatcttgatggtatccaaatcagctgctggttttggcctggagaacacaagcataacctctaccccatgttattattttacctatttcccaactcgttgttatcgaatctctccaccaaaccagttgttccgcttctatctttgcagctggttttggtagatgccgttcagctgctgatagcatctggcctttagataggctcaaaaaatttaaagtcagtaatgctagattcagttgcatgtgtggagtcctataatcactgtccctgtttcccccttctgcttttgcaattgtcattttagggagagattcattcgttccacaatggcttgtccttgtgaattatatgggatgccagtaatgtgtttaatattccatatagagaaaaatgtagctagagcttggctagtatagcctgggacattgtccgttttaacagaagctggaatgcacatgaccgtgaagcgttgcagaagatgccgtttaatacaggcagaagattctcctgtttgacaggtagcccaaacaaagtgagaaaaatgtatctacacatacatgcacataagctagtctcctaaacgagggaacatgggtggcacccatttgccaaagagaattaggttccgatcctcgaggattaactcctcctgtaaaagatgaggaatgcaccatttgacaagttgggcatcgctggataatagctttagcttctttccaggtaatgctgtatctgcgtttgagaccagaggcattaacatgggttaaattgtgaaagtgtctagcgttagatatttcagtagcagctaggcaatcagccatttgattccttggagtcaaaagtcctggaagagttgtatgagctccaatatgagtaatgtaaaaagagtgcattctgttcctaactgtggtttgtaattgggtaaataaagtcatcagttgttcatctgtgtggaattgtagctgagcattttcaactaactgtgtggaatgaaccacatatgaagaatcagaaattacattggcaggcatctcaaaagcagtcagcacctcaattacagctacaagctccgctttttgagctgaagtatagggcgtctggaaaactttacgttttgaataagaagctttaccattactagacccatctgtaaaaacattttcagcacctacagctggtttagatttagttattccagggagaatccaattagttaattttaaaagttgaaataattttgttttcggaaagtgattatcaagaacacctacgaaatcagctaaatgggtttgccaagactatttataaagtcctgttgtgttagtgtttttgtaagagggacaataatttttccagggtcatatgcatgcaatttaacagtttgggttctcccatttcctaccagagtagcaatttgatccaaataaggaattagagtctgtgaattagcatgtggaagaaaaagccattctaccaagtcctgctcttggacaataacaccagtaggtgaatgctgtgtcggaaaaatcagcaagtctaaagtctttgttggatctattctatttatttgagttgtatgcacttgcttctcaatcagctgtaagtctgcctcagcttcctttgttaattgacaagggctagtgagactaggatctcctctaaggatagaaaatagattactcatggcataggtaggaatgcctagagcaggttgtatccaattaatgtcccctggtaatttttgaaagtcattcagtgttttcaattgatccctacttatggttactttctgtggcactactgtagtgacatttactaaggtccccaagtaggagtgaggaggagcagtctgaattttgtcaggacctataattaaaccggctcgagaaatcgagttttgtaagtgatcataacattggagtaatatttcccaagtcggggcagcacaaagaatatcatctatataatgaataatgtaacactgtgaaaattttttacaagtaggttcaattgcttgtcctatataagtgacaaattgttggactgcttaacatgccttgtgggagcacttcccagtgaaaacgcttagcaggctgcaggttgtttaccacaggaattgtaaatgcaaaccgttcacagtcttgctcagctaaggggatagtaaagaaacagttttttaaatctatgactattaaaggccaatttttaggaatcatagtaggagaaggcaatcctggctgcagtgccctcataagttgtataactgaattaatggctctaagatctgtcaacattctccatttacctgattttttcttaataacaaagactggagaattccagggagaaaatgttggagctatgtgtcctttttctaattgttcagtaactaagtcctctaaagcctccagtttctctttactcagcggccactgctctatccaaattggcttacctgttaaccattttaaaggtataggttctggaggcttaacaatgaccgccatcaaaaatgatctaaaccctgatgagaattctgtccttccgcttgaagcagtttctttaacccttgtaaattttttcctaatcccatgccaggcacgtaccccatctcttgtatcatatgctgactttgagggctatatagttgctcaggaattagaacttgtgctccccattgctgtaataaatctctcccctataaatttataggtacagaagttataattgactggatagtcccaggttgtccatcgagtccttcacaatgcaaaatataactgctttgatatacttcaggggttttaccaactccaactctgttaaattgagtgggttgaattggccatgcggatggccagtgctgtagagaaatgatggaaatgtccgctcctgtatctaccaatcctttcattcatttttttccttgaatggttatttcacaggtaggacatttatcagtaatttgattcacccaataagctgctttgccttgtttatttgtgcttccaaatcctcctgtttgtttaatttcactttttcccattcccacatacagcacagtcaggagctgtgctatacgctctcctggctctgctttccagggaacagaagtagatataacaatttgaatttccccattgtaatctgaatcagtgactcctgtatgtacttgcactccttttaaatttaaactagacctacctagaagtaatcctaccgtccccactggcatcatctgactggagacagcaacattctttaacagtctcattacaaaaggagaacctggtccatattgattaatagctggtttaaattctttgaggaatttaaaaggaaaaggctcaaatgtagccataatattcccctgttgatcaggtgagtatattctaacagagaactgccaagcatccatatcaccttctcatctagcttgctggattcctgcctaaatggaactgagagcggtcgctcgaggcactgctggaacagtcactggggcagctactttttgcccagtgtcctctggaaaagagagatttggagagtcaggccactctttttcttcaaaataatgagggggtatagaggggtagggacaaacctctccctcctttgtctctttagctggcaagcaaacctgctctgtcatctcttctgttagttacttcgttacactctccttcttcctctgattcctcctccttgtcatctatatagaaaggctccaaggtggaacaaaccacaatccacactgaccagagagttacaggaatatcctcagcaccatccttgtatgcctttttcagtgtgctgcctaccttttcccagacctctacattcatagttcctcagtcctgaaaccaggggcagtatttctctaccacactaaaaagttgcataagtcagctggtgctaaccttcactccttttctgaggagatgccgaagcagactcaagcctcgtgcctgctcgacccttgtcccattgttaccctgatgcttccgagctccccttcttactcaccacagggattgcttaagagtactcgggtgttccccagcgtagttccacgttctccaactgtcgcttcggggcgacccttcgacccgggttcaagcccccatgttgggcaccgcttgccgagaccagctcggtcgtggagaccctaacccagcagcactagaggaattaaagacacagacacagaaatagagtgcagagtgggatcagggggctgacagccgtcagagctgagagccacaaacggaatctgacccacatattattgacagtaagccagtgctaagcattgcttctatagattatagattagctagaagcattccttatgggaaacaaagcaattttagcgaggagcagagaaacaggccctggctgattatctgcagcaaaaacacgttgttaagacacaggctgctcctgctattgtttatggctagagcagttttccgctcccgggggtgggggggccaggttttccttgccctgctccagtaaaccaacgacttctagcagtgtgtgtgatagccatcacgagcatgccacattgctgcagaaatcctttttatggccagtttctttaaggcctgtttatgacaggcttagggcttgctaccagcacaaactaacctataaaattagcaatgaattttttaaaaggtaattcccaagggtagcaaggatgagatgagatgagcactgtttattaactaaattctgctggggggagttctaagtggcacaccctgctgggaatgtttggaaatattcatcaagccctttaaaatgcccgtacccagccgggcatggtggctcacgcctgtaatcccagcactttgggaggccaaggcaggcagatcacttggatcacttaaggtcaagagttcgagaccagcctagccaacatggtgagaccctgactctactaaaaatacagaaattaaccgggcatggtggcacacacttgtagttccagctactcaggagactgaagcaggagaattgtttgaacccgggaggcagaggttgcagtgagccgagattgcgccactgcgctctagcctgggagacaaaacaagactccatctcaaaaaataaataaattaattaaaatgcccataacctttgataggaacttactttaaagaaataattttgtacacacatattgatcacattatttatggtagaaacattgggaataaaccaaatgttcaactggaaataattccaagttgaattatgttcttcacagttgtgtcaccctggagcagttattacaggccccttcttccccactgtggtgagatcccacatcgagcttccttggctgatctttaagggggatgctgttgccattgggagctccatagacttggatcacttaacagctttgagagatgatataacttctagagacaatcttatttgcagctggagtgcagtgaataataatcatcacacaatgtagtttcctttttacttttctctaagcaaaataatgttcatacagaaatcagtaaaataaaaatgcaggaaaggcaagtacttttattggatctttaaaatgtgttataggtatgacatcatggaaattatttatagtgaatgcttaaggtaaaagtcacccacagattgtaaagttcctgaaggcagtggctgcatctccttttgcctctgctgggtgtgaacagcataaggtactgagcaggagcacagttaacactcatcagaatttaaaatagcatcggtggtgttaaagataaagaaattgatacattttttcttattttcattacttatataaatgtattatgtactcagtttcacaaaatcattgtatttaaatatgataaaaatctctgccgcaacctgtttagaaaattagcaaaaatgaaggacattgcttttcatcttccctgtacagttattttttctatcttaagtttattactgctataaattatttttatgctcataaccatattctttctaaattagtaaagactgtctttccttggaaacaattcatttttatttggagagaaattttcaccaaagtttatgtagttagccccttaaccttacttaatttattctgtgaatagagccttttataagactcactttcttgaactcctggcctcaaattctcctcctgcctcagcttcctgagtagctgagattacaggctcaggccaccacacccagcttaaaagtcactttcttaccaaaaaaaaaaaaaaaaaaaaaaaaaaacctcatatttaaaaactacgtcactctaaaatgttacaaataggtcatcttcttagtatgcattgccttgtaaaaacattggtcaagtcgggatgtagtcggccaccaactagaaatgtgttaagattttttttgcagacttgcttaataaggcaaggagggggtcaggttgttctggggccagcagaagggtctaaaatacagggtagtgaaaagagattagagattgtgagtttcctttaaatgcttaactgtcattattaagacagccacattttgtggggcgagccaaactgctgagcttggaatagcatatgcttggaatctgaatatgaataaggcccaggtgccacactttacacacagatcctttgctaaagaggcactatttgtctaacaggcaaggaccaggctggcagtcaggaaggctgggttttggtgctgatcttgtcaccaactatgcactcttgaacaagtcacttcacttcactatcctaagcctgttttctcatctgaaaaataaaggggttagacttagccttttaaatgacatttttgtatatttctactggctataaaattattacaaatatctatgtctgacggtaagatagtctaaatattcaggaaaactccaagtatagctctcctaaaaatgatatgttgcgtgttaaaaaaagaaaaaaaagaaaagaagaagggggaggaaaaaataaaatgaaaaaaacttcaaaaatgcacggctgagttggtagcaaagaaggaaattctttggaggccaaaaagatctagaaagtttaaatccaatgtgcaggagctggcattgcctagctaatccctcatgattgagaacctcagattatagacactcatggggaccaagagataaggcctggggcctcaaaaaggccagagcagaggtcggatcaaagaatccctgtcacaaagctaggacttctcactggcaatactctgagtaggccaagtcggaaagaggccactctggccgggcacggtggctgaagcctgtaatcccagcactttgggaggccgaggcaggcgcatcacctgaggtcaggagtttgagaccagcctggcaaacaaggtgaaaccccgtctctactaaaaatacaacaacaacaaaaaaattagccgggcgtggtagcgcatgcctgtaatcccagctactcgagaggctgaggcagaagaatcgattgaacccgggaggtggaggttgcagtgagacaagatcacaccatcgcactccagcttgggcaacaagagcgaaactccatctcaaaagaaaagaggccaccctacagatgatggattttcaccttggttctaatgtagaaaacaagaagagctcttttgataattcctaaccataagtaagccttcactcacatagttttggagctagaatacatattatatctgtgtgttctgaagaacaccaagctgaaaatttgatttaaagtggacttcagttggtgaggctacaaggtgcctacaagaaataaacttaaatcctccttggaggaatgcacttttaagttccaaagaataagaacctacagttaagaaaaagtatgcatgcatgaggaaataagtcactaagagtaagcaacaacagaaactatagagtccaatcttcaaagactacaaatattgtaattattatttatttatattagagatggggtcttgctgtatcacccaggctgagtgcagtggtgctgtcatagctcattgcagcattggacttcagggctcaagtgatcctcccatctcatccccacaagcagctgggataataggtgcatgccactctgcccagccaagttttattttttatataagcactttatttttatttaattaattaatttatttatttattgagacagaatctcaccctgtagcccaggctggaatgcagtggcacgatctggctcactgtagcctctgcctcccaggctcaagcaattcttctgcctcagcctcctgagtagctgggattacaggtgtgcaccaccacgcccggctaatttttgtatttttagtagagacggggtttcaccatgttgctcagtctggccccgagctcctgacctcgtgatctgcctgccttggcctcccaaagtgctgggattacaggcgtgagtcaccgtgcccggccccaggttttattttttaaaggtttgctttttccacaaaatttgaatctttcaggctaggaatttggatttggatttcagaagggttttgggtgcctgagggagctatcagggttttgttggtaatttacatctgtgtaaaaagtgaaataacgttgtcgtatttactaatgaggatgtgtttctgacattccacagtattcctcagtgagcagttctgtgaggcatttccatcttatctctgtaatgagaacacctacatttttgtggagacattggttgtcatatcttatgtacccatgagtcaaagaactgtgtatgcccttgcccttcgttgactgcaaaccctaaggcaagaaggcctgtttggaccactccctgccaactttgttttatgtttctcacccaaacttttcttctcacatactcattcatcttttaaaagattgctatatagttattgtgtatatatttggtggcttatcttaaacctttttggagacaggtaggatatacattattcagaaaaaaaaaagtaaaagaaatatccctagagcaatgtttttcaaactttattgacttgagctcactcaggcagtttaaaagacacccgtatacatttctgcatggaaaaaattaacttttgttttaacaaaaagagagggacaaaataatgtaaaatatactaaagtgtgtagacatattcagtacactaaagagctttattttcccgtaacatcagtggtaggggaaatggtaaggttttggataagaaccttagagaagacttactattttgggtcagttggccaatcttaaaatgtggggattttaaagaccatcttgttctgatttattcccagagacattatcagtaaactaaaagacaaactatattcaaaaacgaaatggtcagtgtgtttatcagtggactactctcattaaaagtgaggcttacataatagaaaaaatatcactctaggaattctaaggggaagaaaggaaaactgtggggctagaggagtacttttagaaaatatcacagaaatttctggttaaaaagtactactaacatttcctactaatgttagtgttcagttttatctgaaaatcctcagtgatacatattacattttttcctaaggcagccattgcctatttgggcaattataagagtcagggtgatctcttactttctcttaagttcttccataaaattgaaacctataagtaagcacacatttgaaagaatacatatacagactactcttaagtgatgttttatctatattatagattcccacaagatatttcttttaaatttcagaaaacaagaattatatccctaagaagctggcttccaaattaaacaacctgcttgtttcttggcaaataagtatgctttaagatgcataatgtagttttatgttttctcaacatattaaacaaatgcatttttattttcgtgttttcagatagtggccagaactatagtgccagtagtaaaggtgaacgactaagtgccagactcagagctttacctgggacaaatgaaccttatgaaagtagcagtaacaaagaaataggcaagtactctccacccagttcctccaggcatagcaggtctgaagaagaatggtgagatggccaaaaggtgttgctgggaattcttaagaatttgatatttacagataaaatttaaaatgacttgggagaccatttctgttcactctgagttattcattttgactatgagcctgattggtttcacatttgttttgtttgtttacataactctaacgtgacaatctcttcgaaacctagatgcctcctatgtggacccacttggccctcaaatagaacgaccaaaaactgcagccaagaaaaggatcgatgaggatgattttgctgatgaagaattaggagatgatttgcttccagaataatattcactttaatatttattaaaggaaagaaattgccttatgagatcatcctcatgttaaaccttggattaaatatctaacctgtaattattttttttcactgtcaaaacttaagtaagtgtattctattctgtatgtatgcatttaagttgtttttttcttttaaggaataaaaacaggtaaaactaatactttaggccagtgacttccttagctttttgaaaacattgacacacaggaagaaataaatttcataacacaacctagtacatatatgtgtatgtagtcataaaaatttacccttattattgcaatacatgctaatattttctatagtttcattcaaacaaagtgctagtagtgaagccactacattgatttcatggcttgcagattgaaaaatgctgtgtggacataggcacaatttctattcatacttaaattgcttggagtttggaaattctttggaagatttgccttgtggggattagaaacactattaaaacaattatgttttggaagcagtataaagggtaatgggattaaataccaaaccataaccctagtgctcctttccgaagttcctttctacttcagcccaggggtgtgcaccaatagcacagagcagtaacaactctaagatggcttttcccatttgtgacttagtgggttgggggcaggactgcctgcatttttctttaacaatgtgtttggctggtctagagtctccagaggaattataatgacgaggatgtcagaagcagtggcttatctctaacactataccaaagagaatggacccctcaatcttacttaccattgtctctgcaacgtgcatgctactgttagatgcgagggaggaaaaccaaaactagaccacattccttgctcccaaagtaggttatgctctaattgatgagacagccaacaaatacagtaaacatccagtatgtgcagagaattcattaaaatttgggggatacagtagtgaaaaagaactataccttgccctcaagaagcttaaattctggtggggagatggaaaatatattttgtttgtttgtttgggttttttttgagatggaatctcactctgtcgcccaggctggagtgcagtggtgcaatgttggctcactgtaacgtccacctcctggtttcaagcaatgctcctgcctcagcctcctgagttgctgggattacaggcacgcaccaccacacctggctaatttttgtatttttagtcagacggggtttcaccatgttggccaggctggtctcgaattcttgacctcatgatccacccaccttggcctcccagagctgggattacaggcatgagccagcgtgcctggccagaaaatatgtttttaaaggactctagatattgttaattacagttaagagaacaaaatggagtaatgcaataggtagtgattatagaggagggactctaagaggtggccttggtaataacactagaatggtgagaagaaagcagtgttctgagcagaaggagcagcaagtgccgcacactgaaaaatgaatgatctggatgtgtcacagggttattgagctacagtgatagtgagagggtttgggatccagcagtgtgggtggtgtgctacatgggcaggaaagggaaaggagatgagatccaaaaggtaggcagggttcagagcatgtacagccttataaagacagtttggatcttattctagttactatagaacacctgctagaaggtttcatgcaaggggggtgagtgaagtgctttcatttaacctttagaaaccagtcatcacactggtcgccatgaagatgaagtgggcaagtgggatggaagggaagagtggaaactactagcagtagcctgggtaagagatgaaagcaattgagacaggtttttagcaatagaaaattgtgagaagtggtcagattcagcatatatttggaggcagagctgagacttactaatggattggatgtggattgtgagggaaagagaggaaaagatgatgccaaaatttgtggctaaggaacggagtggctagtgttgtctttttagtaagatagatttgggggggaataagtagatgtgttttacccatgttaaatttgtctcaagcattcaatttgagatgcgaagaatgcagttaatctttaaaatctggaggtcacagaagtgag

SEQ ID NO: 15688 - DNA, 22871 bp, Human
tttaagctttgatttgaaaggttctaaaacaattttgtctagaaaagaaaacaaattgttattctttcattttctattttaataaaatatatatccatatttgttaaatttttagcttaaaggagaaaagttaatttgattggtaaaagcaccaaggaggaattttttaaaagtgactctttaaaaaaatcttcaaagttgcttgtatggtatctacaatgccactttaatttttaaaagccaatttcaatattaaagtaattttataaagtttccttcattcagcaaacaaaagtatcttttactatcaacctcaaaaactataaatcaaatttacttttaaaaagctaatttttatgcatcagtttttcttatatgtaactaaaataaaggggagaaaaaatccaaatgacaaaactatcaaataatttgtgctaaaactaatttttacactggaaaaatatattacactggctatatattaattatggtattagggcaatatttttaatcctcataaaattaacaacatggactatgttgtcatttggtgtcctatttcattcaaaaagcagattgtttgatctcctgggaaatcaccaaaatgaaaaggatgactttaaaactatatcatttttcataaactaatattcaccaaaacatgaatgtttattacacaataataaaatcacacaagtttatagtcaaattagttgaagcagactgagtgcagcagttacaacaaataacttaagcacagttctctagtacaacacactgcatttcaccctagagaaagaatgctggcaaagatctctaccacatggaaactgttcttaaagctgctgggccctgaaattttactcagcagtttgaaatcaagacatagcttttctcattcaccctcccacttggggctaatgcacagacatgaacatctattgaggaaaaccacaaaaaacttcaaaacagctacaacggtaggcttacttttcatatattattttaaatattgtttgttaaagtgcgactgactcatctaatagtcttaataaatgtaaaggccatctctggtttaagtttcagttacctcaattaatttttaagaagtacttatgtatatcatcgcataaatttaacatccacgcaggcaagaatagggtgctgcagaagtcacaaatccattatcttcttcattttcaacctctggatttttgacaaactggcatctataatgcagcatcagcaactcttgagtgattctgtttgaagttacttaagaaaaagtctgaaatgtgtacccaccagagaaaatccattgatgagcctaaaggaatcctttctattacattcctcaaagttctttgattaaagttcggtatttcctctagcctgcaatactattctttcagttttcttagcttaaattaaaaatacaatactattaactaaaaattatgatcacctattaaaattacaaaactaagaaaattaaaaacgtatggcttttcctatattctgtaccacctaaaggtgttaatgactacttttcataatgttaaatttaagttttaaaacttttcttggaacttgtttctgttcataccaatataaatcaagagttcttataaagtagctaagtggaaatatgatatttttaactcacatgagacaggatcttgggactttattttaactatttatactacaggtatcctaagaatatttcaattaaatattagtatgtctgctgaaggcacttaattattaagaaacttaaaattatcaatctttcttgaatttctgatagagaagtaaaactattttccaaaactatttttcagaatgttcactgatacataaaaactgctagcatctaattaaagatcactaagggttaaatactgttctctggcccttactgcgcacaccctgccaaaacatcctctaagcttttaaatattgcttcgatggtctgaatttttatttccagggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggtactttatttctattctaaatttagcttctaaaatactgcccatttaaatgcatgtttttgcttttcctgaatgtgtctgataaggtaaggggaagggaaaatcactttaaatgattcaaacgaattcataataattgtccctaagattgtatttttagagtatgtatgctttccaaattaataaatggtatctatggtaaccaaacagtatctatagtaaccaaaaaataaaacttaaagaaaactagactttaagatgatccctcaccagttgcaatttatatattaagtaatgttacacaatgccctatacttgcaatgttgtgttgcctcaaaaataaattagcggaaatgtgtatttggagaaataaagatgaattatcagcttaaggttattattatagaaaacaatttgaagaaaatacatagaagagtactggttattttgatatcaatagcattccacaataatttatatatgccatctacatacagtaccaaaaactgaaaacctagtcaatataggactttctttttaaatcaattttaacagtttagaccctctatcaattggtaccaagtaactgtaactgtctttgagttaacactgcaagggtgacgttataccacatcattcattccccacctttatgggcaaactaattacttgtggttttcttggcacacagaaatgaatgctgggtaaggaaaaagttaatacagcacttaagtatctgttgcccactatgtatgacacatacacatacacactggaaaatgagaaattcagccaaatatataacaatactgattgtttcagaagttcttctccactataaattggaggataaagacttataagattgaccagttataattgctactttctcttttcttttttgcaggggtacacaatgagcaaatgttaacaccacagtttctttctttcagttaatgcttttaatatgatagcattatttttgcccatcactaagacacaaaggataggtattactaattatagcttcaagttaaagaaaaaaaagtcccatcataacataggctattggctcacttggatgatttgaatctattaagattccctgatccctaaagagtttagagattatttttctctctgcttcttctctttacagggctttagaagtttctctatcttaatataaatgcagggtctaagatatttgtggagtggagtagaattcaacaggacttgatgtgcaaacacagagtagagggaggaagttcaaccaccacacagatgggagaatgaaggtgaagggcagagtcaggagtcaagaccgagactaaaatggaacatgcttacaaaggacagaaagaataggacaccacataatacactgtaatctaatggcagaaaacgtactctccaagaacaggaaagacaggatctaaattgtatctactccaatttccccagaattaatggcctaccccagtggcccaagcagggtaggtaaggtaagctggaataaaagggatccaagagccagggcttaatggagggatataggtaattaaagggtcaccccaagaagagacctaaagaccttaattggtagtttatacttgtgacatggctggagctctagtcttactcaaaatggtagaatctgaatgagaaactcagttcagacaagacccctgaggaacagtttcacctcagaaaaactttcattccaattcagggaattctcacctagctttcatttggaatttcaggatgttcaacatttattaagcactgagtgtagctactggcgatataaaaataaaaacacccagttcttttactcaaggagctcatagtctagaataaaaacaagctaaaaaatacttattgtaatttaatagatgataaaatggaaatatgtatgaaagcctaatggagcacaaaggaaatgccactaattgtaactacgagaaggtgtctgtgatcccttcattttacagagaaacacagacttaatgaagctaggtaacaaacttttatttttccaataggaaaaagaaactgtgataatacccaatgagaaaagtcttcaattacaaaaagatgaggcaataacaccattacctcccaagaaagaaaatgatggtaagtatcatctaaatatttttcaaatggatcttttaaaaatagctataatggactttattccttgtggtaatcaaaaactgactcaagatacagtaaatacaaacagtggaattttatttccaatgataaactcaaactgggagtgcacaccatttgccatcccacattatgagtgagaaatgtggagcaagaacttgtgagaacaaccaaagcttaggcaagcttagcctccacaaagtgtggtttccatccatataaaatctattcgagaaatacttaaacacggattatttgcaaaatacaatgtgcagcctcagtatacggtaaatataattattgcctttaagaaacttacagaacagaaacacacatatacatcaataattacacatacatttcaattaaaatagaaaacttgtcatgaaataacaaattacaagtcctacttaataattcctgtgtacttggcttactcttactctatcacagaacattatttcacatgaaaacatgacaaaaaccacatattaatttctatatttctaaaataaaatgaaaatgaaccataacagaaaataaagcttaaaaagcgagaagtatgatagtaaaaatagatttgaataaatttaaagacatcccaggctgggcgtggtggctcacgcctgtaatcccagtactttgggaggctgaggcgggtggatcacgaggtcaggagttcaagaccagcctggtcaagatggtgaaaccctgtctctactaaaaatacaaaaaattagccaggcgtggtggcaggtgcctgtaatcccagctactcgggaagctgaggcagagaattgcttgaacctgggaggtggaggttgcggtgagccgaggtcgtgccattgtactccagcctaggcggcagagcaagactctgtctcaaaaaaaacaaaaacaaaaacaaaaaacaaaagacatcccttgttcttggatggaatgactcaaaatcataaagatgtcagttctttctaaatttataaatttaaaacaatccaactaaaattaccaataaatttttttataaagctggaaaaccagattctagaattcatatggaacaacatgtaacaaataacaagggaaacagtaaacagtaacaagtatatgtaggaatcagatgtactacacattaaaatatattataaaactctatactttaaaaagtgcgatactggtatatgaatagacaaaaagatcaatgaaatagaatagaaaatccagaaacagacaaaaatacacatgaaaattcagtacatactaaaggtaccaacctaaatcactgaagcaaaaatggtctttttaaaaaatggtgctgggagaaacagccatttgaagaggtgtacatttaggtccataccttacacaaaaaataaactccaaatagattagcaatctgaatgtataaaatgaaatcgtacaagtactagaaaagaatctgggtgcagggtgcctcaaaatccagagacaacaatagaacagaacaataaatttgaccctaaaaatacctgtggtaaagtcgaaggcaactaaaaactgggaaaaatatttgtaacatatactacagataaataatatcactagataaagagctcacagataatataactaaaaataaagatctagtaactctaatttataaagcactcttaaaaatcgaggaaaagagattaaccaaaaatccactggaaaaatgacagttcacaagatgatttaaatgatttaacccaaataagtgttcaatctcacacagagacatataaattaaaattacattgagataccatttttaacctatctgattgaaaaaaattgaagtatgacaacacattaatatattccatgagcaagggctatggggtaagacactcatacacggcagcaggaaggcaaatcaacacaatgcttttggacaggaacttggcaatatctaacaaaataaaaaatgcatttactttttgacataagaaccaactttgaggatttttttttttttttgagacagagtctcgctctcagactggtgtgcagcagtacaatcttggctcactgcaacctccgccatttgggctcaagcaattctcctgcttcagcctccgagtagctgggattacaggcacgcgccaccacgccaggctaatttattgtatttttagtagagacaggtttcaccatgttggtcaggctggtcttgaactcctgacctcaagtgcctcagcctcccaaagtgctggtattacaggcgtgagccaccactcccggccaactttgagaaatttaccttgatgatatactccaaaataaaatacaaatgcaaaatcactaaagcattgcatgcaattgcaaaatatcagaaataatttaactgcccaaacactgaagagtagttgaataaacaatggtaaatccaacagaagagaatactatgcagttgtaaaaatgaatgaggaagatctctaagaactaacatggagtgatttccaggatacactatgtggaaaaaaaaaacaaagtgcaaaagaatatctataatatgctgtctttcatgtaagaaagaaaaggatataagaaaatatatatgtatctgcttgtttctgtgaaaataaatacaggctaaaaagaaattgggggagaggggatggcagttctctgcgtatatactttttaatgtagatttaatttttagaacaatgctgtttcgtatagtcaaaaaaccaaatacgtatataaatgaaatcaacaagaataaggtaaaaagaacccaaattggaatacaaacataaaaacataaacttgattgtgcttcaaattaataactcagcaaaggaagaaaaaactctaagtaactgttaaacacagcattttcctatataccttcaggctaaggacaaaaaagaactataaacaaatatgaagttccagtgagtaggtttgttatgcacagtgttatgagttagcaatactggaactacttaatatgtgtgccagaactaagtaaatatacgtaaataatgagagccaggttccgcactgtcagagaaacattacaaatacggaaaggtggaaggctagaaagaacactgtggagttggtttggaatagaagatactactattaactcagggtttgtatatacagagatacagaaatatagaaatgtttctctctgtttatctctatgtgtgtgtatgtatacatgagtatatggtatacatatgcatgtatattgtatatgtttatatccgtatatgttgcatgtatgtgtattatctgtggagaaagagacaaataaacacacacatttatttcctagctctctctgctgaaagagcctagaagcaacgtgatctcaatggcaatgagcacacccagcacctgcatcttggtttctaataccattctccactaaaagaaaccaatgctggccgggtgtggtggctcatgcctgtaatatcagcactctgggaggccaaggcgggtggaccacctgaagttaggaatttgagacaagcctggccaacatggtgaaaccccgtctctactaaaaatacaaaaaaaattagctgggcatggtggcacatgtctgtaatcccagctactcgggaggctgaggtgggagcatcacttggactcaggaggcagagctgcagtgagacgagatggcaccactgcactccagcctgggtgacagggcgagactctgtcttaaaaacaaatgaacaaaccaaaaaaacccccagtgctttctgaagagatagctgatttcagggttggggcaggaaaaatgcaaggttagtttgggacatcttgctatgttaggaaataaggaagttctcaaagaataatggtgtttttttgtttgtttgtttgtttttttagacagggtctcgctctattacccatgctggagtatagtggcatgatcatggctcactgcagtcttgacctcctgggctccagcaatcctcctgcctcagcctcccaagtagctgggactacaggaacgtgccaccacacctggctaatttttgtatttttttgtagagatgaggtttcatcatgttgcccaggttggtctcaaactcctagactcaaatgatccacctgcctcagcctctaaaagtgccaagattacatatatgagccattgcacccagtctcctgacaaaatgtttttaaatccatcaaaatatataaaagaaatagatataaaagatgtttatgggaaggccgaggcaagaggactgcttgacctcaggagtttgagaccagcttgggcaacatagtgacaccatgtctctacaaaaaatttaaccaagaaaaagccaggtgtggtggcacaaacctgtagtcccagttacttgagaggctgaggcaggaggatcgcttgagcccaggaggtcgaggtttgcagtgaaccatgatcatgcgactgtaccccaccctgagtgacagcatgagatcttgtctcaaaaaaaaaaaaataaaggtatgtaaggcctgtacactgaaatctaaataacgctgctaagagaaaataaagaagacctatatataaggagaaatgtattatgttcgaggtctagaagattcaatatcattaagatgtcagttttccccaaatttagagattcaacacaatcccaatcaaaatcctaataggttttttttttgtttaattaacaagctgattctaaaatatatataaaaatataaaggacctagaatagtctaacaacattgaagaagaacaaagttgcaggatttatactaacaagactgttacaaaggtacaggaatcaagacactgcagtattggcataaaaatgttaaagtgggtcaccagaacaaaataaaatccagaaacaggctaacatgaagtaaccaactagttcttgacaatgtgacaatacaattcaatggggaaagaataatccttttaaaaaacggtgctgaaagaaccagacaactgtaggaaaatttttcaaaaaagaattaacccttcctggcaccatatataaaaattagcccaaagtataccccacacctaaaggtaaagatcttaaactatacaacttctagaagaaaacaaagtgtcaaatcttggtggtcggcaaacattacttaaatacaacacagaaaccatgaattatcaaggaaccaactgttcttcattaaaatttaaaatgtttcatttccaaaaggaaaactagtaagagggaaaaaaaaaaagacaagtcatcaaatatatggatgccaaacaagcacatgaaaagatgctaacatcattagttatcagagaatacaaattaaaacacaatgagatactataacatgccctacatttcaattgctaaaattaaaaagactgaccataccaaatgttggcaaggatgtggagcagctggaactctcatatgctgctggtaggaatgtaaaatggcacagtcctttggaaaatagtttgacactttcttcaaaagataaaacatacatttataaaaagacccagccattccactccttaggtacttacccaagagaaatgaaagcattaagtccacacaaacttacacataaatttctttgaaatagtgaaaacctggaaacaacccaatgtccatatgaaatgaccatgtaaattgtatatattgagacaattgaatactactgagtaataaagaagaatgaactactgataaagattgaaaatcaaaataataatgctgagtaaaagaagccagaaaaggaagtagatactccatgattcttttaatataaaattctcctaaatgcaaactaatgtatactgaccaaaagcaggtcagtcattgctcgaggacaagagtgggagggagagattaccaaagggcaggagaaaactttttggagtgacaggtatgttaattaactcacttgtagtgaacgtttcatgggggtgtacatatgtaaaaatcgtatatgttgtacgatttaaatacacgcaattaattgtaagtcagctaaccacaaaaagctgtagcaggaaaaaaaagcttgaaagggcctaatctgtgacaatttgactattaaaataaacacagattatgacttatgggacacaattcatattgatatgaaaatatcaattaaaatttcaaaaaataggccgggcgtggtggctcacacctgtaatcctagcactttgggaggctgaggcgggcagatcacctgaggtcaggagttcgaaagcagcctggccaacatggtgaaacccagtctctactaaaaatacaaaaaaattagctggacatggtggcacatgcctgtaatcccggatacttgggaggctgaggcaggagaattgcttgaacccgggaggcggagactgcagtgagccgagatcacaccactgcactccaacctgggtgacgaagcgagacttcatctcaaaaaaaagaaaaaaaattcaaaaaataaaatttgacatgtttatttgatatatttaaaatatatcaaaataggtcaggtgtgatggctcacgtctgtaatcccggcactttgggagaccgaggcaggcagatcacttgaggtcatgttcgagaccagcctggccaacatggtgaaaccttgtctatactaaaaattcaaaaaaaaaaaaaaaatagccatgtgtggtggcatacgccagtaatcccagctactcaggaggctgaggcagaagaatcgcttgaaatggggaggtggaggttgcaatgagccaagatcacaccaccacactccagcatgagcaacagggcaagactctgtctcaaaaataagtaagtaaataaaataataaaatatatcaaaatatataaaacaagttcatattgatataaaaataagaagagagtgccaactaacaaatgtagaaggaatgatggaattagaaaatcactatttggttagtcacaaatgattcgggtaagaatcatcaatggatgctaaaactagtatatgaaagtacaatgtcacaccagacatttagattctcaaagtacttctccagaattacttgttatgaagtgaaaaatattaactttactcagtgagaaacatggcaaatactagttgaaccaagtgaccaaagatattatcaggaatgggataaacagatatcatgtgcttttggacacacagcactgacgatccatggtactcctgccaaaaatgagaaacctctgccaactgaaaggcattctgcagaataaatgccctgaaaaagaaaactaaacaaaaaaaaaagctctacacttttcaaaaacaggaaaaggtataaaaaacaaagactaaggaatgttccaagaggtatgacaagtaaatgtaataaatgacttggggtgctaaaggatccaaacagtgcctacgattactctaattttcaagttaatggcttccttacttaactagtggttactaaagtctagctactgtcaccaatctgaaatatgtttctcacacattaaacttaataagtcaagctcatgtttaccttaactcctgctttgtaaatttttttggttttcaaataaggaaatgtaactgtcaatcaattcagcatttaagcaatcaccagtaaaacaaaataaaaagagattctcaaacaatattctggtgaattatcaagcacaatataggtaacgagttaccatgactatctttcttatgattctgtaaaacatctcttcaaattagtaatagcattcataatagcaataattttactactagaggagaaatattttcaaacgattgttcatatttttatgattttattcccaatttagaaatgcccacgtgtctgctgtgtgtttgtttaagtggctctgtatactgtgaagaagttgacattgatgctgtaccacccttaccaaaggaatcagcctatctttacgcacgattcaacaaaattaaaaagctgactgccaaagattttgcagacatacgtaagttaagctgaaatatgatattagtattaactcgtattagtatttaactcatataaacacaagtttctatatagttgctgcctatcacattcaggtttgtcacttgaagtacataaatatctaacatgtttcacaaaagtccattcatttgttggtgaatcatctttccacttagacagatcctgtgatctttctttactggtgacttcactgtctatgatgacagcccatctaacatatgggcaactatatcttctcaactccaatacttcaagatcccttgcttcagacactgagcaacaccaatataactgggatgcttctccaaccacaatgttttattttctacctggactataaaaacacagaaagtgctttttcttactttaactaatggctcttaaacctggctgcatattaaaaatatcttgggaagtgttttttttttctcccccctccccccaacccgacatggagtcttgctctgttgcccaggctggagtagagtggcgtgatcttggctcactgcaacctctgtctcccaggtttaagtggctctcctgtctcagcctctcacgtagctgaggtgtgtgccaccacacctggctaatatttgtatttttagtagagatggggtttcaccatgttggccaggctggtctggaactcctgaccttgtgatccgcccgcctcggcctcccaaagtgctgggaatacaggcgtgagccaccatgcccggcagggaagtattttttaaatactgatactaggtcctacttcccaggggttgtaattcagatctggggtagggcccaagcaacatcattaaaaacaaacaaactccttggatgattctaatatggaaatactgttgagaacagtggtatttaattccttaccaggtcattatcaatcttgaacttctagcaaaccttaactcagttagtgttgccataagcacaccagaatcctccatttctgcagtaccaaatcccagtcctagatcactaatttcttgtcagttttctagactcctaatattgtcaagagttctgaaaaaaatcacaccgagaaatgcatactagccccgctacacatttatgagactaaccataaccaggttcatgctgccactgatagctcccaaatgtggattgaagtatagttgatccttgttatttgtggattccatatttgtgaatacccacttgctaaaatttatttataaccccaaaattaatacacattgtgctttcatgggctttctcagacatgctcagagtggcaaaaaatttgaattacttgacatgcacattcccatctgaggttgaacaaggtaacactgtcttctggttccagttctcatactgtaaataaatgccctgttcacagtctatttaacgacatgtttttcacatttttgtgctttgtgtttatgattttgctgtttattgatttttgttttttggggggtttttttgtttgagacagggtctcgctctgttgcccaggctgaagtgcagtggtgtgatctcagctcactgcagcctctgcctcctgggttcaagggattcttgtccctcagtctcgcaagtagctgagactacaggcatgtgccaccacacctggttacttcttttattgtaatttaatttaatttaatttatttattttttgagatggagtcttactctgtcgcccaggctggagtgcagtggcaccatctcggctcactgctagctccgcctcccaggttcatgccattctcctgcctcagcttcccgagtagctgggactacaagtgctcgccaccacgcctggctaattttttttttttttttggtatttttagtagagatggggtttcaccgtgttagccaggatggtctcgatctcctgacctcatgatccgcccaccttggcctcccaaagtgctgggattacaggtgtgagccaccgcgcctggcctattataattttaatagagatgaggttgcgctgtgttggccaggctggtctcgaactcctgacctcaagtgatctgcccaccttggcctcccaaagtgctaggattacaggcataagccaccacacctggcctgattttgctgtttaacatgacccaacacatggtgctgaagtgacgtctaacatccccaagcacaaaaaggctgtgatatgcctacagggaaaatatgttagataaggtttgttcaggcatgagttatagtgcaatattaatgattcaacaatatatactcagccaagtgtccttaagcaaaaacacataaagttatatactaatagttgatggaaatgtgtggccagaggctcacaggaacataaccctgtatttctcctaggaataatggttcagtatttacaaattcaacacttgtggtaattttatagaacatgattcctgtgaataagaaacaattgatttcctaattatcccagatatacgtgatgcacacgcaagtacgcgcgcgcgcacacacacacacacacacacacactgaatttctctctcaatctgtgtcactttaacaaatcagggaacatctttgtctttgttgttgttaagcgataaggcatagagagattaagattaagataacatactcagaatcacaacgcaacatgccagcaaaaaaataaaaaaaattacatgattccaatcaaatgtaatgcttcctttccatgatttgcaacaagaatttctttcaaactgcctgaccatcccaaggaatttgaacagagaaagatgaaaagactcgattaactttaagatcactttcaaacctgagattctaggactccagtcagaaagggaatcaatttcaggcacaaagaggtgttcagtgatcattccacaaaactttactgggctatgaattgtaaacagtctaccaggcactaaaaatgaaagatgcttgagtgatctgttaaacaaatgcttttcttcagtccatacaataagaattttacttacgtagttgttttttatatttttttccctctagctaacttaagaagactcgattttacaggaaatttgatagaagatatagaagatggtactttttcaaaactttctctgttagaagaactttcacttgctgaaaatcaactactaaaacttccagttcttcctcccaagctcactttatttaatgcaaaatacaacaaaatcaagagtaggggaatcaaagcaaatgcattcaaagtaagtattttatagtaaaactaagcatagtatgagtgatgatatgatagataaaagagaaactttggtctagaattgtattttgattacacttaaaaactattttgatttaataaatgaagacattatttacataataaataaccatcctattaggctcattcagcctagcttatacccatatctcagttaaaatacataacctttattttatttcatgggactattttgtttctcattttttcacttgttcatacagcaaatatttatttagacagacatggttggccctctcatgacacttacagtctacgaaagctcaaaatgggatatttcctgtgtttctttttccttacaatgttagcaaattataaacaccagaaaaaaataaagatccaaaagtaaatactgaatttaacttttaatatttaaagatattagactgtgaaattctatagggagattttcctttgaatttcatgagagcatgtaatataaaattttatatgtagtaagaattaaatacatttcttaacaattcaagcaaatattatgtaggaaaaagggaaagtaatctacttcggtttaggtagacaatttgtctcaaaatgcatgacctacaggagtaatcactttagtccaggatttccatagctctgatgtaatcattccccagataaaatgatgaccatgccattgctggtaacagacataatctcattcaaaaggcaaggtttcttgcttctaaaggtaacttcggaaactatcaaatattcattatcataaagtttatgataatcacacacaggtaaattctgtcaaaaaatgtacaatctgttagaaagtgtacaaatagtccattttttcatttttcattacaattaaggtatctttattcaactttaagggacattttaaagttacatcagagctcatctgatgtttcttataaggaactcagaagttaagggactcttagaggactttttaaaagcagatacaccttttttttttttttttttgagatggagtcttgctctgtcacccaggctggagtgcagtggcgtgatcttggcttactgcaacctccgcctcccaggtttgagcaattctcctgcctcagcctcccaagtggctgggactacaggcacacaccaccacgcccggctaatttctacacttttagtagagatgggtgttggccaggctggtcttgaactcctgacctcaggtgatccgcccactttggcctcccaaagtgctaggattacaggcgtaagccaccgtgcctggcctttttttttttgttttaaagttgtaatttgaaaatattaatttgagttggtcactctttgaataacagacatgttaaagacctataaaagttgatgcaggacaggttcagtggctcacgcctataatcccagcactttaggaggatgaggcaggcggatcacttgaggtcaggaggtcaggaccagcctggccaacatggtgaaactctgtctccactaaaaatacaaaaattagctaggcgtggtggtgggcgcctgtagtcccagctactcaggaggctgaggcacaagaattgcttgaacctgggaggcagaagttgcagtgaactgctgagattgtaccactgcactccagcctgggccacagagcaagattcagtctccaaaaaaaaaggagctgatcaacatttcacaaaaagaacatttgaatattctggggtttagacaggaattacagaagggatttatgacaagttggtatgaaaataataaacttggccaggcacggtggctcatgcctgtaatcctagcactttgggaggccaaggcgggcagattgcctgagctcaagagttcgagaccagcctgggcaacatggtgaaaccctgtctctactgaaatacaaaaaattagctgggcgtggtggtgggcacctgtcgtcccagctactcaggaggctgaggcaggagaattgctttaacctgggaggcggaggttgcagtgagctcagatcatgacactgcactacagcctgggcaacagagtgagactccatctctaaaaaaaaagaaaagaaaataataaattcagctgccctatagttttgtttaatgtcctaagctgctacagtcactagtagaattaggttattctacctcatgtaaatgagactcactgggaagacaagagcttgatgcccacatggtggaagggtagggtgcttaagaaagtattaaaatagcaacacagaaaagaattagcaaaatctaccacaggatacatattgaagataaggtaaaagagtaatgtcaggggaaattacaattatacacaataatgggttactgatcatgaagaataatccaacattaagcccttagggaaaaaacctgcatcaagctaactgtttgctaaactgctttgggaaacatcttgctaagaacacatttttttttttttttcttgagatggagtctcgttctgtggcccaggctggagtgcagtggcacaatctcggctcactgcaacctccaccccctgggttcaagcaattctcctgcctcactcaggctccctagtagctgggattacaggcatgtgctaccacaccagttaatttttgtatttttagtagaaatggggtttcaccatgttggccaggctggtctcgaactcctgacctcaagtgatccacccacattgacctctcaaagtactgggattacaggcgtgagccaccatgcccggctaagcacacacatttcttttttttttttttttttttttctttttgagacagagtctcgctctgttgcccaggctgtagtacagtggtgcgatctcagctcactgcaagctctgcctcctgggttcacagcattctcctgcctcagcctcccgagtagctgggactacaggcgcccaccaccacgcctgtctaattttttgtatttttttaggccgggcatggtggctcacacctgtaatcccagcactttgggaggctgaggcgggcagatcacgaggtcaggaaatcgataccataccagccaacatggtgaaacctcgtctctactaaaaacatacaagcacacacatttctaagaagtaaccacttagctagaaattggtggaactgagatgggaaactccagaggtacaggagaggttatggcagcaccagggtcaaaattcaatcccacatagggactcacctcattagttcctatcaagacaaacacaaagagtaccagaagttggcattagagccggatattcagagatcagatgaatggacagaagtgtggggtatgcggcagagctccactggccatcataaaggatcaaaatacactacacgtgaagtcagaaaaaaaacccaaacaagaaactaccatacgaacaattgatataattgatgtattcatatcaatatgcaagtctgtatatatagacatatactcatatgcacatatatattgcttgaatcctgtgaaagaatgtacagaacctcaataacactcacatgaaattttccttacagaaactgaataacctcaccttcctctacttggaccataatgccctggaatccgtgcctcttaatttaccagaaagtctacgtgtaattcatcttcaggtatgatagttcctttcacaatatctgactctaattacctatgagtcaaaatcttgtgactcattgggaacctcacttattcacatacaaattttggttagatcactgtagtagcgtgatagctaaatgtctgcctatcaaaaagattaatactaggctcatgaactttcttcccagaagtccagattccatccagagcataacaagtagaccagcacagtacgtgtgaagtctgctcttgattgtatttgtctccaggtgtacatttgagtatttcctaattaatttgacacaaggatttgaagtgagggggcactcagacctctgacttaggtttcctttacccattatatagcatatgaaaggttgatttcagatttctgaacaatgttttcctcgttttttttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattggtttaatattaaccttgtatctcattttgaaggaatttaatattttaagcaaggatgttcaaaatcttacatataataagtaaaaagtaagactgaatgtctacgttcgaaacaaagtaatatgaaaatatttaaacagcattacaaaatcctagtttatactagactaccatttaaaaatcatgtttttatataaatgcccaaatttgagatgcattattcctattactaatgatgtaagtacgaggataaatccaagaaactttcaactctttgcctttcctggcctttactggatcccaaaagcatttaaggtacatgttccaaaaactttgaaaagctaaatgtttcccatgatcgctcattcttcttttatgattcatacgttattccttataaagtaagaactttgttttcctcctatcaaggcagctattttattaaatttttcacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattctgtggtgccagtgcacactaccttcccacccatacacatccatgttcactgtaacaaactgaatattcacaataaagcttctgagtaacactttctgattactcatgataaactgacatggctaactgcaagaattaaatcttctatctgagagtaataatttatgatgactcagtggtgccagagtaaagtttctaaaataacattcctctcacttgtaccccactaaaagtattagactacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaatagaagggttctgttttatttggaaaaattgaatctttaaactatcataatcttgaatgactgtcatctttctagttttcagaaaaataatgtattcctatattatttttatgataaaacttatggagcaaaacaccatcaaataactctcaaattaagaaaaaattcaaaagtcagtagttttagataagataatgataagggagaaagaacattggtaaaaggtatgaattccagaattaaagaaataatttggggatttctagataagaggatatatatgaacatgcataccttacaccttcatatacacaaccttaaatcacaaataaaacaaaataaacaatacaaattataccaccaagattcagaagatatcagacgaaataattagagaaagtaaaaatatgctgtctccattatattcataatgtttcattcttgacactaataattagaggctttaaatttttaaatgatttactttttactaacattgctgaaaaaaactaaagacatacataaatggaaagatgtcttgtgtttatggatggtaagatttaatgttgttaagacaacaatactatccaatatgatatgcagactgaacacagttgccatcaaaatctcaatgatgctttcacacaaataaaatggaacttcaagagacccccaaataaagagaagaatcttgaaaataagaataaagatagaagactcacatttcctaacttcaacatttacaacaaagatacagtaatgaaaacagtgtgtggctgggcgcaatggctcacacctgtaatcccagcactttgtgaggctgaggcgggtggattacttgaggtcaggagttcgagaccagcctggccaacatggttaaactctgtctctattaaaaattccaaaaaattagccgggtgtggtggcgggtgcctgtaatcccagctactgggaggctgaggcaggagaatcgcttgaccaggaggcggaggttgcagtgagccaagatcgcatcactgcactctagcctaggcgacagagcaagactctgtctaaaaaaaaaaaaaaaaaaaaaaaaaggaaaacagtgtggtactagcgtaagtacagacatatagaccaacagaataaattaaacagcccagaaataaacccttccaaatagggtcagatacttttcaacaaaagtacaaagaccattcagtggagaacgccagtctcttcaacaatggtgctgggaaaactggatatccatatacaaaagaatgaagttggacacctaccttatgtaatatttaaaaacaaactaaaagacctaaacttaagggttaaattataaaattcttagagaaaatatagaggaaaa

SEQ ID NO: 15689 - DNA, 22871 bp, Human; identical to SEQ ID NO: 15688

SEQ ID NO: 15690 - DNA, 44653 bp, Human; identical to SEQ ID NO: 11944
